US012773462B2

(12) United States Patent
Deverman et al.

(10) Patent No.: US 12,773,462 B2
(45) Date of Patent: Oct. 27, 2026

(54) SYSTEMS FOR EVOLVED ADENO-ASSOCIATED VIRUSES (AAVs) FOR TARGETED DELIVERY

(71) Applicant: The Broad Institute, Inc., Cambridge, MA (US)

(72) Inventors: Benjamin E. Deverman, Cambridge, MA (US); Qin Huang, Cambridge, MA (US); Ken Y. Chan, Cambridge, MA (US)

(73) Assignee: The Broad Institute, Inc., Cambridge, MA (US)

( * ) Notice: Subject to any disclaimer, the term of this patent is extended or adjusted under 35 U.S.C. 154(b) by 1398 days.

(21) Appl. No.: 17/427,213

(22) PCT Filed: Jan. 30, 2020

(86) PCT No.: PCT/US2020/015972

§ 371 (c)(1),
(2) Date: Jul. 30, 2021

(87) PCT Pub. No.: WO2020/160337

PCT Pub. Date: Aug. 6, 2020

(65) Prior Publication Data

US 2022/0143214 A1 May 12, 2022

Related U.S. Application Data

(60) Provisional application No. 62/798,961, filed on Jan. 30, 2019.

(51) Int. Cl.
*C12N 15/86* (2006.01)
*A61K 48/00* (2006.01)
(Continued)

(52) U.S. Cl.
CPC ............ *A61K 48/005* (2013.01); *C12N 15/86* (2013.01); *C12N 2750/14122* (2013.01);
(Continued)

(58) Field of Classification Search
CPC .......... C12N 15/86; C12N 2750/14122; C12N 2750/14143; G01N 33/566; C07K 14/005
See application file for complete search history.

(56) References Cited

U.S. PATENT DOCUMENTS 5,552,157 A 9/1996 Yagi et al.
5,565,213 A 10/1996 Nakamori et al.
(Continued)

FOREIGN PATENT DOCUMENTS

WO WO 2008/103962 A2 8/2008
WO WO 2015/038958 A1 3/2015
(Continued)

OTHER PUBLICATIONS

Huang Q, Chan KY, Tobey IG, Chan YA, Poterba T, Boutros CL, Balazs AB, Daneman R, Bloom JM, Seed C, Deverman BE. Delivering genes across the blood-brain barrier: LY6A, a novel cellular receptor for AAV-PHP.B capsids. PLoS One. Nov. 14, 2019; 14(11):e0225206. PMID: 31725765; (Year: 2019).*
(Continued)

*Primary Examiner* — Gregory S Emch
*Assistant Examiner* — Michael Cameron Sveiven
(74) *Attorney, Agent, or Firm* — Wolf, Greenfield & Sacks, P.C.

(57) ABSTRACT

Methods for screening for an adeno-associated virus (AAV) capsid protein that can bind to a target protein (e.g., Ly6 protein) and related compositions are provided in aspects of the disclosure.

11 Claims, 32 Drawing Sheets

Specification includes a Sequence Listing.

(51) Int. Cl.
*C07K 14/005* (2006.01)
*G01N 33/566* (2006.01)

(52) U.S. Cl.
CPC .............. *C12N 2750/14143* (2013.01); *C12N 2750/14145* (2013.01); *C12N 2810/6027* (2013.01)

(56) References Cited

U.S. PATENT DOCUMENTS

| | | | |
|---|---|---|---|
| 5,567,434 | A | 10/1996 | Szoka, Jr. |
| 5,738,868 | A | 4/1998 | Shinkarenko |
| 5,741,516 | A | 4/1998 | Webb et al. |
| 5,795,587 | A | 8/1998 | Gao et al. |
| 7,198,951 | B2 | 4/2007 | Gao et al. |
| 9,585,971 | B2 | 3/2017 | Deverman et al. |
| 2017/0166926 | A1 | 6/2017 | Deverman et al. |
| 2021/0403946 | A1 | 12/2021 | Deverman et al. |

FOREIGN PATENT DOCUMENTS

| | | | | |
|---|---|---|---|---|
| WO | WO-2017100671 | A1 * | 6/2017 | ................ A61P 9/00 |
| WO | WO2018017754 | A1 * | 1/2018 | ............. A61K 38/46 |
| WO | WO 2019/211401 | A1 | 11/2019 | |
| WO | WO 2020/014471 | A1 | 1/2020 | |
| WO | WO 2020/028751 | A3 | 2/2020 | |
| WO | WO 2020/068990 | A1 | 4/2020 | |
| WO | WO 2020/160337 | A1 | 8/2020 | |

OTHER PUBLICATIONS

Invitrogen TRIzol Reagent Product Page (https://www.thermofisher.com/order/catalog/product/15596026) (Year: 2025).*

B Sivasankar, RM Donev, MP Longhi, TR Hughes, R Davies, DS Cole, BP Morgan, KJ Marchbank, CD59a deficient mice display reduced B cell activity and antibody production in response to T-dependent antigens, Molecular Immunology, vol. 44, Issue 11, 2007, pp. 2978-2987 (Year: 2007).*

Partial European Search Report for Application No. 20747933.8, mailed Oct. 10, 2022.

Extended European Search Report for Application No. 20747933.8, mailed Jan. 11, 2023.

Invitation to Pay Additional Fees for Application No. PCT/US2020/015972, mailed Mar. 18, 2020.

International Search Report and Written Opinion for Application No. PCT/US2020/015972, mailed May 21, 2020.

International Preliminary Report on Patentability for Application No. PCT/US2020/015972, mailed Aug. 12, 2021.

[No Author Listed], Genbank Submission; NCBI, Accession No. XP_001381054.1; Predicted: similar to olfactory receptor Olr218 [Monodelphis domestica]; Feb. 27, 2007.

Akache et al., The 37/67-kilodalton laminin receptor is a receptor for adeno-associated virus serotypes 8, 2, 3, and 9. J Virol. Oct. 2006;80(19):9831-6. doi: 10.1128/JVI.00878-06.

Albright et al., Discovery of a Neurotropic Footprint That Enables AAV Transport Across the Blood-Brain Barrier. Mol Ther. 2017; 25(5): 230-231.

Allen et al., Global Representations of Goal-Directed Behavior in Distinct Cell Types of Mouse Neocortex. Neuron. May 17, 2017;94(4):891-907.e6. doi: 10.1016/j.neuron.2017.04.017.

Aurnhammer et al., Universal real-time PCR for the detection and quantification of adeno-associated virus serotype 2-derived inverted terminal repeat sequences. Hum Gene Ther Methods. Feb. 2012;23(1):18-28. doi: 10.1089/hgtb.2011.034.

Aurnhammer et al., Universal real-time PCR for the detection and quantification of adeno-associated virus serotype 2-derived inverted terminal repeat sequences. Hum Gene Ther Methods. Feb. 2012;23(1):18-28. Supplementary Information. 2 pages.

Bedbrook et al., Machine learning-guided channelrhodopsin engineering enables minimally invasive optogenetics. Nat Methods. Nov. 2019;16(11):1176-1184. doi: 10.1038/s41592-019-0583-8. Epub Oct. 14, 2019.

Bedbrook et al., Viral Strategies for Targeting the Central and Peripheral Nervous Systems. Annu Rev Neurosci. Jul. 8, 2018;41:323-348. doi: 10.1146/annurev-neuro-080317-062048. Epub Apr. 25, 2018.

Bell et al., Identification of the galactose binding domain of the adeno-associated virus serotype 9 capsid. J Virol. Jul. 2012;86(13):7326-33. doi: 10.1128/JVI.00448-12. Epub Apr. 18, 2012.

Biswas et al., Toward machine-guided design of proteins. bioRxiv. Jun. 2, 2018; 1; 1-10. DOI: 10.1101/337154.

Bogan et al., Anatomy of hot spots in protein interfaces. J Mol Biol. Jul. 3, 1998;280(1):1-9. doi: 10.1006/jmbi.1998.1843.

Börner et al., Pre-arrayed Pan-AAV Peptide Display Libraries for Rapid Single-Round Screening. Mol Ther. Apr. 8, 2020;28(4):1016-1032. doi: 10.1016/j.ymthe.2020.02.009. Epub Feb. 13, 2020.

Brass et al., Identification of host proteins required for HIV infection through a functional genomic screen. Science. Feb. 15, 2008;319(5865):921-6. doi: 10.1126/science.1152725. Epub Jan. 10, 2008.

Bryant et al., Deep diversification of an AAV capsid protein by machine learning. Nat Biotechnol. Jun. 2021;39(6):691-696. doi: 10.1038/s41587-020-00793-4. Epub Feb. 11, 2021.

Chan et al., Engineered AAVs for efficient noninvasive gene delivery to the central and peripheral nervous systems. Nat Neurosci. Aug. 2017;20(8):1172-1179. doi: 10.1038/nn.4593. Epub Jun. 26, 2017.

Chao et al., Isolating and engineering human antibodies using yeast surface display. Nat Protoc. 2006;1(2):755-68. doi: 10.1038/nprot.2006.94.

Chinni et al., CXCL12/CXCR4 transactivates HER2 in lipid rafts of prostate cancer cells and promotes growth of metastatic deposits in bone. Mol Cancer Res. Mar. 2008;6(3):446-57. doi: 10.1158/1541-7786.MCR-07-0117.

Cray et al., Regulation and selective expression of Ly-6A/E, a lymphocyte activation molecule, in the central nervous system. Brain Res Mol Brain Res. Jun. 1990;8(1):9-15. doi: 10.1016/0169-328x(90)90003-v.

Dalkara et al., In vivo-directed evolution of a new adeno-associated virus for therapeutic outer retinal gene delivery from the vitreous. Sci Transl Med. Jun. 12, 2013;5(189):189ra76. doi: 10.1126/scitranslmed.3005708.

Danecek et al., Twelve years of SAMtools and BCFtools. Gigascience. Feb. 16, 2021;10(2):giab008. doi: 10.1093/gigascience/giab008.

Davis et al., Rational design and engineering of a modified adeno-associated virus (AAV1)-based vector system for enhanced retrograde gene delivery. Neurosurgery. Feb. 2015;76(2):216-25; discussion 225. doi: 10.1227/NEU.0000000000000589.

Dayton et al., More expansive gene transfer to the rat CNS: AAV PHP.EB vector dose-response and comparison to AAV PHP.B. Gene Ther. Aug. 2018;25(5):392-400. doi: 10.1038/s41434-018-0028-5. Epub Jul. 16, 2018.

Deutscher et al., Mechanism of galactosylation in the Golgi apparatus. A Chinese hamster ovary cell mutant deficient in translocation of UDP-galactose across Golgi vesicle membranes. J Biol Chem. Jan. 5, 1986;261(1):96-100.

Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.

Eichhoff, Nanobodies as tools for optimizing adeno-associated viruses for gene and tumor therapy. Dissertation, University of Hamburg. May 4, 2018. URL: https://ediss.sub.uni-hamburg.de/volltexte/2018/9158/.

Excoffon et al., Directed evolution of adeno-associated virus to an infectious respiratory virus. Proc Natl Acad Sci U S A. Mar. 10, 2009;106(10):3865-70. doi: 10.1073/pnas.0813365106. Epub Feb. 23, 2009.

Flytzanis et al., Broad gene expression throughout the mouse and marmoset brain after intravenous delivery of engineered AAV capsids. bioRxiv. 2020;1:1-21.

Fu et al., Crossing the blood-brain-barrier with viral vectors. Curr Opin Virol. Dec. 2016;21:87-92. doi: 10.1016/j.coviro.2016.08.006. Epub Sep. 1, 2016.

(56) References Cited

OTHER PUBLICATIONS

Fujimura et al., A lipid raft-associated 67kDa laminin receptor mediates suppressive effect of epigallocatechin-3-O-gallate on FcepsilonRI expression. Biochem Biophys Res Commun. Oct. 21, 2005;336(2):674-81. doi: 10.1016/j.bbrc.2005.08.146.
Gao et al., Clades of Adeno-associated viruses are widely disseminated in human tissues. J Virol. Jun. 2004;78(12):6381-8. doi: 10.1128/JVI.78.12.6381-6388.2004.
Gao et al., Therapeutic Delivery of Butyrylcholinesterase by Brain-Wide Viral Gene Transfer to Mice. Molecules. Jul. 8, 2017;22(7):1145. doi: 10.3390/molecules22071145.
Gibson et al., Adeno-Associated Viral Gene Therapy Using PHP. B:NPC1 Ameliorates Disease Phenotype in Mouse Model of Niemann-Pick C 1 Disease (conference paper). American Society of Gene and Cell Therapy Annual Meeting. Washington, DC, USA. (May 10-13, 2017).
Girod et al., Genetic capsid modifications allow efficient re-targeting of adeno-associated virus type 2. Nat Med. Sep. 1999;5(9):1052-6. doi: 10.1038/12491.
Guida et al., Mouse adenovirus type 1 causes a fatal hemorrhagic encephalomyelitis in adult C57BL/6 but not BALB/c mice. J Virol. Dec. 1995;69(12):7674-81. doi: 10.1128/JVI.69.12.7674-7681. 1995.
Hanlon et al., Selection of an Efficient AAV Vector for Robust CNS Transgene Expression. Mol Ther Methods Clin Dev. Oct. 23, 2019;15:320-332. doi: 10.1016/j.omtm.2019.10.007. eCollection Dec. 13, 2019.
Hillier et al., Causal evidence for retina-dependent and -independent visual motion computations in mouse cortex. Nat Neurosci. Jul. 2017;20(7):960-968. doi: 10.1038/nn.4566. Epub May 22, 2017.
Hochreiter et al., Long short-term memory. Neural Comput. Nov. 15, 1997;9(8):1735-80. doi: 10.1162/neco.1997.9.8.1735.
Hordeaux et al., The Neurotropic Properties of AAV-PHP.B Are Limited to C57BL/6J Mice. Mol Ther. Mar. 7, 2018;26(3):664-668. doi: 10.1016/j.ymthe.2018.01.018. Epub Feb. 2, 2018.
Huang et al., Delivering genes across the blood-brain barrier: LY6A, a novel cellular receptor for AAV-PHP.B capsids. PLoS One. Nov. 14, 2019;14(11):e0225206. doi: 10.1371/journal.pone.0225206. eCollection 2019.
Huang et al., Parvovirus glycan interactions. Curr Opin Virol. Aug. 2014;7:108-18. doi: 10.1016/j.coviro.2014.05.007. Epub Jul. 19, 2014.
Jackson et al., Better Targeting, Better Efficiency for Wide-Scale Neuronal Transduction with the Synapsin Promoter and AAV-PHP. B. Front Mol Neurosci. Nov. 4, 2016;9:116. doi: 10.3389/fnmol. 2016.00116. eCollection 2016.
Jarvinen et al., Systemically Administered, Target Organ-Specific Therapies for Regenerative Medicine. Int J Mol Sci. Sep. 30, 2015;16(10):23556-71. doi: 10.3390/ijms161023556.
Kariolis et al., Brain delivery of therapeutic proteins using an Fc fragment blood-brain barrier transport vehicle in mice and monkeys. Sci Transl Med. May 27, 2020;12(545):eaay1359. doi: 10.1126/scitranslmed.aay1359.
Keane et al., Mouse genomic variation and its effect on phenotypes and gene regulation. Nature. Sep. 14, 2011;477(7364):289-94. doi: 10.1038/nature10413.
Kikkert et al., Binding of Tomato Spotted Wilt Virus to a 94-kDa Thrips Protein. Phytopathology. Jan. 1998;88(1):63-9. doi: 10.1094/PHYTO.1998.88.1.63.
Körbelin et al., A brain microvasculature endothelial cell-specific viral vector with the potential to treat neurovascular and neurological diseases. EMBO Mol Med. Jun. 1, 2016;8(6):609-25. doi: 10.15252/emmm.201506078. Print Jun. 2016.
Kotterman et al., Engineered AAV vectors for improved central nervous system gene delivery. Neurogenesis. Dec. 3, 2015;2(1):e1122700. doi: 10.1080/23262133.2015.1122700. eCollection 2015.
Krishnan et al., RNA interference screen for human genes associated with West Nile virus infection. Nature. Sep. 11, 2008;455(7210):242-5. doi: 10.1038/nature07207.
Kumar et al., Multiplexed Cre-dependent selection yields systemic AAVs for targeting distinct brain cell types. Nat Methods. May 2020;17(5):541-550. doi: 10.1038/s41592-020-0799-7. Epub Apr. 20, 2020.
Langmead et al., Fast gapped-read alignment with Bowtie 2. Nat Methods. Mar. 4, 2012;9(4):357-9. doi: 10.1038/nmeth.1923.
Li et al., Single amino acid modification of adeno-associated virus capsid changes transduction and humoral immune profiles. J Virol. Aug. 2012;86(15):7752-9. doi: 10.1128/JVI.00675-12. Epub May 16, 2012.
Li et al., The Sequence Alignment/Map format and SAMtools. Bioinformatics. Aug. 15, 2009;25(16):2078-9. doi: 10.1093/bioinformatics/btp352. Epub Jun. 8, 2009.
Lisowski et al., Selection and evaluation of clinically relevant AAV variants in a xenograft liver model. Nature. Feb. 20, 2014;506(7488):382-6. doi: 10.1038/nature12875. Epub Dec. 25, 2013.
Liu et al., Identification of chicken lymphocyte antigen 6 complex, locus E (LY6E, alias SCA2) as a putative Marek's disease resistance gene via a virus-host protein interaction screen. Cytogenet Genome Res. 2003;102(1-4):304-8. doi: 10.1159/000075767.
Loeuillet et al., In vitro whole-genome analysis identifies a susceptibility locus for HIV-1. PLoS Biol. Feb. 2008;6(2):e32. doi: 10.1371/journal.pbio.0060032.
Loughner et al., Organization, evolution and functions of the human and mouse Ly6/uPAR family genes. Hum Genomics 10, 10, doi:10.1186/s40246-016-0074-2.
Malek et al., Role of Ly-6 in lymphocyte activation. II. Induction of T cell activation by monoclonal anti-Ly-6 antibodies. J Exp Med. Sep. 1, 1986;164(3):709-22. doi: 10.1084/jem.164.3.709.
Mar et al., LY6E mediates an evolutionarily conserved enhancement of virus infection by targeting a late entry step. Nat Commun. Sep. 6, 2018;9(1):3603. doi: 10.1038/s41467-018-06000-y.
Marques et al., Applying machine learning to predict viral assembly for adeno-associated virus capsid libraries. Mol Ther Methods Clin Dev. Dec. 3, 2020;20:276-286. doi: 10.1016/j.omtm.2020.11.017. eCollection Mar. 12, 2021.
Mason et al., Deep learning enables therapeutic antibody optimization in mammalian cells by deciphering high-dimensional protein sequence space. bioRxiv. 2019;1:1-25.
Matochko et al., Deep sequencing analysis of phage libraries using Illumina platform. Methods. Sep. 2012;58(1):47-55. doi: 10.1016/j.ymeth.2012.07.006. Epub Jul. 20, 2012.
Matsuzaki et al., Intravenous administration of the adeno-associated virus-PHP.B capsid fails to upregulate transduction efficiency in the marmoset brain. Neurosci Lett. Feb. 5, 2018;665:182-188. doi: 10.1016/j.neulet.2017.11.049. Epub Nov. 24, 2017.
Mattheakis et al., An in vitro polysome display system for identifying ligands from very large peptide libraries. Proc Natl Acad Sci U S A. Sep. 13, 1994;91(19):9022-6. doi: 10.1073/pnas.91.19.9022.
Mayor et al., Sorting GPI-anchored proteins. Nat Rev Mol Cell Biol. Feb. 2004;5(2):110-20. doi: 10.1038/nrm1309.
Mccafferty et al., Phage antibodies: filamentous phage displaying antibody variable domains. Nature. Dec. 6, 1990;348(6301):552-4. doi: 10.1038/348552a0.
Mendell et al., Single-Dose Gene-Replacement Therapy for Spinal Muscular Atrophy. N Engl J Med. Nov. 2, 2017;377(18):1713-1722. doi: 10.1056/NEJMoa1706198.
Morabito et al., AAV-PHP.B-Mediated Global-Scale Expression in the Mouse Nervous System Enables GBA1 Gene Therapy for Wide Protection from Synucleinopathy. Mol Ther. Dec. 6, 2017;25(12):2727-2742. doi: 10.1016/j.ymthe.2017.08.004. Epub Aug. 10, 2017.
Müller et al., Random peptide libraries displayed on adeno-associated virus to select for targeted gene therapy vectors. Nat Biotechnol. Sep. 2003;21(9):1040-6. doi: 10.1038/nbt856. Epub Aug. 3, 2003.
Münch et al., Off-target-free gene delivery by affinity-purified receptor-targeted viral vectors. Nat Commun. Feb. 10, 2015;6:6246. doi: 10.1038/ncomms7246.
Nathwani et al., Advances in Gene Therapy for Hemophilia. Hum Gene Ther. Nov. 2017;28(11):1004-1012. doi: 10.1089/hum.2017. 167.

(56) References Cited

OTHER PUBLICATIONS

Nonnenmacher et al., Adeno-Associated Virus 2 Infection Requires Endocytosis through the CLIC/GEEC Pathway. Cell Host Microbe. Dec. 15, 2011; 10(6): 563-76.
Nonnenmacher et al., Rapid evolution of blood-brain-barrier-penetrating AAV capsids by RNA-driven biopanning. Mol Ther Methods Clin Dev. Dec. 23, 2020;20:366-378. doi: 10.1016/j.omtm.2020.12.006. eCollection Mar. 12, 2021.
Ogden et al., Comprehensive AAV capsid fitness landscape reveals a viral gene and enables machine-guided design. Science. Nov. 29, 2019;366(6469):1139-1143. doi: 10.1126/science.aaw2900.
Ojala et al., In Vivo Selection of a Computationally Designed Schema AAV Library Yields a Novel Variant for Infection of Adult Neural Stem Cells in the SVZ. Mol Ther. Jan. 3, 2018;26(1):304-319. doi: 10.1016/j.ymthe.2017.09.006. Epub Sep. 8, 2017.
Ortega et al., Role of Ly-6 in lymphocyte activation. I. Characterization of a monoclonal antibody to a nonpolymorphic Ly-6 specificity. J Immunol. Nov. 15, 1986;137(10):3240-6.
Paulk et al., Bioengineered Viral Platform for Intramuscular Passive Vaccine Delivery to Human Skeletal Muscle. Mol Ther Methods Clin Dev. Jul. 24, 2018;10:144-155. doi: 10.1016/j.omtm.2018.06.001. eCollection Sep. 21, 2018.
Pierleoni et al., PredGPI: a GPI-anchor predictor. BMC Bioinformatics. Sep. 23, 2008;9:392. doi: 10.1186/1471-2105-9-392.
Pillay et al., AAV serotypes have distinctive interactions with domains of the cellular receptor AAVR. J Virol. Aug. 24, 2017;91(18):e00391-17. doi: 10.1128/JVI.00391-17. Print Sep. 15, 2017.
Pillay et al., An essential receptor for adeno-associated virus infection. Nature. Feb. 4, 2016;530(7588):108-12. doi: 10.1038/nature16465. Epub Jan. 27, 2016.
Pulicherla et al., Engineering liver-detargeted AAV9 vectors for cardiac and musculoskeletal gene transfer. Mol Ther. Jun. 2011;19(6):1070-8. doi: 10.1038/mt.2011.22. Epub Mar. 1, 2011.
Qian et al., Directed Evolution of AAV Serotype 5 for Increased Hepatocyte Transduction and Retained Low Humoral Seroreactivity. Mol Ther Methods Clin Dev. Oct. 20, 2020;20:122-132. doi: 10.1016/j.omtm.2020.10.010. eCollection Mar. 12, 2021.
Ran et al., In vivo genome editing using *Staphylococcus aureus* Cas9. Nature. Apr. 9, 2015;520(7546):186-91. doi: 10.1038/nature14299. Epub Apr. 1, 2015.
Ravina et al., Intraputaminal AADC gene therapy for advanced Parkinson's disease: interim results of a phase 1b Trial [abstract]. Human Gene Therapy. Dec 1, 2017; 28(12): A6. Accessed at: https://doi.org/10.1089/hum.2017.29055.abstracts.
Ravn et al., By-passing in vitro screening—next generation sequencing technologies applied to antibody display and in silico candidate selection. Nucleic Acids Res. Nov. 2010;38(21):e193. doi: 10.1093/nar/gkq789. Epub Sep. 15, 2010.
Riesselman et al., Accelerating Protein Design Using Autoregressive Generative Models. BioRxiv. 2019; 1: 1-7.
Rolnick et al., Deep Learning is Robust to Massive Label Noise. ArXiv. 2018; 3: 1-10.
Sago et al., High-throughput in vivo screen of functional mRNA delivery identifies nanoparticles for endothelial cell gene editing. Proc Natl Acad Sci U S A. Oct. 16, 2018;115(42):E9944-E9952. doi: 10.1073/pnas.1811276115. Epub Oct. 1, 2018.
Sago et al., Nanoparticles That Deliver RNA to Bone Marrow Identified by in Vivo Directed Evolution. J Am Chem Soc. Dec. 12, 2018;140(49):17095-17105. doi: 10.1021/jacs.8b08976. Epub Nov. 16, 2018.
Sah, Safety and Increased Transduction Efficiency in the Adult Nonhuman Primate Central Nervous System with Intravenous Delivery of Two Novel Adeno-Associated Virus Capsids [abstract 0661]. American Society of Gene and Cell Therapy Annual Meeting. Chicago, IL, USA. Molecular Therapy. (May 16-19, 2018).
Saha et al., GPI-anchored protein organization and dynamics at the cell surface. J Lipid Res. Feb. 2016;57(2):159-75. doi: 10.1194/jlr.R062885. Epub Sep. 22, 2015.
Shen et al., Terminal N-Linked Galactose Is the Primary Receptor for Adeno-associated Virus 9. J Biol Chem. Apr. 15, 2011;286(15):13532-40. doi: 10.1074/jbc.M110.210922. Epub Feb. 17, 2011.
Simon et al., Epithelial cell adhesion molecule-targeted drug delivery for cancer therapy. Expert Opin Drug Deliv. Apr. 2013;10(4):451-68. doi: 10.1517/17425247.2013.759938. Epub Jan. 14, 2013.
Sinai et al., A primer on model-guided exploration of fitness landscapes for biological sequence design. ArXiv. Oct. 23, 2020; 2:1-43.
Smith, Filamentous fusion phage: novel expression vectors that display cloned antigens on the virion surface. Science. Jun. 14, 1985;228(4705):1315-7. doi: 10.1126/science.4001944.
Spindler et al., The major locus for mouse adenovirus susceptibility maps to genes of the hematopoietic cell surface-expressed LY6 family. J Immunol. Mar. 15, 2010;184(6):3055-62. doi: 10.4049/jimmunol.0903363. Epub Feb. 17, 2010.
Summerford et al., AAVR: A Multi-Serotype Receptor for AAV. Mol Ther. Apr. 2016;24(4):663-6. doi: 10.1038/mt.2016.49.
Tabuchi et al., Multi-line split DNA synthesis: a novel combinatorial method to make high quality peptide libraries. BMC Biotechnol. Sep. 1, 2004:4:19. doi: 10.1186/1472-6750-4-19.
Tervo et al., A Designer AAV Variant Permits Efficient Retrograde Access to Projection Neurons. Neuron. Oct. 19, 2016;92(2):372-382. doi: 10.1016/j.neuron.2016.09.021. Epub Oct. 6, 2016.
Traxlmayr et al., Strong Enrichment of Aromatic Residues in Binding Sites from a Charge-neutralized Hyperthermostable Sso7d Scaffold Library. J Biol Chem. Oct. 21, 2016;291(43):22496-22508. doi: 10.1074/jbc.M116.741314. Epub Aug. 30, 2016.
Tse et al., Structure-guided evolution of antigenically distinct adeno-associated virus variants for immune evasion. Proc Natl Acad Sci U S A. Jun. 13, 2017;114(24):E4812-E4821. doi: 10.1073/pnas.1704766114. Epub May 30, 2017.
Van De Rijn et al., Mouse hematopoietic stem-cell antigen Sca-1 is a member of the Ly-6 antigen family. Proc Natl Acad Sci U S A. Jun. 1989;86(12):4634-8. doi: 10.1073/pnas.86.12.4634.
Weinmann et al., Identification of a myotropic AAV by massively parallel in vivo evaluation of barcoded capsid variants. Nat Commun. Oct. 28, 2020;11(1):5432. doi: 10.1038/s41467-020-19230-w.
Whitehead et al., Optimization of affinity, specificity and function of designed influenza inhibitors using deep sequencing. Nat Biotechnol. May 27, 2012;30(6):543-8. doi: 10.1038/nbt.2214.
Yalcin et al., Sequence-based characterization of structural variation in the mouse genome. Nature. Sep. 14, 2011;477(7364):326-9. doi: 10.1038/nature10432.
Yang et al., Machine-learning-guided directed evolution for protein engineering. Nat Methods. Aug. 2019;16(8):687-694. doi: 10.1038/s41592-019-0496-6. Epub Jul. 15, 2019.
Zelikowsky et al., The Neuropeptide Tac2 Controls a Distributed Brain State Induced by Chronic Social Isolation Stress. Cell. May 17, 2018;173(5):1265-1279.e19. doi: 10.1016/j.cell.2018.03.037.
Zhang et al., An RN A-sequencing transcriptome and splicing database of glia, neurons, and vascular cells of the cerebral cortex. J Neurosci. Sep. 3, 2014;34(36):11929-47. doi: 10.1523/JNEUROSCI.1860-14.2014.
Zhang et al., Protein structure and sequence re-analysis of 2019-nCoV genome does not indicate snakes as its intermediate host or the unique similarity between its spike protein insertions and HIV-1. bioRxiv. Feb. 8, 2020;2020.02.04.933135. doi: 10.1101/2020.02.04.933135. Preprint.
Zurzolo et al., Glycosylphosphatidylinositol-anchored proteins: Membrane organization and transport. Biochim Biophys Acta. Apr. 2016;1858(4):632-9. doi: 10.1016/j.bbamem.2015.12.018. Epub Dec. 17, 2015.

* cited by examiner

FIG. 5E
Selected on cells expressing Ly6c1 ($10^{11}$ vg/mouse)
AAV(Ly6c1-C1)
AAV(Ly6c1-C2)
AAV(Ly6c1-C5)
NLS-GFP
C57BL/6J
BALB/cJ

| Approved gene symbol (NCBI accession #) | Gene name | Alias(es) | Genomic location | Number of | |
|---|---|---|---|---|---|
| | | | | Exons | LU Domains |
| *ACRV1* (NP_001603.1) | Acrosomal vesicle protein 1 | *SP-10; SPACA2; D11S4365* | 11q24.2 | 5 | 1 |
| *CD177* (BAE93254.1) | CD177 molecule (Human Neutrophil Alloantigen 2A) | *NB1; PRV1; HNA2A; PRV-1; HNA-2a; NB1 GP* | 19q13.2 | 9 | 2 |
| *CD59* (CAG46523.1) | CD59 molecule, complement regulatory protein | *1 F5; EJ16; EJ30; EL32; G344; MIN1; MIN2; MIN3; MIRL; HRF20; MACIF; MEM43; MIC11; MSK21; 16.3A5; HRF-20; MAC-IP; p18-20* | 11p13 | 5 | 1 |
| *GML* (EAW82296.1) | Glycosylphosphatidylinositol anchored molecule like | *LY6DL* | 8q24.3 | 5 | 1 |
| *GPIHBP1* (AAH35810.2) | Glycosylphosphatidylinositol anchored high density lipoprotein-binding protein 1 | *HYPL1D; GPI-HBP1* | 8q24.3 | 4 | 1 |
| *LY6D* (AAH31330.1) | Lymphocyte antigen 6 complex, locus D | *E48; Ly-6D* | 8q24 | 3 | 1 |
| *LY6E* (AAH03392.1) | Lymphocyte antigen 6 complex, locus E | *RIGE; SCA2; RIG-E; SCA-2; TSA-1* | 8q24.3 | 4 | 1 |
| *LY6G5B* (CAC85543.1) | Lymphocyte antigen 6 complex, locus G5B | *G5b; C6orf19* | 6p21.3 | 3 | 1 |
| *LY6G5C* (CAC85542.1) | Lymphocyte antigen 6 complex, locus G5C | *G5C; NG33; C6orf20; LY6G5CA; LY6G5CB* | 6p21 | 3 | 1 |
| *LY6G6C* (EAX03491.1) | Lymphocyte antigen 6 complex, locus G6C | *G6c; NG24; C6orf24* | 6p21 | 3 | 1 |
| *LY6G6D* (CAC85540.1) | Lymphocyte antigen 6 complex, locus G6D | *G6D; NG25; LY6-D; MEGT1; C6orf23* | 6p21.3 | 3 | 1 |
| *LY6G6F* (AAI37213.1) | Lymphocyte antigen 6 complex, locus G6F | *G6f; NG32; LY6G6D; C6orf21* | 6p21.33 | 6 | 1 |
| *LY6H* (BAA34115.1) | Lymphocyte antigen 6 complex, locus H | *NMLY6* | 8q24.3 | 4 | 1 |
| *LY6K* (AAI17145.1) | Lymphocyte antigen 6 complex, locus K | *CT97; ly-6 K; URLC10; HSJ001348* | 8q24.3 | 3 | 1 |
| *LY6L*[a] (XP_011544859.1) | Lymphocyte antigen 6 complex, locus L | *LOC101928108* | 8q24.3 | 5 | 1 |
| *LYNX1* (NP_803429.1) | Ly6/neurotoxin 1 8q24.3 4 | | 8q24.3 | 4 | 1 |
| *LYPD1* (EAX11675.1) | Ly6/PLAUR domain containing 1 | *PHTS; LYPDC1; LYNX2* | 2q21.2 | 3 | 1 |
| *LYPD2* (EAW82307.1) | Ly6/PLAUR domain containing 2 | *LYPDC2; UNQ430* | 8q24.3 | 3 | 1 |
| *LYPD3* (EAW57190.1) | Ly6/PLAUR domain containing 3 | *C4.4A* | 19q13.31 | 5 | 2 |

FIG. 12A

| **Approved gene symbol (NCBI accession #)** | **Gene name** | **Alias(es)** | **Genomic location** | **Number of** | |
|---|---|---|---|---|---|
| | | | | Exons | LU Domains |
| *LYPD4* (AAH34629.1) | Ly6/PLAUR domain containing 4 | *Sperm Membrane Receptor* | 19q13.2 | 5 | 1 |
| *LYPD5* (EAW57232.1) | Ly6/PLAUR domain containing 5 | *PRO4356* | 19q13.31 | 5 | 1 |
| *LYPD6* (AAH47013.1) | Ly6/PLAUR domain containing 6 | | 2q23.2 | 5 | 1 |
| *LYPD6B* (AAH18203.1) | Ly6/PLAUR domain containing 6B | *CT116; LYPD7* | 2q23.2 | 7 | 1 |
| *LYPD8* (NP_001278212.1) | Ly6/PLAUR domain containing 8 | | 1q44 | 7 | 1 |
| *PATE1* (AAI07045.1) | Prostate and testis expressed 1 | *PATE* | 11q24.2 | 5 | 1 |
| *PATE2* (AAI44527.1) | Prostate and testis expressed 2 | *PATE-M; UNQ3112; C11orf38* | 11q24.2 | 6 | 1 |
| *PATE3* (NP_001123355.3) | Prostate and testis expressed 3 | *HEL-127; PATE-DJ* | 11q24.2 | 3 | 3 |
| *PATE4* (NP_001138346.1) | Prostate and testis expressed 4 | *PATE-B* | 11q24.2 | 3 | 1 |
| *PINLYP* (NP_001180550.1) | Phospholipase A2 inhibitor and Ly6/PLAUR domain containing | | 19q13.31 | 6 | 1 |
| *PLAUR* (CAG33233.1) | Plasminogen activator, urokinase receptor | *CD87; UPAR; URKR; U-PAR* | 19q13 | 7 | 3 |
| *PSCA* (AAH65183.1) | Prostate stem cell antigen | *PRO232* | 8q24.2 | 3 | 1 |
| *SLURP1* (AAT01436.1) | Secreted Ly6/PLAUR domain containing 1 | *ARS; MDM; ANUP; ArsB; LY6LS* | 8q24.3 | 3 | 1 |
| *SLURP2* (NP_803253.1) | Secreted Ly6/PLAUR domain containing 2 | *LYNX1, isoform B precursor* | 8q24.3 | 4 | 1 |
| *SPACA4* (AAQ88753.1) | Sperm acrosome associated 4 | *SAMP14* | 19q13.33 | 1 | 1 |
| *TEX101* (EAW57189.1) | Testis expressed 101 | *SGRG; CT131; GTPR867; NYD-SP8; PRO1884; SPATA44; TES101RP* | 19q13.31 | 9 | 1 |

[a] Novel gene named in Loughner et al. Human Genomic (2016) 10:10

FIG. 12B

SYSTEMS FOR EVOLVED ADENO-ASSOCIATED VIRUSES (AAVs) FOR TARGETED DELIVERY

CROSS REFERENCE TO RELATED APPLICATIONS

This application is a national stage filing under 35 U.S.C. § 371 of International PCT Application No. PCT/US2020/015972, filed Jan. 30, 2020, which was published under PCT Article 21 (2) in English, and which claims priority to and the benefit of U.S. Provisional Application No. 62/798,961, filed Jan. 30, 2019, the entire disclosure of each of which is hereby incorporated by reference.

FEDERALLY SPONSORED RESEARCH

This invention was made with government support under Grant No. NINDS UG3 NS111689-01 awarded by the National Institutes of Health Somatic Cell Genome Editing Consortium. The government has certain rights in the invention.

DESCRIPTION OF THE TEXT FILE SUBMITTED ELECTRONICALLY

The instant application contains a Sequence Listing which has been submitted in ASCII format via EFS-Web and is hereby incorporated by reference in its entirety. The ASCII file, created on Jul. 27, 2021, is named B119570068US01-SEQ-SXT.txt and is 5,473,462 bytes in size.

BACKGROUND OF THE INVENTION

AAV vectors provide a safe and versatile platform for gene therapy. For example, an AAV2 vector carrying the RPE65 gene is now an approved drug for the treatment of Leber's congenital amaurosis. Additionally, data from ongoing clinical trials supports the continued evaluation of AAV-based treatments for additional indications including hemophilia types A and B, Parkinson's disease, spinal muscular atrophy, and MPS I and II. Despite these encouraging results, expanding the use of in vivo gene therapy, especially in difficult to target organs such as the brain, is still hindered by delivery challenges.

SUMMARY OF THE INVENTION

The present disclosure is based, at least in part, on the identification of target proteins (e.g., Ly6 proteins) that enhance transcytosis of AAV capsids across the blood-brain barrier. The present disclosure provides, in some embodiments, methods for identifying AAV capsid proteins capable of crossing the blood-brain barrier, and compositions comprising such.

Some aspects of the present disclosure provide an AAV vector comprising an amino acid sequence that comprises at least 4 contiguous amino acids from a sequence listed in Table 4, 5, 6, 7, 8, 9, 10, 11, 12, 13, 14, 15, 16, 17, 18, or 19. Some aspects of the present disclosure provide an AAV vector comprising an amino acid sequence that is encoded by a nucleic acid sequence listed in any of the Tables included herein.

In some embodiments, the amino acid sequence is part of a capsid protein of the AAV vector. In some embodiments, the amino acid sequence is inserted at a position corresponding to the position between amino acids 586-592 of the sequence provided in SEQ ID NO: 730 or 731. In some embodiments, the amino acid sequence is inserted at a position corresponding to the position between amino acids 588-589 of the sequence provided in SEQ ID NO: 730 or 731.

In some embodiments, the AAV vector comprises at least 4 contiguous amino acids from a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, the AAV vector comprises a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204.

In some embodiments, the AAV vector comprises at least 4 contiguous amino acids of: PKMTLKI (SEQ ID NO: 320), LGKKTNS (SEQ ID NO: 325), LPKYKSS (SEQ ID NO: 396), GRGNSVL (SEQ ID NO: 465), RSPRVNA (SEQ ID NO: 466), IRNPRMA (SEQ ID NO: 467), ARRPNSE (SEQ ID NO: 480), IKMLNKP (SEQ ID NO: 484), or REVLQRI (SEQ ID NO: 506).

In some embodiments, the AAV vector comprises at least 4 contiguous amino acids of: RKPRVHD (SEQ ID NO: 317), YADTNRR (SEQ ID NO: 321), TKSVRVV (SEQ ID NO: 327), TKSSMRP (SEQ ID NO: 336), RRHLAET (SEQ ID NO: 346), RRPPSMG (SEQ ID NO: 354), KDRKVPN (SEQ ID NO: 382), KVTNRHE (SEQ ID NO: 439), DMDLGMG (SEQ ID NO: 453), IEKPTYR (SEQ ID NO: 482), RGKMELY (SEQ ID NO: 505), SKDNHRM (SEQ ID NO: 511), DIHGANL (SEQ ID NO: 512), HSVGYLD (SEQ ID NO: 514), ASLADRP (SEQ ID NO: 515), SKNDHEY (SEQ ID NO: 517), or NLGAINK (SEQ ID NO: 522).

In some embodiments, the AAV vector comprises at least 4 contiguous amino acids of: RSMKPNN (SEQ ID NO: 316), RKPRVHD (SEQ ID NO: 317), VRKMPDY (SEQ ID NO: 318), QKPIRIV (SEQ ID NO: 319), PKMTLKI (SEQ ID NO: 320), YADTNRR (SEQ ID NO: 321), RKQMNTT (SEQ ID NO: 322), ELYKLPT (SEQ ID NO: 323), GGQLRKP (SEQ ID NO: 324), LGKKTNS (SEQ ID NO: 325), NRQTVKG (SEQ ID NO: 326), TKSVRVV (SEQ ID NO: 327), GINVRPR (SEQ ID NO: 328), KKGSIGS (SEQ ID NO: 329), LRKNPNP (SEQ ID NO: 330), NSKTVVR (SEQ ID NO: 331), VRRTQLD (SEQ ID NO: 332), KKSTILA (SEQ ID NO: 333), RSKLGSG (SEQ ID NO: 334), DRRGHDR (SEQ ID NO: 335), TKSSMRP (SEQ ID NO: 336), NRITPNR (SEQ ID NO: 337), KIQNNKQ (SEQ ID NO: 338), KSRLTQP (SEQ ID NO: 339), SQKAGGR (SEQ ID NO: 340), ARKTPDY (SEQ ID NO: 341), TRKPVVI (SEQ ID NO: 342), NLKDKRT (SEQ ID NO: 343), KRDARMN (SEQ ID NO: 344), KGSMRQA (SEQ ID NO: 345), RRHLAET (SEQ ID NO: 346), VKTHRPV (SEQ ID NO: 347), or KRNNVAA (SEQ ID NO: 348).

In some embodiments, the AAV is an AAV9 vector. In some embodiments, the AAV vector is an AAV1, AAV2, AAV3, AAV4, AAV5, AAV6, AAV7, AAV8, AAV10 or AAV11 vector.

In some embodiments, the AAV vector comprises at least 5 contiguous amino acids from a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, the AAV vector comprises at least 6 contiguous amino acids from a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, the AAV vector comprises a sequence that is at least 80% identical to a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204.

In some embodiments, the the AAV vector comprises a sequence that contains a single amino acid substitution compared to a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204, and wherein the amino acid substitution is a conservative amino acid substitution In some embodiments, the AAV vector comprises at least 4 contiguous amino acids of: NSKTVVR (SEQ ID NO: 331), QRIQGQK (SEQ ID NO: 367), RGTRTEN (SEQ ID NO: 369), KLDKRMG (SEQ ID NO: 397), TRRDSLF (SEQ ID NO: 403), STKTVKL (SEQ ID NO: 420), LNNKQVR (SEQ ID NO: 454), RNTRTEA (SEQ ID NO: 479), GERSPRL (SEQ ID NO: 507), TPTNPRW (SEQ ID NO: 508), or SADRKHI (SEQ ID NO: 516).

In some embodiments, the amino acid sequence binds to a Ly6/uPAR protein. In some embodiments, the amino acid sequence specifically binds to a human Ly6/uPAR protein. In some embodiments, the amino acid sequence binds to a human Ly6/uPAR protein and binds to a non-human primate Ly6/uPAR protein. In some embodiments, the amino acid sequence binds to a human Ly6/uPAR protein, binds to a non-human primate Ly6/uPAR protein, and binds to a rodent Ly6/uPAR protein. In some embodiments, the Ly6/uPAR protein is CD59.

Some aspects of the present disclosure provide an AAV capsid protein comprising an amino acid sequence that comprises at least 4 contiguous amino acids from a sequence listed in Table 4, 5.6, 7, 8, 9, 10, 11, 12, 13, 14, 15, 16, 17, 18 or 19.

In some embodiments, the AAV capsid protein comprises at least 4 contiguous amino acids from a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, the AAV capsid protein comprises a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204.

In some embodiments, the AAV capsid protein comprises at least 4 contiguous amino acids of: PKMTLKI (SEQ ID NO: 320), LGKKTNS (SEQ ID NO: 325), LPKYKSS (SEQ ID NO: 396), GRGNSVL (SEQ ID NO: 465), RSPRVNA (SEQ ID NO: 466), IRNPRMA (SEQ ID NO: 467), ARRPNSE (SEQ ID NO: 480), IKMLNKP (SEQ ID NO: 484), or REVLQRI (SEQ ID NO: 506).

In some embodiments, the AAV capsid protein comprises at least 4 contiguous amino acids of: RKPRVHD (SEQ ID NO: 317), YADTNRR (SEQ ID NO: 321), TKSVRVV (SEQ ID NO: 327), TKSSMRP (SEQ ID NO: 336), RRHLAET (SEQ ID NO: 346), RRPPSMG (SEQ ID NO: 354), KDRKVPN (SEQ ID NO: 382), KVTNRHE (SEQ ID NO: 439), DMDLGMG (SEQ ID NO: 453), IEKPTYR (SEQ ID NO: 482), RGKMELY (SEQ ID NO: 505), SKDNHRM (SEQ ID NO: 511), DIHGANL (SEQ ID NO: 512), HSVGYLD (SEQ ID NO: 514), ASLADRP (SEQ ID NO: 515), SKNDHEY (SEQ ID NO: 517), or NLGAINK (SEQ ID NO: 522).

In some embodiments, the AAV capsid protein comprises at least 4 contiguous amino acids of: RSMKPNN (SEQ ID NO: 316), RKPRVHD (SEQ ID NO: 317), VRKMPDY (SEQ ID NO: 318), QKPIRIV (SEQ ID NO: 319), PKMTLKI (SEQ ID NO: 320), YADTNRR (SEQ ID NO: 321), RKQMNTT (SEQ ID NO: 322), ELYKLPT (SEQ ID NO: 323), GGQLRKP (SEQ ID NO: 324), LGKKTNS (SEQ ID NO: 325), NRQTVKG (SEQ ID NO: 326), TKSVRVV (SEQ ID NO: 327), GINVRPR (SEQ ID NO: 328), KKGSIGS (SEQ ID NO: 329), LRKNPNP (SEQ ID NO: 330), NSKTVVR (SEQ ID NO: 331), VRRTQLD (SEQ ID NO: 332), KKSTILA (SEQ ID NO: 333), RSK-LGSG (SEQ ID NO: 334), DRRGHDR (SEQ ID NO: 335), TKSSMRP (SEQ ID NO: 336), NRITPNR (SEQ ID NO: 337), KIQNNKQ (SEQ ID NO: 338), KSRLTQP (SEQ ID NO: 339), SQKAGGR (SEQ ID NO: 340), ARKTPDY (SEQ ID NO: 341), TRKPVVI (SEQ ID NO: 342), NLKDKRT (SEQ ID NO: 343), KRDARMN (SEQ ID NO: 344), KGSMRQA (SEQ ID NO: 345), RRHLAET (SEQ ID NO: 346), VKTHRPV (SEQ ID NO: 347), or KRNNVAA (SEQ ID NO: 348).

In some embodiments, the AAV capsid protein comprises at least 4 contiguous amino acids of: NSKTVVR (SEQ ID NO: 331), QRIQGQK (SEQ ID NO: 367), RGTRTEN (SEQ ID NO: 369), KLDKRMG (SEQ ID NO: 397), TRRDSLF (SEQ ID NO: 403), STKTVKL (SEQ ID NO: 420), LNNKQVR (SEQ ID NO: 454), RNTRTEA (SEQ ID NO: 479), GERSPRL (SEQ ID NO: 507), TPTNPRW (SEQ ID NO: 508), or SADRKHI (SEQ ID NO: 516).

In some embodiments, the AAV capsid protein further comprises a nanoparticle or second molecule to which said AAV capsid protein is conjugated. In some embodiments, the AAV capsid protein is part of an AAV. In some embodiments, the AAV capsid protein is part of an AAV9.

In some embodiments, the AAV capsid protein comprises the amino acid sequence inserted at a position corresponding to the position between amino acids 586-592 of the sequence provided in SEQ ID NO: 730 or 731. In some embodiments, the AAV capsid protein comprises the amino acid sequence inserted at a position corresponding to the position between amino acids 588-589 of the sequence provided in SEQ ID NO: 730 or 731.

In some embodiments, the AAV capsid protein is part of an AAV1, AAV2, AAV3, AAV4, AAV5, AAV6, AAV7, AAV8, AAV10 or AAV11.

In some embodiments, the AAV capsid protein comprises at least 5 contiguous amino acids from a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, the AAV capsid protein comprises at least 6 contiguous amino acids from a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, the AAV capsid protein comprises a sequence that is at least 80% identical to a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204.

In some embodiments, the AAV capsid protein comprises a sequence that contains a single amino acid substitution compared to a sequence selected from SEQ ID NOs: 316-522, 732-1909, 3088-3199, 3312-6429, 9548-10086, 10626-10688, 10690-11520, 12481-12683, 12952-20446, 27942-

28880, 29819-29983, 30149-30166 and 30185-30204, and wherein the amino acid substitution is a conservative amino acid substitution.

In some embodiments, the AAV capsid protein comprises the amino acid sequence that binds to a Ly6/uPAR protein. In some embodiments, the AAV capsid protein comprises the amino acid sequence that specifically binds to a human Ly6/uPAR protein. In some embodiments, the AAV capsid protein comprises the amino acid sequence that binds to a human Ly6/uPAR protein and binds to a non-human primate Ly6/uPAR protein. In some embodiments, the AAV capsid protein comprises the amino acid sequence that binds to a human Ly6/uPAR protein, binds to a non-human primate Ly6/uPAR protein, and binds to a rodent Ly6/uPAR protein. In some embodiments, the AAV capsid protein comprises the amino acid sequence that binds to CD59.

Some aspects of the present disclosure provide a library of AAV9 capsid proteins comprising an AAV9 capsid protein as described herein.

Some aspects of the present disclosure provide a nucleic acid sequence encoding an AAV capsid protein as described herein.

Some aspects of the present disclosure provide a pharmaceutical composition comprising an AAV capsid protein as described herein and one or more pharmaceutical acceptable carriers.

Some aspects of the present disclosure provide a peptide comprising an amino acid sequence set forth in SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, the peptide further comprises a nanoparticle or second molecule to which said peptide is conjugated.

Some aspects of the present disclosure provide a method of delivering a nucleic acid to a target environment of a subject in need, comprising providing a composition comprising an AAV vector, wherein the AAV vector comprises a capsid protein that comprises an amino acid sequence that comprises at least 4 contiguous amino acids of a sequence selected from a sequence listed in Table 4, 5, 6, 78, 9, 10, 11, 12, 13, 14, 15, 16, 17, 18, or 19, and wherein the AAV vector comprises a nucleic acid to be delivered to the target environment of the subject; and administering the composition to the subject.

In some embodiments, a method of delivering a nucleic acid to a target environment of a subject in need comprises providing a composition comprising any AAV vector described herein, and administering the composition to the subject.

In some embodiments, the target environment is the central nervous system, liver, muscle, heart, lungs, stomach, adrenal gland, adipose, intestine, or immune cells. In some embodiments, the target environment is neurons, astrocytes, cardiomyocytes, or a combination thereof.

In some embodiments, the nucleic acid to be delivered comprises one or more of: a) a nucleic acid sequence encoding a trophic factor, a growth factor, or a soluble protein; b) a cDNA that restores protein function to humans or animals harboring a genetic mutation(s) in that gene; c) a cDNA that encodes a protein that can be used to control or alter the activity or state of a cell; d) a cDNA that encodes a protein or a nucleic acid used for assessing the state of a cell; e) a cDNA and/or associated guide RNA for performing genomic engineering; f) a sequence for genome editing via homologous recombination; g) a DNA sequence encoding a therapeutic RNA; h) a shRNA or an artificial miRNA delivery system; and i) a DNA sequence that influences the splicing of an endogenous gene.

In some embodiments, the subject in need is a subject suffering from or at a risk to develop one or more of chronic pain, cardiac failure, cardiac arrhythmias, Friedreich's ataxia, Huntington's disease (HD), Alzheimer's disease (AD), Parkinson's disease (PD), Amyotrophic lateral sclerosis (ALS), spinal muscular atrophy types I and II (SMA I and II), Friedreich's Ataxia (FA), Spinocerebellar ataxia, lysosomal storage disorders that involve cells within the CNS.

In some embodiments, the AAV vector is administered to the subject via intravenous administration or systemic administration. In some embodiments, the nucleic acid is delivered to dorsal root ganglia, visceral organs, astrocytes, neurons, or a combination thereof of the subject.

Some aspects of the present disclosure provide a method comprising providing an AAV capsid protein; contacting the AAV capsid protein with a cell that expresses protein of Ly6/uPAR protein family attached to the surface of the cell; and selecting the AAV capsid protein if it specifically binds to the protein of the Ly6/uPAR protein family attached to the surface of the cell. In some embodiments, a method comprises any AAV capsid protein described herein.

In some embodiments, the protein of the Ly6/uPAR protein family is expressed recombinantly in the cell. In some embodiments, the protein of the Ly6/uPAR protein family is expressed endogenously in the cell. In some embodiments, the protein of the Ly6/uPAR protein family is a human protein. In some embodiments, the protein of the Ly6/uPAR protein family is expressed in the central nervous system. In some embodiments, the protein of the Ly6/uPAR protein family is LY6A, LY6C1, LY6E, CD59, Ly6H, LYNX1 or GPIHBP1. In some embodiments, the protein of the Ly6/uPAR protein family is ACRV1, CD177, CD59A, CD59B, GML, GML2, LY6A, LY6A2, LY6C1, LY6C2, LY6D, LY6E, LY6F, LY6G, LY6G2, LY6G5B, LY6G5C, LY6G6C, LY6G6D, LY6G6E, LY6G6F, LY6G6G, LY6I, LY6K, LY6L, LY6M, LYPD1, LYPD2, LYPD3, LYPD4, LYPD5, LYPD6, LYPD6B, LYPD8, LYPD9, LYPD10, LYPD11, PATE1, PATE2, PATE3, PATE4, PATE5, PATE6, PATE7, PATE8, PATE9, PATE10, PATE11, PATE12, PATE13, PATE14, PINLYP, PLAUR, PSCCA, SLURP1, SLURP2, SPACA4, or TEX101.

In some embodiments, the method comprises contacting the AAV capsid protein with a cell that expresses a GPI-anchored protein.

In some embodiments, the method is a method for identifying an AAV capsid protein that can cross the blood-brain barrier.

Some aspects of the present disclosure provide a method comprising providing a targeting peptide; incubating the targeting peptide with a protein of the Ly6/uPAR protein family; and selecting the targeting peptide if it specifically binds to the protein of the Ly6/uPAR protein family. In some embodiments, the protein of the Ly6/uPAR protein family is a fusion protein. In some embodiments, the protein of the Ly6/uPAR protein family is an Fc fusion. In some embodiments, the protein of the Ly6/uPAR protein family forms a dimer. In some embodiments, the protein of the Ly6/uPAR protein family is fused to a: AviTag, C-tag, Calmodulin-tag, E-tag, FLAG, HA, poly-HIS, MYC, NE, Rho1D4, S-tag, SBP, Softag, Spot-tag, T7-tag, TC, Ty, V5, VSV, Xpress, Isopeptag, SpyTag, SnoopTag, DogTag, SdyTag, BCCP, GST, GFP, Halo, SNAP, CLIP, Maltose binding protein (MBP), Nus-tag, Thioredoxin-tag, Fc-tag, CRDSAT, SUMO-tag, or B2M-tag. In some embodiment, the method as described herein is conducted in vitro.

In some embodiments, the targeting peptide is expressed within an AAV capsid protein. In some embodiments, the targeting peptide is expressed within an AAV9 capsid protein. In some embodiments, the targeting peptide is contained within an AAV capsid protein described herein. In some embodiments, the targeting peptide comprises at least 4 contiguous amino acids of an amino acid sequence set forth in SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, the targeting peptide comprises an amino acid sequence set forth in SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204.

Some aspects of the present disclosure provide a method comprising delivering a protein, RNA, or DNA to a target environment of a subject and administering an adeno-associated virus (AAV) vector to the target environment of the subject. In some embodiments, the AAV vector comprises a capsid protein comprising at least 4 contiguous amino acids from a sequence listed in Table 4, 5, 6, 7, 8, 9, 10, 11, 12, 13, 14, 15, 16, 17, 18, or 19. In some embodiments, the AAV vector comprises a nucleic acid molecule to be delivered to the target environment of the subject. In some embodiments, the protein that is delivered is a LY6/uPAR protein. In some embodiments, the DNA or RNA that is delivered encodes a Ly6/uPAR protein. In some embodiments, the method as described herein is a method of treating a disorder or defect in a subject. In some embodiments, the nucleic acid molecule to be delivered to the target environment of the subject encodes a therapeutic protein. In some embodiments, the nucleic acid molecule is a therapeutic. In some embodiments, the therapeutic protein is effective for treating the disorder or defect in the subject. In some embodiments, the nucleic acid molecule is effective for treating the disorder or defect in the subject. In some embodiments, the LY6/uPAR protein is LY6A. In some embodiments, the LY6/uPAR protein is LY6C1. In some embodiments, the LY6/uPAR protein is a murine protein. In some embodiments, the AAV is a murine AAV. In some embodiments, the AAV targets the Ly6/uPAR protein.

In some embodiments, the nucleic acid molecule to be delivered comprises one or more of: a) a nucleic acid sequence encoding a trophic factor, a growth factor, or a soluble protein; b) a cDNA that restores protein function to humans or animals harboring a genetic mutation(s) in that gene; c) a cDNA that encodes a protein that can be used to control or alter the activity or state of a cell; d) a cDNA that encodes a protein or a nucleic acid used for assessing the state of a cell; e) a cDNA and/or associated guide RNA for performing genomic engineering; f) a sequence for genome editing via homologous recombination; g) a DNA sequence encoding a therapeutic RNA; h) a shRNA or an artificial miRNA delivery system; and i) a DNA sequence that influences the splicing of an endogenous gene. In some embodiments, the method as disclosed herein is a diagnostic method.

In some embodiments, the disorder or defect is one or more of chronic pain, cardiac failure, cardiac arrhythmias, Friedreich's ataxia, Huntington's disease (HD), Alzheimer's disease (AD), Parkinson's disease (PD), Amyotrophic lateral sclerosis (ALS), spinal muscular atrophy types I and II (SMA I and II), Friedreich's Ataxia (FA), Spinocerebellar ataxia, and lysosomal storage disorders that involve cells within the CNS.

In some embodiments, the protein, RNA, or DNA is delivered to the subject via intravenous administration or systemic administration. In some embodiments, the AAV vector is administered to the subject via intravascular administration or systemic administration. In some embodiments, the protein, RNA, or DNA is delivered to the subject in trans. In some embodiments, the present method provides that the protein, RNA, or DNA is delivered to the subject via a nanoparticle. In some embodiments, the RNA or DNA is delivered to the subject via a viral vector. In some embodiments, the protein delivered to the subject is a purified protein.

In some embodiments, the method provides that the protein, RNA, or DNA is delivered to the target environment first, followed by the administration of the AAV vector. In some embodiments, the delivering of the protein or RNA to the target environment and the administering of the AAV vector occur simultaneously. In some embodiments, the protein, RNA, or DNA is delivered in a targeted fashion to a target organ, region of an organ, tumor, ganglia, or to the cerebral spinal fluid of the subject.

Some aspects of the present disclosure provide a method of providing an adeno-associated virus (AAV) capsid protein; contacting the AAV capsid protein with a cell that expresses a GPI-anchored protein attached to the surface of the cell; and selecting the AAV capsid protein if it specifically binds to the GPI-anchored protein attached to the surface of the cell. Some aspects of the present disclosure provide a method of providing an adeno-associated virus (AAV) capsid protein; contacting the AAV capsid protein with a cell that expresses a protein attached to the surface of the cell; and selecting the AAV capsid protein if it specifically binds to the protein attached to the surface of the cell.

In some embodiments, the protein attached to the surface of the cell is: i) a protein that exhibits luminal surface exposure on brain endothelium; ii) a protein that is localized within lipid micro-domains; and/or iii) a protein that exhibits recycling/intracellular trafficking capabilities.

Some aspects of the present disclosure provides a method of providing a targeting peptide; incubating the targeting peptide with a GPI-anchored protein; and selecting the targeting peptide if it specifically binds to the GPI-anchored protein. In some embodiments, the method provides that the targeting peptide is contained within an adeno-associated virus (AAV) capsid protein.

Some aspects of the present disclosure provide a method of providing an adeno-associated virus (AAV) capsid protein; contacting the AAV capsid protein with a cell that expresses a surface protein; and selecting the AAV capsid protein if it specifically binds to the surface protein. In some embodiments, the surface protein is a GPI-anchored protein. In some embodiments, the GPI-anchored protein is a Ly6/uPAR protein. In some embodiments, the surface protein is a protein that traffics to the plasma membrane. In some embodiments the surface protein is expressed recombinantly in the cell. In some embodiments, next-generation sequencing is used to determine peptide disclosed herein. In some embodiments, targeting peptides disclosed herein do not have the sequence of SEQ ID NO: 10689 (YTLSQGW).

It should be appreciated that the foregoing concepts, and additional concepts discussed below, may be arranged in any suitable combination, as the present disclosure is not limited in this respect. Further, other advantages and novel features of the present disclosure will become apparent from the following detailed description of various non-limiting embodiments when considered in conjunction with the accompanying figures.

BRIEF DESCRIPTION OF THE DRAWINGS

The following drawings form part of the present specification and are included to further demonstrate certain aspects of the present disclosure, which can be better understood by reference to one or more of these drawings in combination with the detailed description of specific embodiments presented herein.

FIGS. 12A-B show name, chromosomal location, number of exons, and LU domains for human Ly6/uPAR family genes. (Adapted from Loughner et al. (2016) *Human Genomics* 10:10.)

DETAILED DESCRIPTION

Figure 1A:
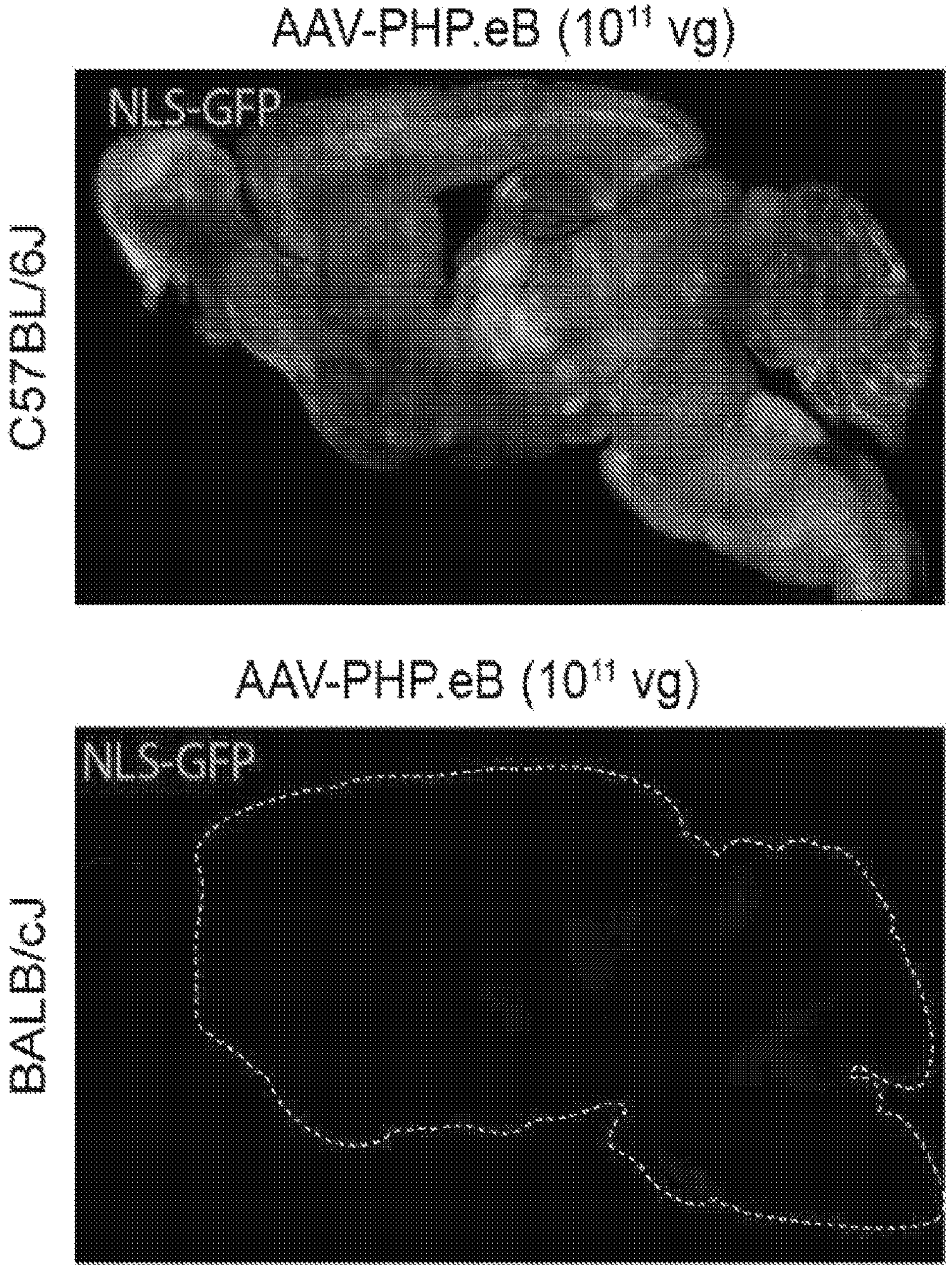
FIG. 1A shows images of GFP fluorescence within sagittal brain sections from C57BL/6J (top) or BALB/cJ (bottom) two weeks after intravenous administration of AAV-PHP.eB:CAG-NLS-GFP.

Aspects of the present disclosure relate to methods for identifying targeting peptides that enhance transcytosis of AAV capsids across the blood-brain barrier via binding to target proteins such as Ly6/uPAR proteins. Accordingly, methods and compositions described herein are useful, in some embodiments, for in vivo gene therapy.

Adeno-Associated Virus (AAV) Vectors

Aspects of the invention relate to adeno-associated virus (AAV) vectors and their use in gene therapy. AAV vectors described herein can be used to deliver a nucleic acid encoding a protein of interest to a subject, including delivery to the central nervous system (CNS) of a subject. AAV vectors are described further in U.S. Pat. No. 9,585,971 and US 2017/0166926, which are incorporated by reference herein in their entireties.

AAV refers to a replication-deficient Dependoparvovirus within the Parvoviridae genus of viruses. AAV can be derived from a naturally occurring virus or can be recombinant. AAV can be packaged into capsids, which can be derived from naturally occurring capsid proteins or recombinant capsid proteins. The single-stranded DNA genome of AAV includes inverted terminal repeat (ITRs), which are involved in integrating the AAV DNA into the host cell genome. In some embodiments, AAV integrates into a host cell genome, while in other embodiments, AAV is non-integrating. AAV vectors can comprise: one or more ITRs, including, for example a 5' ITR and/or a 3' ITR; one or more promoters; one or more nucleic acid sequences encoding one or more proteins of interest; and/or additional posttranscriptional regulator elements. AAV vectors described herein can be prepared using standard molecular biology techniques known to one of ordinary skill in the art, as described, for example, in Sambrook et al. (Molecular Cloning: A Laboratory Manual. Cold Spring Harbor Laboratory Press, N.Y. (2012)).

AAV vectors described herein can include sequences from any known organism and can include synthetic sequences. AAV vector sequences can be modified in any way known to one of ordinary skill in the art, such as by incorporating insertions, deletions or substitutions, and/or through the use of posttranscriptional regulatory elements, such as promoters, enhancers, and transcription and translation terminators, such as polyadenylation signals. AAV vectors can also include sequences related to replication and integration. In some embodiments, AAV vectors include a shuttle element for replication and integration.

AAV vectors can include any known AAV serotype, including, for example, AAV1, AAV2, AAV3, AAV4, AAV5, AAV6, AAV7, AAV8, AAV9, AAV10, and AAV11. In some embodiments, the AAV serotype is AAV9. Clades of AAV viruses are described in, and incorporated by reference, from Gao et al. (2004) J. Virol. 78(12):6381-6388.

AAV vectors of the present disclosure may comprise or be derived from any natural or recombinant AAV serotype. In some embodiments, the AAV vector may utilize or be based on an AAV serotype described in WO 2017/201258A1, the contents of which are incorporated herein by reference in its entirety, such as, but not limited to, AAV1, AAV2, AAV2G9, AAV3, AAV3a, AAV3b, AAV3-3, AAV4, AAV4-4, AAV5, AAV6, AAV6.1, AAV6.2, AAV6.1.2, AAV7, AAV7.2, AAV8, AAV9, AAV9.11, AAV9.13, AAV9.16, AAV9.24, AAV9.45, AAV9.47, AAV9.61, AAV9.68, AAV9.84, AAV9.9, AAV10, AAV11, AAV12, AAV16.3, AAV24.1, AAV27.3, AAV42.12, AAV42-1b, AAV42-2, AAV42-3a, AAV42-3b, AAV42-4, AAV42-5a, AAV42-5b, AAV42-6b, AAV42-8, AAV42-10, AAV42-11, AAV42-12, AAV42-13, AAV42-15, AAV42-aa, AAV43-1, AAV43-12, AAV43-20, AAV43-21, AAV43-23, AAV43-25, AAV43-5, AAV44.1, AAV44.2, AAV44.5, AAV223.1, AAV223.2, AAV223.4, AAV223.5, AAV223.6, AAV223.7, AAV1-7/rh.48, AAV1-8/rh.49, AAV2-15/rh.62, AAV2-3/rh.61, AAV2-4/rh.50, AAV2-5/rh.51, AAV3.1/hu.6, AAV3.1/hu.9, AAV3-9/rh.52, AAV3-11/rh.53, AAV4-8/r11.64, AAV4-9/rh.54, AAV4-19/rh.55, AAV5-3/rh.57, AAV5-22/rh.58, AAV7.3/hu.7, AAV16.8/hu.10, AAV16.12/hu.11, AAV29.3/bb.1, AAV29.5/bb.2, AAV106.1/hu.37. AAV114.3/hu.40, AAV127.2/hu.41, AAV127.5/hu.42, AAV128.3/hu.44, AAV130.4/hu.48. AAV145.1/hu.53, AAV145.5/hu.54, AAV145.6/hu.55, AAV161.10/hu.60, AAV161.6/hu.61.

AAV33.12/hu.17, AAV33.4/hu.15, AAV33.8/hu.16, AAV52/hu.19, AAV52.1/hu.20, AAV58.2/hu.25, AAVA3.3, AAVA3.4, AAVA3.5, AAVA3.7, AAVC1, AAVC2, AAVC5, AAV-DJ, AAV-DJ8, AAVF3, AAVF5, AAVH2, AAVrh.72, AAVhu.8, AAVrh.68, AAVrh.70, AAVpi.1, AAVpi.3, AAVpi.2, AAVrh.60, AAVrh.44, AAVrh.65, AAVrh.55, AAVrh.47, AAVrh.69, AAVrh.45, AAVrh.59, AAVhu.12, AAVH6, AAVLK03, AAVH-1/hu.1, AAVH-5/hu.3, AAVLG-10/rh.40, AAVLG-4/rh.38, AAVLG-9/hu.39, AAVN721-8/rh.43, AAVCh.5, AAVCh.5R1, AAVcy.2, AAVcy.3, AAVcy.4, AAVcy.5, AAVCy.5R1, AAVCy.5R2, AAVCy.5R3, AAVCy.5R4, AAVcy.6, AAVhu.1, AAVhu.2, AAVhu.3, AAVhu.4, AAVhu.5, AAVhu.6, AAVhu.7, AAVhu.9, AAVhu.10, AAVhu.11, AAVhu.13, AAVhu.15, AAVhu.16, AAVhu.17, AAVhu.18, AAVhu.20, AAVhu.21, AAVhu.22, AAVhu.23.2, AAVhu.24, AAVhu.25, AAVhu.27, AAVhu.28, AAVhu.29, AAVhu.29R, AAVhu.31, AAVhu.32, AAVhu.34, AAVhu.35, AAVhu.37, AAVhu.39, AAVhu.40, AAVhu.41, AAVhu.42, AAVhu.43, AAVhu.44, AAVhu.44R1, AAVhu.44R2, AAVhu.44R3, AAVhu.45, AAVhu.46, AAVhu.47, AAVhu.48, AAVhu.48R1, AAVhu.48R2, AAVhu.48R3, AAVhu.49, AAVhu.51, AAVhu.52, AAVhu.54, AAVhu.55, AAVhu.56, AAVhu.57, AAVhu.58, AAVhu.60, AAVhu.61, AAVhu.63, AAVhu.64, AAVhu.66, AAVhu.67, AAVhu.14/9, AAVhu.t 19, AAVrh.2, AAVrh.2R, AAVrh.8, AAVrh.8R, AAVrh.10, AAVrh.12, AAVrh.13, AAVrh.13R, AAVrh.14, AAVrh.17, AAVrh.18, AAVrh.19, AAVrh.20, AAVrh.21, AAVrh.22, AAVrh.23, AAVrh.24, AAVrh.25, AAVrh.31, AAVrh.32, AAVrh.33, AAVrh.34, AAVrh.35, AAVrh.36, AAVrh.37, AAVrh.37R2, AAVrh.38, AAVrh.39, AAVrh.40, AAVrh.46, AAVrh.48, AAVrh.48.1, AAVrh.48.1.2, AAVrh.48.2, AAVrh.49, AAVrh.51, AAVrh.52, AAVrh.53, AAVrh.54, AAVrh.56, AAVrh.57, AAVrh.58, AAVrh.61, AAVrh.64, AAVrh.64R1, AAVrh.64R2, AAVrh.67, AAVrh.73, AAVrh.74, AAVrh8R, AAVrh8R A586R mutant, AAVrh8R R533A mutant, AAAV, BAAV, caprine AAV, bovine AAV, AAVhE1.1, AAVhEr1.5, AAVhER1.14, AAVhEr1.8, AAVhEr1.16, AAVhEr1.18, AAVhEr1.35, AAVhEr1.7, AAVhEr1.36, AAVhEr2.29, AAVhEr2.4, AAVhEr2.16, AAVhEr2.30, AAVhEr2.31, AAVhEr2.36, AAVhER1.23, AAVhEr3.1, AAV2.5T, AAV-PAEC, AAV-LK01, AAV-LK02, AAV-LK03, AAV-LK04, AAV-LK05, AAV-LK06, AAV-LK07, AAV-LK08, AAV-LK09, AAV-LK10, AAV-LK11, AAV-LK12, AAV-LK13, AAV-LK14, AAV-LK15, AAV-LK16, AAV-LK17, AAV-LK18, AAV-LK19, AAV-PAEC2, AAV-PAEC4, AAV-PAEC6, AAV-PAEC7, AAV-PAEC8, AAV-PAEC11, AAV-PAEC12, AAV-2-pre-miRNA-101, AAV-8h, AAV-8b, AAV-h, AAV-b, AAV SM 10-2, AAV Shuffle 100-1, AAV Shuffle 100-3, AAV Shuffle 100-7, AAV Shuffle 10-2, AAV Shuffle 10-6, AAV Shuffle 10-8, AAV Shuffle 100-2, AAV SM 10-1, AAV SM 10-8, AAV SM 100-3, AAV SM 100-10, BNP61 AAV, BNP62 AAV, BNP63 AAV, AAVrh.50, AAVrh.43, AAVrh.62, AAVrh.48, AAVhu.19, AAVhu.11, AAVhu.53, AAV4-8/rh.64, AAVLG-9/hu.39, AAV54.5/hu.23, AAV54.2/hu.22, AAV54.7/hu.24, AAV54.1/hu.21, AAV54.4R/hu.27, AAV46.2/hu.28, AAV46.6/hu.29, AAV128.1/hu.43, true type AAV (ttAAV), UPENN AAV 10, Japanese AAV 10 serotypes, AAV CBr-7.1, AAV CBr-7.10, AAV CBr-7.2, AAV CBr-7.3, AAV CBr-7.4, AAV CBr-7.5, AAV CBr-7.7, AAV CBr-7.8, AAV CBr-B7.3, AAV CBr-B7.4, AAV CBr-E1, AAV CBr-E2, AAV CBr-E3, AAV CBr-E4. AAV CBr-E5, AAV CBr-e5, AAV CBr-E6, AAV CBr-E7, AAV CBr-E8, AAV CHt-1, AAV CHt-2, AAV CHt-3, AAV CHt-6.1, AAV CHt-6.10, AAV CHt-6.5, AAV CHt-6.6, AAV CHt-6.7, AAV CHt-6.8, AAV CHt-P1, AAV CHt-P2, AAV CHt-P5, AAV CHt-P6, AAV CHt-P8, AAV CHt-P9, AAV CKd-1, AAV CKd-10, AAV CKd-2. AAV CKd-3, AAV CKd-4, AAV CKd-6, AAV CKd-7, AAV CKd-8, AAV CKd-B1, AAV CKd-B2, AAV CKd-B3, AAV CKd-B4, AAV CKd-B5, AAV CKd-B6, AAV CKd-B7, AAV CKd-B8, AAV CKd-H1, AAV CKd-H2, AAV CKd-H3, AAV CKd-H4, AAV CKd-H5, AAV CKd-H6, AAV CKd-N3, AAV CKd-N4, AAV CKd-N9, AAV CLg-F1, AAV CLg-F2, AAV CLg-F3, AAV CLg-F4, AAV CLg-F5, AAV CLg-F6, AAV CLg-F7, AAV CLg-F8, AAV CLv-1, AAV CLv1-1, AAV Clv1-10, AAV CLv1-2, AAV CLv-12, AAV CLv1-3, AAV CLv-13, AAV CLv1-4, AAV Clv1-7, AAV Clv1-8, AAV Clv1-9, AAV CLv-2, AAV CLv-3, AAV CLv-4. AAV CLv-6, AAV CLv-8, AAV CLv-D1, AAV CLv-D2, AAV CLv-D3, AAV CLv-D4, AAV CLv-D5, AAV CLv-D6, AAV CLv-D7, AAV CLv-D8, AAV CLv-E1, AAV CLv-K1, AAV CLv-K3, AAV CLv-K6, AAV CLv-L4, AAV CLv-L5, AAV CLv-L6, AAV CLv-M1, AAV CLv-M11, AAV CLv-M2, AAV CLv-M5, AAV CLv-M6, AAV CLv-M7, AAV CLv-M8, AAV CLv-M9, AAV CLv-R1, AAV CLv-R2, AAV CLv-R3, AAV CLv-R4, AAV CLv-R5, AAV CLv-R6, AAV CLv-R7, AAV CLv-R8, AAV CLv-R9, AAV CSp-1, AAV CSp-10, AAV CSp-11, AAV CSp-2, AAV CSp-3, AAV CSp-4, AAV CSp-6, AAV CSp-7, AAV CSp-8, AAV CSp-8.10, AAV CSp-8.2, AAV CSp-8.4, AAV CSp-8.5, AAV CSp-8.6, AAV CSp-8.7, AAV CSp-8.8, AAV CSp-8.9, AAV CSp-9, AAV.hu.48R3, AAV.VR-355, AAV3B, AAV4, AAV5, AAVF1/HSC1, AAVF11/HSC11. AAVF12/HSC12, AAVF13/HSC13, AAVF14/HSC14, AAVF15/HSC15, AAVF16/HSC16. AAVF17/HSC17, AAVF2/HSC2, AAVF3/HSC3, AAVF4/HSC4, AAVF5/HSC5, AAVF6/HSC6, AAVF7/HSC7, AAVF8/HSC8, AAVF9/HSC9, AAV-PHP.B (PHP.B), AAV-PHP.A (PHP.A), G2B-26, G2B-13, TH1.1-32 and/or TH1.1-35, and variants thereof.

AAV vectors disclosed herein comprise targeting sequences (e.g., 7-mer sequences) capable of directing the AAV vectors to specific environments within a subject, including, in some embodiments, directing the AAV vectors across the blood-brain barrier in a subject. In some embodiments, the targeting sequence is inserted into the capsid protein of the AAV vector. The targeting sequence can be inserted into any region of the capsid protein. In some embodiments, the targeting sequence is inserted at a position corresponding to the position between amino acids 588 and 589 of an AAV9 capsid protein, such as a capsid protein provided in SEQ ID NO: 730 or 731. In some embodiments, the targeting sequence is inserted at a position corresponding to a position between amino acids 586 and 592 of an AAV9 capsid protein, such as a capsid protein provided in SEQ ID NO: 730 or 731.

As used herein, a position (such as a nucleic acid residue or an amino acid residue) in sequence "X" is referred to as corresponding to a position or residue (such as a nucleic acid residue or an amino acid residue) "a" in sequence "Y" when the residue in sequence "X" is at the counterpart position of "a" in sequence "Y" when sequences X and Y are aligned using amino acid sequence alignment tools known in the art, such as, for example, Clustal Omega or BLAST®. One of ordinary skill in the art would be able to determine a position in a given protein that corresponds to the position between amino acids 588 and 589 of an AAV9 capsid protein, or a position between amino acids 586 and 592 of an AAV9 capsid protein, such as a capsid protein provided in SEQ ID NO: 730 or 731, using methods known in the art.

Aspects of the present disclosure, in some embodiments, provide an AAV vector comprising an amino acid sequence that comprises at least 4 contiguous amino acids from a sequence listed in Table 4, 5, 6, 78, 9, 10, 11, 12, 13, 14, 15, 16, 17, 18, or 19. In some embodiments, the AAV vector comprises at least 4 contiguous amino acids, at least 5 contiguous amino acids, or at least 6 contiguous amino acids of a sequence selected from SEQ ID NOs: 316-522, 732-1909, 3088-3199, 3312-6429, 9548-10086, 10626-10688, 10690-11520, 12481-12683, 12952-20446, 27942-28880, 29819-29983, 30149-30166 and 30185-30204. In some embodiments, an AAV vector comprises a sequence selected from SEQ ID NOs: 316-30,204. In some embodiments, any sequence selected from SEQ ID NOs: 316-30,204 is compatible with aspects of the disclosure, including in some embodiments insertion into AAV vectors as described herein.

In some embodiments, the AAV vector comprises at least 4 contiguous amino acids, at least 5 contiguous amino acids, or at least 6 contiguous amino acids of: PKMTLKI (SEQ ID NO: 320), LGKKTNS (SEQ ID NO: 325), LPKYKSS (SEQ ID NO: 396), GRGNSVL (SEQ ID NO: 465), RSPRVNA (SEQ ID NO: 466), IRNPRMA (SEQ ID NO: 467), ARRPNSE (SEQ ID NO: 480), IKMLNKP (SEQ ID NO: 484), or REVLQRI (SEQ ID NO: 506).

In some embodiments, the AAV vector comprises at least 4 contiguous amino acids, at least 5 contiguous amino acids, or at least 6 contiguous amino acids of: RKPRVHD (SEQ ID NO: 317), YADTNRR (SEQ ID NO: 321), TKSVRVV (SEQ ID NO: 327), TKSSMRP (SEQ ID NO: 336), RRHLAET (SEQ ID NO: 346), RRPPSMG (SEQ ID NO: 354), KDRKVPN (SEQ ID NO: 382), KVTNRHE (SEQ ID NO: 439), DMDLGMG (SEQ ID NO: 453), IEKPTYR (SEQ ID NO: 482), RGKMELY (SEQ ID NO: 505), SKDNHRM (SEQ ID NO: 511), DIHGANL (SEQ ID NO: 512), HSVGYLD (SEQ ID NO: 514), ASLADRP (SEQ ID NO: 515), SKNDHEY (SEQ ID NO: 517), or NLGAINK (SEQ ID NO: 522). In some embodiments, the AAV vector comprises at least 4 contiguous amino acids, at least 5 contiguous amino acids, or at least 6 contiguous amino acids of any of sequences listed in Table 4, 5, 6, 7, 8, 9, 10, 11, 12, 13, 14, 15, 16, 17, 18, or 19.

In some embodiments, the AAV vector comprises at least 4 contiguous amino acids, at least 5 contiguous amino acids, or at least 6 contiguous amino acids of any one of: SEQ ID NO: 732-1909, SEQ ID NO: 3088-3199, SEQ ID NO: 3312-6429, SEQ ID NO: 9548-10086, 1 SEQ ID NO: 0626-10688, SEQ ID NO: 10690-11520, SEQ ID NO: 12481-12683, SEQ ID NO: 12952-20446, SEQ ID NO: 27942-28880, SEQ ID NO: 29819-29983, SEQ ID NO: 30149-30166, or SEQ ID NO: 30185-30204. In some embodiments, the AAV vector does not comprise SEQ ID NO: 10689 (YTLSQGW).

In some embodiments, the AAV vector comprises at least 4 contiguous amino acids, at least 5 contiguous amino acids, or at least 6 contiguous amino acids of: RSMKPNN (SEQ ID NO: 316), RKPRVHD (SEQ ID NO: 317), VRKMPDY (SEQ ID NO: 318), QKPIRIV (SEQ ID NO: 319), PKMTLKI (SEQ ID NO: 320), YADTNRR (SEQ ID NO: 321), RKQMNTT (SEQ ID NO: 322), ELYKLPT (SEQ ID NO: 323), GGQLRKP (SEQ ID NO: 324), LGKKTNS (SEQ ID NO: 325), NRQTVKG (SEQ ID NO: 326), TKSVRVV (SEQ ID NO: 327), GINVRPR (SEQ ID NO: 328), KKGSIGS (SEQ ID NO: 329), LRKNPNP (SEQ ID NO: 330), NSKTVVR (SEQ ID NO: 331), VRRTQLD (SEQ ID NO: 332), KKSTILA (SEQ ID NO: 333), RSKLGSG (SEQ ID NO: 334), DRRGHDR (SEQ ID NO: 335), TKSSMRP (SEQ ID NO: 336), NRITPNR (SEQ ID NO: 337), KIQNNKQ (SEQ ID NO: 338), KSRLTQP (SEQ ID NO: 339), SQKAGGR (SEQ ID NO: 340), ARKTPDY (SEQ ID NO: 341), TRKPVVI (SEQ ID NO: 342), NLKDKRT (SEQ ID NO: 343), KRDARMN (SEQ ID NO: 344), KGSMRQA (SEQ ID NO: 345), RRHLAET (SEQ ID NO: 346), VKTHRPV (SEQ ID NO: 347), or KRNNVAA (SEQ ID NO: 348).

Aspects of the invention relate to AAV capsid proteins. AAV capsid proteins described herein may have a sequence that is different from the corresponding wild type AAV capsid protein sequence or is different from a reference AAV capsid protein sequence. An AAV capsid protein can include an insertion, deletion, or substitution of one or more nucleotides or one or more amino acids relative to the corresponding wild type AAV capsid protein sequence or relative to a reference AAV capsid protein sequence. The insertion, deletion, or substitution of one or more nucleotides or one or more amino acids can be at the 5' end, the 3' end and/or internally within the capsid sequence.

In some embodiments, the AAV capsid protein comprising at least 4, at least 5 contiguous amino acids, or at least 6 contiguous amino acids contiguous amino acids of: PKMTLKI (SEQ ID NO: 320), LGKKTNS (SEQ ID NO: 325), LPKYKSS (SEQ ID NO: 396), GRGNSVL (SEQ ID NO: 465), RSPRVNA (SEQ ID NO: 466), IRNPRMA (SEQ ID NO: 467), ARRPNSE (SEQ ID NO: 480), IKMLNKP (SEQ ID NO: 484), or REVLQRI (SEQ ID NO: 506).

In some embodiments, the AAV capsid protein comprises at least 4 contiguous amino acids, at least 5 contiguous amino acids, or at least 6 contiguous amino acids of: RKPRVHD (SEQ ID NO: 317), YADTNRR (SEQ ID NO: 321), TKSVRVV (SEQ ID NO: 327), TKSSMRP (SEQ ID NO: 336), RRHLAET (SEQ ID NO: 346), RRPPSMG (SEQ ID NO: 354), KDRKVPN (SEQ ID NO: 382), KVTNRHE (SEQ ID NO: 439), DMDLGMG (SEQ ID NO: 453), IEKPTYR (SEQ ID NO: 482). RGKMELY (SEQ ID NO: 505), SKDNHRM (SEQ ID NO: 511), DIHGANL (SEQ ID NO: 512), HSVGYLD (SEQ ID NO: 514), ASLADRP (SEQ ID NO: 515), SKNDHEY (SEQ ID NO: 517), or NLGAINK (SEQ ID NO: 522).

In some embodiments, the AAV capsid protein comprises at least 4 contiguous amino acids, at least 5 contiguous amino acids, or at least 6 contiguous amino acids of: RSMKPNN (SEQ ID NO: 316), RKPRVHD (SEQ ID NO: 317), VRKMPDY (SEQ ID NO: 318), QKPIRIV (SEQ ID NO: 319), PKMTLKI (SEQ ID NO: 320), YADTNRR (SEQ ID NO: 321), RKQMNTT (SEQ ID NO: 322), ELYKLPT (SEQ ID NO: 323), GGQLRKP (SEQ ID NO: 324), LGKKTNS (SEQ ID NO: 325), NRQTVKG (SEQ ID NO: 326), TKSVRVV (SEQ ID NO: 327), GINVRPR (SEQ ID NO: 328), KKGSIGS (SEQ ID NO: 329), LRKNPNP (SEQ ID NO: 330), NSKTVVR (SEQ ID NO: 331), VRRTQLD (SEQ ID NO: 332), KKSTILA (SEQ ID NO: 333), RSKLGSG (SEQ ID NO: 334), DRRGHDR (SEQ ID NO: 335), TKSSMRP (SEQ ID NO: 336), NRITPNR (SEQ ID NO: 337), KIQNNKQ (SEQ ID NO: 338), KSRLTQP (SEQ ID NO: 339), SQKAGGR (SEQ ID NO: 340), ARKTPDY (SEQ ID NO: 341), TRKPVVI (SEQ ID NO: 342), NLKDKRT (SEQ ID NO: 343), KRDARMN (SEQ ID NO: 344), KGSMRQA (SEQ ID NO: 345), RRHLAET (SEQ ID NO: 346), VKTHRPV (SEQ ID NO: 347), or KRNNVAA (SEQ ID NO: 348).

The nucleotide sequence of an AAV capsid protein can be at least about 50%, about 55%, about 60%, about 65%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99% or more than 99%, inclusive of all ranges and subranges therebetween, identical to a wild type AAV capsid nucleotide sequence or a reference AAV capsid nucleotide sequence. The protein sequence of an AAV capsid protein can be at least about 50%, about 55%, about 60%, about 65%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99% or more than 99%, inclusive of all ranges and subranges there between, identical to a wild type AAV capsid protein sequence or a reference AAV capsid protein sequence.

Also disclosed herein are libraries of AAV capsid proteins, such as AAV9 capsid proteins. As used herein, a "library" of AAV capsid proteins refers to a collection of at least two AAV capsid proteins. In some embodiments, at least one of the AAV capsid proteins within the library includes an insertion of a targeting sequence (e.g., a 7-mer). In some embodiments, at least one of the AAV capsid proteins within the library includes an insertion of a targeting sequence selected from the targeting sequences in Table 4, 5, 6, 7, 8, 9, 10, 11, 12, 13, 14, 15, 16, 17, 18, or 19.

The AAV capsid protein can, in some embodiments, include one or more amino acid substitutions relative to the corresponding wildtype AAV capsid protein provided in SEQ ID NO: 730, including but not limited to, a K449R substitution, a A587D substitution, a Q588G substitution, a A587G substitution, a Q588G substitution, a V592T substitution, a K595S substitution, a A595N substitution, a Q597P substitution, or any combination thereof. An example an AAV capsid protein comprising a K449R substitution is provided in SEQ ID NO: 731. Amino acid modifications of AAV capsid proteins are described further in, and incorporated by reference from Li et al. (2012) Journal of Virology 86(15): 7752-7759. Sequences of AAV9 capsid proteins are further described in, and incorporated by reference from U.S. Pat. No. 7,198,951, assigned to The Trustees of the University of Pennsylvania.

The targeting sequences disclosed herein, in some embodiments, can increase transduction efficiency of an AAV across the blood-brain barrier in a subject relative to an AAV that does not contain the targeting sequence. For example, the inclusion of one or more of the targeting sequences disclosed herein in an AAV can result in an increase in transduction efficiency by at least 5%, 10%, 20%, 30%, 40%, 50%, 60%, 70%, 80%, 90%, 100%, 1.5-fold, 2-fold, 2.5-fold, 3-fold, 3.5-fold, 4-fold, 4.5-fold, 5-fold, 5.5-fold, 6-fold, 6.5-fold, 7-fold, 7.5-fold, 8-fold, 10-fold, 20-fold, 30-fold, 40-fold, 50-fold, 60-fold, 70-fold, 80-fold, 90-fold, 100-fold, or more than 100-fold, including all values in between, relative to an AAV that lacks the targeting sequence. In some embodiments, the transduction efficiency is increased for transducing AAV to the blood-brain barrier. In some embodiments, the transduction efficiency is increased for transducing AAV to the CNS. In some embodiments, the transduction efficiency is increased for transducing AAV to the PNS. In some embodiments, the transduction efficiency is increased for transducing AAV to the heart. In some embodiments, the transduction efficiency is increased for transducing AAV to cardiomyocytes, sensory neurons, dorsal root ganglia, visceral organs, or any combination thereof. In some embodiments, the transduction efficiency is increased for transducing AAV to any target environment suitable for the delivery of AAV vectors.

In some embodiments, an AAV9 capsid protein, or a library of AAV9 capsid proteins, is provided in which the AAV9 genome contains the viral replication gene (rep) and capsid gene (cap) that have been modified so as to not prevent the replication of the virus under conditions in which it could normally replicate. In some embodiments, an AAV9 capsid protein, or a library of AAV9 capsid proteins, is provided in which the AAV9 genome contains an engineered cap gene. In some embodiments, an AAV9 capsid protein, or a library of AAV9 capsid proteins, is provided in which the AAV9 genome contains the rep cap genes are flanked by ITRs. In some embodiments, an AAV genome contains the cap gene and contains rep gene sequences that are involved in regulating expression and/or splicing of the cap gene. In some embodiments, a capsid gene recombinase recognition sequence is provided, optionally with flanking ITRs.

Libraries of AAV capsid proteins, such as AAV9 capsid proteins, described herein, can be used to select for AAV capsid proteins that exhibit, e.g.: enhanced targeting to specific cells or organs; evasion of immunity; efficiency at homologous recombination; efficiency of conversion of the single stranded AAV genome to a double stranded DNA genome within a cell; and/or increased conversion of an AAV genome to a persistent, circularized form within the cell.

Targeting Peptides

Aspects of the invention relate to targeting peptides that can direct AAV, e.g., to a specific target environment. In some embodiments, the target environment is a cell (e.g., neuron). In some embodiments, the target environment is neurons, astrocytes, cardiomyocytes, or a combination thereof. In some embodiments, the target environment is an organ (e.g., heart, brain). In some embodiments, the targeting peptide directs AAV to the central nervous system (CNS) of a subject. The CNS includes, e.g., brain tissue, nerves (e.g., optic nerves or cranial nerves), and fluid (e.g., cerebrospinal fluid). In some embodiments, the targeting peptide directs AAV to the peripheral nervous system (PNS) of a subject. Targeting peptides can be conjugated to other components, such as a nanoparticle or a viral capsid protein.

In some embodiments, the targeting peptide comprises an amino acid consensus motif selected from the group consisting of (T/S)-(L/I/V/M)-(A/x)-(V/x)-P-F-K, (SIT)-(V/x)-(S/T/x)-(K/R)-P-F-(L/I/V/A), x-x-x-F-K-(D/N)-(I/V/P), x-(K/R/Y)-(x/R/K/Y/F)-(G/Y/K/R/x)-(Y/W/F/L/M)-(S/A)-(S/T/A/Q), S-X-X-G-W-(V/A/S/T/I/L)-(A/P), Y-X-X-X-X-(G/S)-W, K-X-X-G/X-S-(V/I/Y/F/M)-Y, R-(F/Y)-X-(G/S)-(D/E)-(S/A/P/N/G)(S/A/G/T/V/I/Q), X-X-X-G-(Y/F/W)-S-(Q/S/T/A/M), X-X-X-P-G-V-W, G-X-X-X-G-R-W, (D/E)-(V/G/D/P/L/N/A)-(G/P/A/T/D/N/L)-S-G-R-W, S-(P/UY/E/G/T/D/A)-(G/N/S/D/V/T/H)-(D/S/G/E/P/V/Y/I)-(G/A/S/N/V/A)-R-W, X-X-Y-X-G-S-(S/T/V/A/M/Q/I/H)R-(TVL)-(S/G)-(A/S)-(G/N/x)-(S/G/M/x)-(T/S), G-S-G-T-V-(K/R)-X, Q-N-R-X-X-Y-V, Y-H-P-(L/M)-D-(V/P/I/R/K/UM/W)-(T/S), and X-X-(F/W)-X-P-P-S, where x is any amino acid.

In some embodiments, the targeting peptide comprises an amino acid consensus motif selected from the group consisting of (T/S)-(L/I/V/M)-(A/x)-(V/x)-P-F-K, (SIT)-(V/x)-(S/T/x)-(K/R)-P-F-(L/I/V/A), x-x-x-F-K-(D/N)-(I/V/P), x-(K/R/Y)-(x/R/K/Y/F)-(G/Y/K/R/x)-(Y/W/F/L/M)-(S/A)-(S/T/A/Q), F-T-(hydrophobic)-x-x-P-K, (S/T/x)-x-x-x-P-F-(R/K), G-x-(F/W)-x-P-P-x, (T/S/X)-X-X-(R/K)-P-F-(I/L/V/Q/H/S/T/M/A), P-(S/T/X)-(S/T/X)-(S/T/X)-(S/T/X)-(S/T)-W, (S/G)-X-X-G-W-A-P, L-T-(hydrophobic)-x-T-S-(V/I/K/R), X-X-(K/R)-F-E-X-(I/V/M), X-X-(F/W)-X-P-P-S, S-X-X-G-W-(V/A/S/T/I/L)-(A/P), Y-X-X-X-X-(G/S)-W, K-X-X-G/X-S-(V/I/Y/F/M)-Y, R-(F/Y)-X-(G/S)-(D/E)-(S/A/P/N/G)(S/A/G/T/V/I/Q), X-X-X-G-(Y/F/W)-S-(Q/S/T/A/M), X-X-X-P-G-V-W, G-X-X-X-G-R-W, (D/E)-(V/G/D/P/L/N/A)-(G/P/A/T/D/N/L)-S-G-R-W, S-(P/L/Y/E/G/T/D/A)-(G/

N/S/D/V/T/H)-(D/S/G/E/P/V/Y/I)-(G/A/S/N/V/A)-R-W, X-X-Y-X-G-S-(S/T/V/A/M/Q/I/H), R-(TVL)-(S/G)-(A/S)-(G/N/x)-(S/G/M/x)-(T/S), G-S-G-T-V-(K/R)-X, Q-N-R-X-X-Y-V, and Y-H-P-(L/M)-D-(V/P/I/R/K/L/M/W)-(T/S), where x is any amino acid.

Targeting peptides, as described herein, may be various lengths. In some embodiments, the targeting peptide comprises 4 amino acids (e.g., 4-mer). In some embodiments, the targeting peptide comprises 5 amino acids (e.g., 5-mer). In some embodiments, the targeting peptide comprises 6 amino acids (e.g., 6-mer). In some embodiments, the targeting peptide comprises 7 amino acids (e.g., 7-mer). In some embodiments, the targeting peptide comprises 8 amino acids (e.g., 8-mer). In some embodiments, the targeting peptide comprises 9 amino acids (e.g., 9-mer). In some embodiments, the targeting peptide comprises 10 amino acids (e.g., 10-mer). In some embodiments, the targeting peptide comprises less than 4 or more than 10 amino acids. In some embodiments, the targeting peptide can be any length comprising any numbers of amino acids that are suitable for the incorporation into AAV vectors.

Targeting peptides, as described herein, may be charged or uncharged. In some embodiments, the targeting peptide is positively charged. In some embodiments, the targeting peptide is negatively charged. In some embodiments, the targeting peptide is neutrally charged. In some embodiments, the targeting peptide is uncharged.

Targeting peptides, as described herein, may comprise positively charged amino acids and negatively charged amino acids in various ratios. In some embodiments, the targeting peptide comprises positively charged amino acids and negatively charged amino acids in a 0:1 or 1:0 ratio. In some embodiments, the targeting peptide comprises positively charged amino acids and negatively charged amino acids in a 1:1, 2:1, 3:1, or 4:1 ratio. In some embodiments, the targeting peptide comprises positively charged amino acids and negatively charged amino acids in a 1:2, 1:3, or 1:4 ratio. In some embodiments, the targeting peptide comprises at least one negatively charged amino acids (e.g., arginine) and at least one hydrophobic amino acid residue (e.g., leucine). In some embodiments, the targeting peptide comprises two arginine residues and two leucine residues.

In some embodiments, the targeting peptide comprises an amino acid consensus motif consisting of (T/S)-(L/I/V/M)-(A/x-V/x-P-F-K) (SEQ ID NO: 30225), where x is any amino acid. In some embodiments, the targeting peptide comprises an amino acid sequence selected from the group consisting of SEQ ID NOs: 20-33. In some embodiments, the targeting peptide is encoded by a nucleic acid sequence selected from the group consisting of SEQ ID NOs: 34-47.

In some embodiments, the targeting peptide comprises an amino acid consensus motif consisting of (S/T)-(V/x)-(S/T/x)-(K/R)P-F-(L/I/V/A) (SEQ ID NO: 30226), where x is any amino acid. In some embodiments, the targeting peptide comprises an amino acid sequence selected from the group consisting of SEQ ID NOs: 48-77. In some embodiments, the targeting peptide is encoded by a nucleic acid sequence selected from the group consisting of SEQ ID NOs: 78-107.

In some embodiments, the targeting peptide comprises an amino acid consensus motif consisting of x-x-x-F-K-(D/N)-(I/V/P) (SEQ ID NO: 30227), where x is any amino acid. In some embodiments, the targeting peptide comprises an amino acid sequence selected from the group consisting of SEQ ID NOs: 108-119. In some embodiments, the targeting peptide is encoded by a nucleic acid sequence selected from the group consisting of SEQ ID NOs: 120-131.

In some embodiments, the targeting peptide comprises an amino acid consensus motif consisting of x-(K/R/Y)-(x/R/K/Y/F)-(G/Y/K/R/x)-(Y/W/F/L/M)-(S/A)-(S/T/A/Q) (SEQ ID NO: 30228), where x is any amino acid. In some embodiments, the targeting peptide comprises an amino acid sequence selected from the group consisting of SEQ ID NOs: 132-218. In some embodiments, the targeting peptide is encoded by a nucleic acid sequence selected from the group consisting of SEQ ID NOs: 219-305.

In some embodiments, the targeting peptide comprises an amino acid consensus motif consisting of R-(TVL)-(S/G)-(A/S)-(G/N/x)-(S/G/M/x)-(T/S) (SEQ ID NO: 30280), where x is any amino acid. In some embodiments, the targeting peptide comprises an amino acid sequence selected from the group consisting of SEQ ID NOs: 30149-30155.

In some embodiments, the targeting peptide comprises an amino acid consensus motif consisting of G-S-G-T-V-(K/R)-X (SEQ ID NO: 30281), where x is any amino acid. In some embodiments, the targeting peptide comprises an amino acid sequence selected from the group consisting of SEQ ID NOs: 30156-20160.

In some embodiments, the targeting peptide comprises an amino acid consensus motif consisting of Q-N-R-X-X-Y-V (SEQ ID NO: 30282), where x is any amino acid. In some embodiments, the targeting peptide comprises an amino acid sequence selected from the group consisting of SEQ ID NOs: 30161-30162.

In some embodiments, the targeting peptide comprises an amino acid consensus motif consisting of Y-H-P-(L/M)-D-(V/P/I/R/K/L/M/W)-(T/S) (SEQ ID NO: 30283), where x is any amino acid. In some embodiments, the targeting peptide comprises an amino acid sequence selected from the group consisting of SEQ ID NOs: 30185-30204.

In some embodiments, the targeting peptide comprises at least 4 contiguous amino acids, at least 5 contiguous amino acids, or at least 6 contiguous amino acids of a sequence selected from SEQ ID NOs: 306-310. In some embodiments, the targeting peptide is encoded by a nucleic acid sequence selected from the group consisting of SEQ ID NOs: 311-315.

In some embodiments, the targeting peptide comprises an amino acid sequence selected from the group consisting of SEQ ID NOs: 316-30204. In some embodiments, the targeting peptide is encoded by a nucleic acid sequence selected from the group consisting of SEQ ID NOs: 523-729.

In some embodiments, the targeting peptide comprises at least 4 contiguous amino acids, at least 5 contiguous amino acids, or at least 6 contiguous amino acids of: PKMTLKI (SEQ ID NO: 320), LGKKTNS (SEQ ID NO: 325), LPKYKSS (SEQ ID NO: 396), GRGNSVL (SEQ ID NO: 465), RSPRVNA (SEQ ID NO: 466), IRNPRMA (SEQ ID NO: 467), ARRPNSE (SEQ ID NO: 480), IKMLNKP (SEQ ID NO: 484), or REVLQRI (SEQ ID NO: 506).

In some embodiments, the targeting peptide comprises at least 4 contiguous amino acids, at least 5 contiguous amino acids, or at least 6 contiguous amino acids of: RKPRVHD (SEQ ID NO: 317), YADTNRR (SEQ ID NO: 321), TKSVRVV (SEQ ID NO: 327), TKSSMRP (SEQ ID NO: 336), RRHLAET (SEQ ID NO: 346), RRPPSMG (SEQ ID NO: 354), KDRKVPN (SEQ ID NO: 382), KVTNRHE (SEQ ID NO: 439), DMDLGMG (SEQ ID NO: 453), IEKPTYR (SEQ ID NO: 482), RGKMELY (SEQ ID NO: 505), SKDNHRM (SEQ ID NO: 511), DIHGANL (SEQ ID NO: 512), HSVGYLD (SEQ ID NO: 514), ASLADRP (SEQ ID NO: 515), SKNDHEY (SEQ ID NO: 517), or NLGAINK (SEQ ID NO: 522).

In some embodiments, the targeting peptide comprises at least 4 contiguous amino acids, at least 5 contiguous amino acids, or at least 6 contiguous amino acids of: RSMKPNN (SEQ ID NO: 316), RKPRVHD (SEQ ID NO: 317), VRKMPDY (SEQ ID NO: 318), QKPIRIV (SEQ ID NO: 319), PKMTLKI (SEQ ID NO: 320), YADTNRR (SEQ ID NO: 321), RKQMNTT (SEQ ID NO: 322), ELYKLPT (SEQ ID NO: 323), GGQLRKP (SEQ ID NO: 324), LGKKTNS (SEQ ID NO: 325), NRQTVKG (SEQ ID NO: 326), TKSVRVV (SEQ ID NO: 327), GINVRPR (SEQ ID NO: 328), KKGSIGS (SEQ ID NO: 329), LRKNPNP (SEQ ID NO: 330), NSKTVVR (SEQ ID NO: 331), VRRTQLD (SEQ ID NO: 332), KKSTILA (SEQ ID NO: 333), RSK-LGSG (SEQ ID NO: 334), DRRGHDR (SEQ ID NO: 335), TKSSMRP (SEQ ID NO: 336), NRITPNR (SEQ ID NO: 337), KIQNNKQ (SEQ ID NO: 338), KSRLTQP (SEQ ID NO: 339), SQKAGGR (SEQ ID NO: 340), ARKTPDY (SEQ ID NO: 341), TRKPVVI (SEQ ID NO: 342), NLKDKRT (SEQ ID NO: 343), KRDARMN (SEQ ID NO: 344), KGSMRQA (SEQ ID NO: 345), RRHLAET (SEQ ID NO: 346), VKTHRPV (SEQ ID NO: 347), or KRNNVAA (SEQ ID NO: 348).

In some embodiments, the targeting peptide comprises at least 4 contiguous amino acids, at least 5 contiguous amino acids, or at least 6 contiguous amino acids of any one of: SEQ ID NO: 732-1909, SEQ ID NO: 3088-3199, SEQ ID NO: 3312-6429, SEQ ID NO: 9548-10086, 1 SEQ ID NO: 0626-10688, SEQ ID NO: 10690-11520, SEQ ID NO: 12481-12683, SEQ ID NO: 12952-20446, SEQ ID NO: 27942-28880, SEQ ID NO: 29819-29983, SEQ ID NO: 30149-30166, or SEQ ID NO: 30185-30204.

In some embodiments, the targeting peptide comprises at least 4 contiguous amino acids, at least 5 contiguous amino acids, or at least 6 contiguous amino acids from a sequence selected from the group consisting of SEQ ID NOs: 20-33, SEQ ID NOs: 48-77, SEQ ID NOs: 108-119, SEQ ID NOs: 132-218. SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide comprises at least 5 contiguous amino acids from a sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide comprises at least 6 contiguous amino acids from a sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide comprises 7 contiguous amino acids from a sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204.

In some embodiments, the targeting peptide is at least 75% identical to an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide is at least 80% identical to an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide is at least 85% identical to an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522. SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide is at least 90% identical to an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide is at least 95% identical to an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide is at least 98% identical to an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204.

In some embodiments, the targeting peptide comprises at least 1 amino acid substitution in an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide comprises at least 2 amino acid substitutions in an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the targeting peptide comprises at least 3, at least 4, at least 5, or at least 6, or at least 7 amino acid substitutions in an amino acid sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204. In some embodiments, the at least one amino acid substitution is a conservative amino acid substitution.

In some embodiments, a targeting peptide contains one or more amino acid substitutions relative to a sequence disclosed in Table 4, 5, 6, 7, 8, 9, 10, 11, 12, 13, 14, 15, 16, 17, 18, or 19. In some embodiments, the amino acid substitution is a conservative amino acid substitution. As used herein, a "conservative amino acid substitution" refers to an amino acid substitution that does not alter the relative charge or size characteristics or functional activity of the protein in which the amino acid substitution is made. Conservative substitutions of amino acids include substitutions made amongst amino acids within the following groups: (a) M, I, L, V; (b) F, Y, W; (c) K, R, H; (d) A, G; (e) S, T; (f) Q, N; and (g) E, D. Non-limiting examples of conservative amino acid substitutions are provided in Table 8.

TABLE 8

Non-limiting Examples of Conservative Amino Acid Substitutions

| Original Residue | R Group Type | Conservative Amino Acid Substitutions |
|---|---|---|
| Ala | nonpolar aliphatic R group | Cys, Gly, Ser |
| Arg | positively charged R group | His, Lys |
| Asn | polar uncharged R group | Asp, Gln, Glu |
| Asp | negatively charged R group | Asn, Gln, Glu |
| Cys | polar uncharged R group | Ala, Ser |
| Gln | polar uncharged R group | Asn, Asp, Glu |
| Glu | negatively charged R group | Asn, Asp, Gln |
| Gly | nonpolar aliphatic R group | Ala, Ser |
| His | positively charged R group | Arg, Tyr, Trp |
| Ile | nonpolar aliphatic R group | Leu, Met, Val |
| Leu | nonpolar aliphatic R group | Ile, Met, Val |
| Lys | positively charged R group | Arg, His |
| Met | nonpolar aliphatic R group | Ile, Leu, Phe, Val |
| Pro | polar uncharged R group | |
| Phe | nonpolar aromatic R group | Met, Trp, Tyr |
| Ser | polar uncharged R group | Ala, Gly, Thr |
| Thr | polar uncharged R group | Ala, Asn, Ser |
| Trp | nonpolar aromatic R group | His, Phe, Tyr, Met |
| Tyr | nonpolar aromatic R group | His, Phe, Trp |
| Val | nonpolar aliphatic R group | Ile, Leu, Met, Thr |

In some embodiments, a targeting peptide comprises one or more of the sequences disclosed herein. In other embodiments, a targeting peptide consists of one or more of the sequences disclosed herein. In other embodiments, a targeting peptide consists essentially of one or more of the sequences disclosed herein. Targeting peptides described herein can be fused to or inserted into longer peptides. In some embodiments, targeting peptides are isolated. In some embodiments, targeting peptides are not naturally occurring.

Also disclosed herein are nucleic acid sequences that encode one or more of the targeting peptides disclosed herein. In some embodiments, a nucleic acid sequence encoding a targeting peptide comprises or consists of a sequence selected from the group consisting of SEQ ID NOs: 20-33, SEQ ID NOs: 48-77, SEQ ID NOs: 108-119, SEQ ID NOs: 132-218, SEQ ID NOs: 306-310, SEQ ID NOs: 316-522, SEQ ID NOs: 732-1909, SEQ ID NOs: 3088-3199, SEQ ID NOs: 3312-6429, SEQ ID NOs: 9548-10086, SEQ ID NOs: SEQ ID NOs: 10626-10688, SEQ ID NOs: 10690-11520, SEQ ID NOs: 12481-12683, SEQ ID NOs: 12952-20446, SEQ ID NOs: 27942-28880, SEQ ID NOs: 29819-29983, SEQ ID NOs: 30149-30166 and SEQ ID NOs: 30185-30204.

In some embodiments, the nucleic acid sequence encoding a targeting peptide comprises an amino acid sequence of: PKMTLKI (SEQ ID NO: 320), LGKKTNS (SEQ ID NO: 325), LPKYKSS (SEQ ID NO: 396), GRGNSVL (SEQ ID NO: 465), RSPRVNA (SEQ ID NO: 466), IRNPRMA (SEQ ID NO: 467), ARRPNSE (SEQ ID NO: 480), IKMLNKP (SEQ ID NO: 484), or REVLQRI (SEQ ID NO: 506).

In some embodiments, the nucleic acid sequence encoding a targeting peptide comprises an amino acid sequence of: RKPRVHD (SEQ ID NO: 317), YADTNRR (SEQ ID NO: 321), TKSVRVV (SEQ ID NO: 327), TKSSMRP (SEQ ID NO: 336), RRHLAET (SEQ ID NO: 346), RRPPSMG (SEQ ID NO: 354), KDRKVPN (SEQ ID NO: 382), KVTNRHE (SEQ ID NO: 439), DMDLGMG (SEQ ID NO: 453), IEKPTYR (SEQ ID NO: 482), RGKMELY (SEQ ID NO: 505), SKDNHRM (SEQ ID NO: 511), DIHGANL (SEQ ID NO: 512), HSVGYLD (SEQ ID NO: 514), ASLADRP (SEQ ID NO: 515), SKNDHEY (SEQ ID NO: 517), or NLGAINK (SEQ ID NO: 522).

In some embodiments, the nucleic acid sequence encoding a targeting peptide comprises an amino acid sequence of: RSMKPNN (SEQ ID NO: 316), RKPRVHD (SEQ ID NO: 317), VRKMPDY (SEQ ID NO: 318), QKPIRIV (SEQ ID NO: 319), PKMTLKI (SEQ ID NO: 320), YADTNRR (SEQ ID NO: 321), RKQMNTT (SEQ ID NO: 322), ELYKLPT (SEQ ID NO: 323), GGQLRKP (SEQ ID NO: 324), LGKKTNS (SEQ ID NO: 325), NRQTVKG (SEQ ID NO: 326), TKSVRVV (SEQ ID NO: 327), GINVRPR (SEQ ID NO: 328), KKGSIGS (SEQ ID NO: 329), LRKNPNP (SEQ ID NO: 330), NSKTVVR (SEQ ID NO: 331), VRRTQLD (SEQ ID NO: 332), KKSTILA (SEQ ID NO: 333), RSKLGSG (SEQ ID NO: 334), DRRGHDR (SEQ ID NO: 335), TKSSMRP (SEQ ID NO: 336), NRITPNR (SEQ ID NO: 337), KIQNNKQ (SEQ ID NO: 338), KSRLTQP (SEQ ID NO: 339), SQKAGGR (SEQ ID NO: 340), ARKTPDY (SEQ ID NO: 341), TRKPVVI (SEQ ID NO: 342), NLKDKRT (SEQ ID NO: 343), KRDARMN (SEQ ID NO: 344), KGSMRQA (SEQ ID NO: 345), RRHLAET (SEQ ID NO: 346), VKTHRPV (SEQ ID NO: 347), or KRNNVAA (SEQ ID NO: 348).

In some embodiments, a targeting peptide does not comprise or consist of a sequence disclosed in WO2015/038958 or WO2017/100671, which are incorporated by reference herein in their entireties.

Target Proteins

Disclosed herein are targeting peptides capable of directing AAV to the central nervous system (CNS) via binding to at least one target protein. In some embodiments, an AAV capsid protein comprising a targeting peptide has increased transduction efficiency across the blood-brain barrier as compared to an AAV capsid protein lacking the targeting peptide. As used herein, the term "blood-brain barrier" or "BBB" refers to a network of blood vessels and tissue comprising closely spaced cells that regulate transport of substances between circulating blood from the brain and extracellular fluid in the CNS.

Target proteins that bind to targeting peptides described herein can include one or more of the following characteristics: expression in the CNS; capability of mediating transcytosis; capability of mediating endocytosis; capability of mediating intra-cellular trafficking; association with lipid rafts; and linkage to the cell surface, such as through a glycophosphatidylinositol (GPI) anchor. Characteristics of GPI-anchored proteins are described in, and incorporated by reference, from Zurzolo et al. (2016) *BBA*1858: 632-639; Saha et al. (2016) J. *Lipid Res.* 57: 159-175; Mayor et al. (2004) *Nat Rev Mol Cell Biol* 5, 110-120.

Target proteins, as described herein, can include, but are not limited to, members of the lymphocyte antigen-6 (Ly6)/urokinase-type plasminogen activator receptor (uPAR) protein family and GPI-anchored proteins. Notably, AAV2 has been shown to internalize in detergent-resistant GPI-anchored protein enriched endosomal compartment (GEEC), which is described in, and incorporated by reference, from: https://doi.org/10.1016/j.chom.2011.10.014. Ly6/uPAR proteins are cysteine-rich proteins characterized by a distinct disulfide bridge pattern that creates the three-finger Ly6/uPAR (LU) domain. As used herein, "Ly6/uPAR proteins" includes proteins that contain an LU domain regardless of whether they have been characterized as Ly6/uPAR proteins, and includes proteins that have been characterized as "Ly6-like" proteins, such as CD59. One of ordinary skill in the art would be able to recognize whether a protein sequence corresponds to a Ly6/uPAR protein, as used herein. For example, in some embodiments, a protein can be characterized as a Ly6/uPAR protein based on its level of homology to a protein that has been characterized as a Ly6/uPAR protein, or based on its level of homology to a protein that has been characterized as a Ly6-like protein. In other embodiments, a protein can be characterized as a Ly6/uPAR protein based on the presence of an LU domain.

The Ly6/uPAR protein family comprises at least 35 human and 61 mouse Ly6/uPAR proteins. Ly6/uPAR proteins are classified as glycophosphatidylinositol (GPI)-anchored proteins on the cell membrane or as secreted proteins based on their subcellular localization. The genes encoding Ly6/uPAR family proteins are conserved across different species and are clustered in syntenic regions on human chromosomes 8, 19, 6 and 11, and mouse Chromosomes 15, 7, 17, and 9, respectively. The Ly6/uPAR protein family is described further in Loughner et al. (2016) *Human Genomics* 10:10, which is incorporated by reference herein in its entirety.

Targeting peptides as described herein, in some embodiments, bind to a Ly6/uPAR protein. The Ly6/uPAR protein can be from any mammal, including humans and non-human primates. In some embodiments, the targeting peptide binds to a human Ly6 protein. In other embodiments, the targeting peptide binds to a non-human primate Ly6 protein. In other embodiments, the targeting peptide binds to a rodent Ly6/uPAR protein, such as a mouse Ly6/uPAR protein. Examples of Ly6/uPAR proteins include, but are not limited to, ACRV1, CD177, CD59A, CD59B, GML, GML2, GPIHBP1, LY6A, LY6A2, LY6C1, LY6C2, LY6D, LY6E, LY6F, LY6G, LY6G2, LY6G5B, LY6G5C, LY6G6C, LY6G6D, LY6G6E, LY6G6F, LY6G6G, LY6H, LY6I, LY6K, LY6L, LY6M, LYNX1, LYPD1, LYPD2, LYPD3, LYPD4, LYPD5, LYPD6, LYPD6B, LYPD8, LYPD9, LYPD10, LYPD11, PATE1, PATE2, PATE3, PATE4, PATE5, PATE6, PATE7, PATE8, PATE9, PATE10, PATE11, PATE12, PATE13, PATE14, PINLYP, PLAUR, PSCCA, SLURP1, SLURP2, SPACA4, and TEX101.

Human genes encoding Ly6/uPAR proteins include, but are not limited to, $ACRV_1$, $CD_{177}$, $CD_{59}$, GML, $GPIHBP_1$, LY6D, LY6E, LY6G5B, LY6G5C, LY6G6C, LY6G6D, LY6G6E, LY6G6F, LY6H, LY6K, LY6L, $LYNX_1$, $LYPD_1$, $LYPD_2$, $LYPD_3$, $LYPD_4$, $LYPD_5$, $LYPD_6$, LYPD6B, LYPD8, $PATE_1$, $PATE_2$, $PATE_3$, $PATE_4$, PINLYP, PLA UR, PSCA, $SLURP_1$, $SLURP_2$, $SPACA_4$, and $TEX_{101}$.

Mouse genes encoding Ly6/uPAR proteins include, but are not limited to, $Acrv_1$, $Cd_{177}$, $Cd_{59a}$, $Cd_{59b}$, Gml, $Gml_2$, $Gpihbp_1$, Ly6a, $Ly6a_2$, $Ly6c_1$, $Ly6c_2$, Ly6d, Ly6e, Ly6f, Ly6g, $Ly6g_2$, Ly6g5b, Ly6g5c, Ly6g6c, Ly6g6d, Ly6g6e, Ly6g6f, Ly6g6g, Ly6h, Ly6i, Ly6k, Ly6l, Ly6m, $Lynx_1$, $Lypd_1$, $Lypd_2$, $Lypd_3$, $Lypd_4$, $Lypd_5$, $Lypd_6$, $Lypd_{6b}$, $Lypd_8$, $Lypd_9$, $Lypd_{10}$, $Lypd_{11}$, $Pate_1$, $Pate_2$, $Pate_3$, $Pate_4$, $Pate_5$, $Pate_6$, $Pate_7$, $Pate_8$, $Pate_9$, $Pate_{10}$, $Pate_{11}$, $Pate_{12}$, $Pate_{13}$, $Pate_{14}$, Pinlyp, Plaur, Psca, $Slurp_1$, $Slurp_2$, $Spaca_4$, and $Tex_{101}$.

It should be appreciated that Ly6/uPAR proteins and their expression patterns are known in the art. Information regarding the sequences of Ly6/uPAR proteins and the tissues or cells in which they are expressed is available through public databases known to one of ordinary skill in the art.

In some embodiments, the targeting peptides described herein may bind to a target protein (e.g., Ly6/uPAR protein) with a dissociation constant (Kd) lower than 20 nM (e.g., 15 nM, 10 nM, 5 nm, 1 nm, or less than 1 nm). In some embodiments, the targeting peptides described herein may bind to a Ly6/uPAR protein (e.g., human Ly6) with a dissociation constant (Kd) lower than 20 nM (e.g., 15 nM, 10 nM, 5 nm, 1 nm, or less than 1 nm). The targeting peptide may specifically bind human Ly6. Alternatively, the targeting peptides may bind to Ly6 from different species (e.g., human, non-human primate, mouse, and/or rat). It should be appreciated that any method known in the art for measuring binding activity can be compatible with aspects of the disclosure.

Targeting peptides as described herein, in some embodiments, bind to a target protein expressed in the nervous system. In some embodiments, the targeting peptide binds to a target protein expressed in the CNS. In other embodiments, the targeting peptide binds to a target protein expressed in the PNS. In other embodiments, the targeting peptide binds to a target protein expressed in a hematopoietic lineage, such as an immune cell. Accordingly, in some embodiments, targeting peptides described herein mediate delivery of nucleic acids to the CNS or PNS. In other embodiments, targeting peptides described herein mediate delivery of nucleic acids to a hematopoietic lineage, such as an immune cell.

In some embodiments, targeting peptides described herein mediate delivery of nucleic acids. In other embodiments, targeting peptides described herein mediate delivery of other biologics, such as antibodies. In some embodiments, targeting peptides described herein mediate delivery of nucleic acids or other biologics, such as antibodies, across the blood brain barrier.

In some embodiments, the targeting peptide binds to a target protein involved in cell trafficking. In some embodiments, the targeting peptide binds to a target protein involved in endocytosis. In some embodiments, the targeting peptide binds to a target protein capable of being internalized or trafficked to certain organelles. In some embodiments, the targeting peptide binds to a target protein involved in trafficking to the Golgi. In some embodiments, the targeting peptide binds to a target protein involved in transcytosis in endothelial cells. In some embodiments, the targeting peptide binds to a target protein involved in transcytosis in epithelial cells.

In some embodiments, the targeting peptide binds to a target protein associated with a lipid raft. In some embodiments, the targeting peptide binds to a target protein comprising a GPI-anchor. In some embodiments, the targeting peptide binds to a target protein comprising a typical GPI-attachment signal, e.g., a polar segment that includes the GPI-attachment site followed by a hydrophobic segment located at the C-terminus of the protein.

In some embodiments, the targeting peptide binds to a CNS endothelium protein (e.g., CD59, Ly6E, GPIHBP1) and/or a cell surface protein (e.g., PRNP). In some embodiments, the targeting peptide binds to CD59. In some embodiments, the targeting peptide binds to Ly6E. In some embodiments, the targeting peptide binds to GPIHBP1. In some embodiments, the targeting peptide binds to PRNP.

In some embodiments, the targeting peptides bind to a GPI-anchored protein. In some embodiments, the genes encoding GPI-anchored proteins can include but are not limited to the genes listed in Table 20.

Targeting peptides as described herein, in some embodiments, bind to a target protein and one or more homologues of the target protein. In some embodiments, the target protein is selected from the group consisting of a human protein, a non-human primate protein (e.g., a marmoset protein), and a rodent protein (e.g., a mouse protein). In some embodiments, the homologous target protein is selected from the group consisting of a human protein, a non-human primate protein (e.g., a marmoset protein), and a rodent protein (e.g., a mouse protein).

In some embodiments, the targeting peptide binds to a target protein and at least one homologous target protein. For example, the targeting peptide binds a human target protein and a homolog of the target protein from a non-human primate (e.g., a marmoset). In some embodiments, the targeting peptide binds a human target protein and a homolog of the target protein from a rodent (e.g., a mouse). In some embodiments, the targeting peptide binds target protein from a non-human primate (e.g., a marmoset) and a homolog of the target protein from a rodent (e.g., a mouse).

In some embodiments, the targeting peptide binds to a target protein and at least two homologous target proteins. For example, the targeting peptide binds a human target protein, a homolog of the target protein from a non-human primate (e.g., marmoset), and a homolog of the target protein from a rodent (e.g., a mouse).

In some embodiments, the targeting peptide binds a human target protein and a homolog of the target protein from marmoset. In some embodiments, the targeting peptide binds a human target protein, a homolog of the target protein from marmoset, and a homolog of the target protein from mouse. In some embodiments, the targeting peptide binds a mouse target protein and a homolog of the target protein from marmoset.

Accordingly, aspects of the invention relate to recombinant AAV capsid proteins that bind to target proteins, such as Ly6/uPAR proteins, and that can be used to mediate transport of materials across the blood-brain barrier.

Methods for Selecting Targeting Peptides Based on Target Protein Binding

Methods provided herein, in some embodiments, are useful for identifying targeting peptides, or AAV capsid proteins harboring targeting peptides, that bind target proteins. In some embodiments, the target protein is ectopically expressed on cells. In some embodiments, the target protein is a recombinant protein. In some embodiments, the target protein is endogenously expressed in a cell. In some embodiments, methods provided herein are useful for identifying AAV capsids proteins that cross specific barriers (e.g., blood-brain barrier or gut epithelium). In some embodiments, methods provided herein are useful for identifying AAV9 capsids proteins.

Targeting peptides described herein can be identified by incubating a candidate targeting peptide (e.g., an AAV capsid protein containing a targeting peptide) with a Ly6/uPAR protein; and selecting the targeting peptide if it binds to the Ly6/uPAR protein. In some embodiments, the Ly6/uPAR protein is expressed in a cell, such as on the surface of the cell, and binding of the targeting peptide (e.g., an AAV capsid protein containing a targeting peptide) to the cell that expresses the target protein on the surface of the cell is detected. Such binding assays may be performed with purified target protein (e.g., a purified Ly6/uPAR protein), or with cells naturally expressing or transfected to express a target protein (e.g., a Ly6/uPAR protein). Binding assays may be performed in various formats, including in vitro, or in cell culture, and including high-throughput formats. In some embodiments, a targeting peptide (e.g., an AAV capsid protein containing a targeting peptide) described herein can be further evaluated by monitoring its ability to mediate transcytosis across the blood-brain barrier.

In some embodiments, the target protein (e.g., a Ly6/uPAR protein) is endogenously expressed in a cell. In some embodiments, a control cell does not express a Ly6/uPAR protein. For example, expression of a Ly6/uPAR protein in some embodiments is decreased in a control cell, such as by mutating or deleting expression of the gene encoding a Ly6/uPAR protein. In some embodiments, the level of binding between a targeting peptide and a target protein (e.g., a Ly6/uPAR protein) is compared between a cell that expresses a target protein (e.g., a Ly6/uPAR protein) and a cell that does not express a target protein (e.g., a Ly6/uPAR protein).

In some embodiments, the targeting peptide disclosed herein specifically binds to a target protein, such as a human Ly6/uPAR protein. Methods to determine such specific binding are well known in the art. A targeting peptide is said to exhibit "specific binding" or to "specifically bind to a target protein" if it reacts or associates more frequently, more rapidly, with greater duration and/or with greater affinity with a particular target protein than it does with alternative target proteins. A targeting peptide that specifically binds to a first target protein may or may not specifically or preferentially bind to a second target protein.

As such, "specific binding" or "preferential binding" does not necessarily require (although it can include) exclusive binding. Generally, but not necessarily, reference to binding means preferential binding.

An AAV capsid protein is said to exhibit "specific binding" or to "specifically bind" to a protein if it reacts or associates more frequently, more rapidly, with greater duration and/or with greater affinity with the protein than it does with alternative target proteins. An AAV capsid protein that specifically binds to a protein may or may not specifically or preferentially bind to the protein. In some embodiments, the protein is a protein of the Ly6/uPAR protein family attached to the surface of a cell. In some embodiments, the protein is a GPI-anchored protein attached to the surface of a cell. In some embodiments, the protein is i) a protein that exhibits luminal surface exposure on brain endothelium; ii) a protein that is localized within lipid micro-domains; and/or iii) a protein that exhibits recycling/intracellular trafficking capabilities. In some embodiments, specific binding is determined by comparison to a control. For example, a control may involve contacting an AAV capsid protein with a cell that does not express the protein or contacting an AAV capsid protein with a cell that expresses a different protein.

For example, methods disclosed herein can comprise providing an AAV capsid protein, incubating the AAV capsid protein with a cell that recombinantly expresses a target protein attached to the surface of the cell, and selecting the AAV capsid protein if it specifically binds to the target protein attached to the surface of the cell.

In some embodiments, methods disclosed herein can comprise providing an AAV capsid protein, incubating the AAV capsid protein with a target protein that was purified from cells expressing the target protein, and selecting the AAV capsid protein if it specifically binds to the target protein.

In some embodiments, methods comprise providing an AAV capsid protein, incubating the AAV capsid protein with a cell that recombinantly expresses a Ly6/uPAR protein attached to the surface of the cell, and selecting the AAV capsid protein if it specifically binds to the Ly6/uPAR protein attached to the surface of the cell.

In some embodiments, methods comprise providing an AAV capsid protein, incubating the AAV capsid protein with a Ly6/uPAR protein, and selecting the AAV capsid protein if it specifically binds to the Ly6/uPAR protein.

In some embodiments, methods comprise screening for an AAV capsid protein that can bind to a target protein, comprising providing a library of AAV capsid proteins, incubating the library of AAV capsid proteins with a cell that recombinantly expresses a target protein attached to the surface of the cell, isolating an AAV capsid protein that binds to the cells that recombinantly express the target protein on the cell surface, and identifying the sequence of the isolated AAV capsid protein.

In some embodiments, methods comprise screening for an AAV capsid protein that can bind to a target protein, comprising providing a library of AAV capsid proteins, incubating the library of AAV capsid proteins with a target protein (e.g., a recombinant target protein or a target protein purified from cells expressing the target protein), isolating an AAV capsid protein that binds to the target protein, and identifying the sequence of the isolated AAV capsid protein.

The sequence of the isolated AAV capsid proteins may be identified using any sequencing methods known in the art. In some embodiments, AAV capsid proteins are sequenced using short read sequencing technology. In some embodiments, AAV capsid proteins are sequenced using long read sequencing technology. In some embodiments, AAV capsid proteins are sequenced using next-generation sequencing (NGS) technology or whole genome sequencing (WGS) technology.

Methods provided herein may be performed using any type of cell. Examples of cells include, but are not limited to, mammalian cells, rodent cells, yeast cells, and bacterial cells. Examples of mammalian cells include, but are not limited to, CHO (Chinese Hamster Ovary), VERO, HeLa, CVI, COS, COS-7, BHK (baby hamster kidney), MDCK, CI 27, PC 12, HEK-293, PER C6, NSO, WI38, R1610, BALBC/3T3, HAK, SP2/0, P3x63-Ag3.653, BFA-1c1BPT, RAJI, and 293 cells.

Methods provided herein may be performed using purified endogenous proteins, tagged AviTag, C-tag, Calmodulin-tag, E-tag, FLAG, HA, poly-HIS, MYC, NE, Rho1D4, S-tag, SBP, Softag, Spot-tag, T7-tag, TC, Ty, V5, VSV, Xpress, Isopeptag, SpyTag, SnoopTag, DogTag, SdyTag, BCCP, GST, GFP, Halo, SNAP, CLIP, Maltose binding protein (MBP), Nus-tag, Thioredoxin-tag, Fc-tag, CRDSAT, SUMO-tag, B2M-tag. The recombinant proteins can be purified from any cell type. Examples of cells include, but are not limited to, mammalian cells, rodent cells, yeast cells, and bacterial cells. Examples of mammalian cells include, but are not limited to, CHO (Chinese Hamster Ovary), VERO, HeLa, CVI, COS, COS-7, BHK (baby hamster kidney), MDCK, CI 27, PC 12, HEK-293, PER C6, NSO, WI38, R1610, BALBC/3T3, HAK, SP2/0, P3x63-Ag3.653, BFA-1c1BPT, RAJI, and 293 cells Methods of Use Methods provided herein, in some embodiments, are useful for delivering a nucleic acid (or another biologic, such as an antibody) to a target environment (e.g., the heart, the nervous system, or a combination thereof) of a subject in need. In some embodiments, methods for delivering a nucleic acid (or another biologic, such as an antibody) to a target environment comprise delivering the nucleic acid (or another biologic, such as an antibody) to the heart, the nervous system, or a combination thereof. In some embodiments, methods for delivering a nucleic acid (or another biologic, such as an antibody) to a target environment comprise delivering the nucleic acid (or another biologic, such as an antibody) to neurons, astrocytes, cardiomyocytes, or a combination thereof. In some embodiments, methods for delivering a nucleic acid (or another biologic, such as an antibody) to a target environment comprise delivering the nucleic acid (or another biologic, such as an antibody) to a hematopoietic lineage, such as an immune cell. Methods of use of AAV vectors are described further in U.S. Pat. No.

9,585,971 and US 2017/0166926, which are incorporated by reference herein in their entireties.

In some embodiments, methods for delivering a nucleic acid to a target environment of a subject in need comprise providing a composition comprising an AAV as described herein, and administering the composition to the subject. In some embodiments, methods for delivering a nucleic acid to a target environment of a subject in need thereof comprise providing a composition comprising an AAV comprising (i) a capsid protein that comprises an amino acid sequence that comprises at least 4 contiguous amino acids of a sequence provided herein, and (ii) a nucleic acid (or another biologic, such as an antibody) to be delivered to the target environment of the subject, and administering the composition to the subject.

Methods provided herein, in some embodiments, are useful for treating a disorder or defect in a subject. In some embodiments, the methods as described herein comprise delivering a protein, RNA, or DNA to a target environment of the subject. In some embodiments, the methods as described herein comprise administering an adeno-associated virus (AAV) vector to a target environment of the subject. In some embodiments, the AAV vector comprises a nucleic acid molecule that encodes a therapeutic protein or therapeutic RNA effective in treating the disorder or defect. In some embodiments, the AAV vector comprises a capsid protein comprising at least 4 contiguous amino acids from a sequence listed in Table 4, 5, 6, 7, 8, 9, 10, 11, 12, 13, 14, 15, 16, 17, 18 or 19.

In some embodiments, the protein, RNA, or DNA can be a Ly6/uPAR protein or gene. In one embodiment, the Ly6/uPAR is LY6. In some embodiments, the LY6/uPAR is LY6A. In some embodiments, the LY6/uPAR is LY6C1. In some embodiments, the LY6/uPAR can be any protein that is suitable to be delivered to a target environment. In some embodiments, the LY6/uPAR receptor is a murine receptor. In some embodiments, the AAV targets the Ly6/uPAR protein. In some embodiments, the AAV targets any protein that are characterized as "Ly6-like" proteins.

In some embodiments, the protein, RNA, or DNA is delivered to the subject via intravenous administration or systemic administration. In some embodiments, the protein, RNA, or DNA is delivered in trans. In some embodiments, the protein, RNA, or DNA is delivered to the subject via a nanoparticle. In some embodiments, the RNA is delivered to the subject via a viral vector. In some embodiments, the RNA is delivered to the subject via any carriers suitable for delivering nucleic acid materials. In some embodiments, the protein is a purified protein. In some embodiments, the Ly6/uPAR gene is delivered to the subject via a viral vector.

In some embodiments, the protein or RNA is delivered prior to the administration of the AAV vector. The protein or RNA (e.g. Ly6a or Ly6c1), or an ectopic receptor can be expressed in the target environment transiently. In some embodiments, the AAV vector can be administered to the subjects 12 hours, 1 day, 2 days, 3 days, 4 days, 5 days, 6 days, 7 days, 8 days, 9 days, 10 days, inclusive of all ranges and subranges therebetween, after the protein or RNA is delivered to the target environment. In some embodiments, the AAV vector can then specifically interact with the ectopic receptor (e.g. Ly6a or Ly6c1) during the timeframe of expression of the delivered ectopic receptor. "Transiently," "transient expression," or "transient gene expression" as described herein refers to the temporary expression of proteins or genes that are expressed for a short time after a protein or a nucleic acid (e.g., plasmid DNA encoding an expression cassette), has been introduced into the target environment.

In some embodiments, the protein or RNA can be delivered to the target environment simultaneously with the AAV vector. In some embodiments, the protein or RNA can be delivered to the target environment with the AAV vector in any order or timeframe that is suitable for treating a disorder or defect in the subject as described herein. For example, the AAV vector can be administered a few minutes after the delivery of the protein or RNA.

Any nucleic acid may be delivered to a target environment of a subject according to methods described herein. In some embodiments, a nucleic acid to be delivered to a target environment of a subject comprises one or more sequences that would be of some use of benefit to the subject. In some embodiments, the nucleic acid is delivered to dorsal root ganglia, visceral organs, astrocytes, neurons, or a combination thereof of the subject.

In a non-limiting example, the nucleic acid or nucleic acid molecule to be delivered can comprise one or more of (a) a nucleic acid sequence encoding a trophic factor, a growth factor, or a soluble protein; (b) a cDNA that restores protein function to humans or animals harboring a genetic mutation (s) in that gene; (c) a cDNA that encodes a protein that can be used to control or alter the activity or state of a cell; (d) a cDNA that encodes a protein or a nucleic acid used for assessing the state of a cell; (e) a cDNA and/or associated guide RNA for performing genomic engineering; (f) a sequence for genome editing via homologous recombination; (g) a DNA sequence encoding a therapeutic RNA; (h) a shRNA or an artificial miRNA delivery system; and (i) a DNA sequence that influences the splicing of an endogenous gene.

Any subject in need may be administered a composition comprising an AAV according to methods described herein. In some embodiments, a subject in need or a subject having a disorder or defect is a subject suffering from or at a risk to develop one or more diseases. In some embodiments, the subject in need is a subject suffering from or at a risk to develop one or more of chronic pain, cardiac failure, cardiac arrhythmias, Friedreich's ataxia, Huntington's disease (HD), Alzheimer's disease (AD), Parkinson's disease (PD), Amyotrophic lateral sclerosis (ALS), spinal muscular atrophy types I and II (SMA I and II), Friedreich's Ataxia (FA), Spinocerebellar ataxia, lysosomal storage disorders that involve cells within the CNS.

Any suitable method may be used for administering a composition comprising an AAV described herein. In some embodiments, the composition comprising the AAV is administered to the subject via intravenous administration. In some embodiments, the composition comprising the AAV is administered to the subject via or systemic administration.

Pharmaceutical Compositions

Aspects of the present disclosure provide, in some embodiments, a pharmaceutical composition comprising an AAV vector as described herein and a pharmaceutically acceptable carrier. Suitable carriers may be readily selected by one of skill in the art in view of the indication for which the AAV vector is directed. For example, one suitable carrier includes saline, which may be formulated with a variety of buffering solutions (e.g., phosphate buffered saline). Other exemplary carriers include sterile saline, lactose, sucrose, calcium phosphate, gelatin, dextran, agar, pectin, peanut oil, sesame oil, and water. The selection of the carrier is not a limitation of the present disclosure. Pharmaceutical compositions comprising AAV vectors are described further in U.S.

Pat. No. 9,585,971 and US 2017/0166926, which are incorporated by reference herein in their entireties.

In some embodiments, the pharmaceutical composition comprising an AAV vector comprises other pharmaceutical ingredients, such as preservatives, or chemical stabilizers. Suitable exemplary preservatives include chlorobutanol, potassium sorbate, sorbic acid, sulfur dioxide, propyl gallate, the parabens, ethyl vanillin, glycerin, phenol, and parachlorophenol. Suitable chemical stabilizers include gelatin and albumin.

Methods described herein comprise administering AAV vector in sufficient amounts to transfect the cells of a desired tissue (e.g., heart, brain) and to provide sufficient levels of gene transfer and expression without undue adverse effects. Examples of pharmaceutically acceptable routes of administration include, but are not limited to, direct delivery to the selected organ, oral, inhalation, intraocular, intravenous, intramuscular, subcutaneous, intradermal, intratumoral, and other parental routes of administration. Routes of administration may be combined, if desired.

The dose of AAV required to achieve a particular "therapeutic effect," e.g., the units of dose in genome copies/per kilogram of body weight (GC/kg), will vary based on several factors including, but not limited to: the route of AAV administration, the level of gene or RNA expression required to achieve a therapeutic effect, the specific disease or disorder being treated, and the stability of the gene or RNA product. One of skill in the art can readily determine a AAV dose range to treat a patient having a particular disease or disorder based on the aforementioned factors, as well as other factors.

An effective amount of AAV vector is an amount sufficient to infect an animal or target a desired tissue. The effective amount will depend primarily on factors such as the species, age, weight, health of the subject, and the tissue to be targeted, and may thus vary among animal and tissue. For example, an effective amount of AAV is generally in the range of from about 1 ml to about 100 ml of solution containing from about $10^9$ to $10^{16}$ genome copies. In some cases, a dosage between about $10^{11}$ to $10^{13}$ AAV genome copies is appropriate. In some embodiments, an effective amount is produced by multiple doses of AAV.

In some embodiments, a dose of AAV is administered to a subject no more than once per calendar day (e.g., a 24-hour period). In some embodiments, a dose of AAV is administered to a subject no more than once per 2, 3, 4, 5, 6, or 7 calendar days. In some embodiments, a dose of AAV is administered to a subject no more than once per calendar week (e.g., 7 calendar days). In some embodiments, a dose of AAV is administered to a subject no more than bi-weekly (e.g., once in a two calendar week period). In some embodiments, a dose of AAV is administered to a subject no more than once per calendar month (e.g., once in 30 calendar days). In some embodiments, a dose of AAV is administered to a subject no more than once per six calendar months. In some embodiments, a dose of AAV is administered to a subject no more than once per calendar year (e.g., 365 days or 366 days in a leap year). In some embodiments, a dose of rAAV is administered to a subject no more than once per two calendar years (e.g., 730 days or 731 days in a leap year). In some embodiments, a dose of AAV is administered to a subject no more than once per three calendar years (e.g., 1095 days or 1096 days in a leap year).

Formulation of pharmaceutically-acceptable excipients and carrier solutions is well-known to those of skill in the art, as is the development of suitable dosing and treatment regimens for using the particular compositions described herein in a variety of treatment regimens. Typically, these formulations may contain at least about 0.1% of the active compound or more, although the percentage of the active ingredient(s) may, of course, be varied and may conveniently be between about 1 or 2% and about 70% or 80% or more of the weight or volume of the total formulation. Naturally, the amount of active compound in each therapeutically-useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

The pharmaceutical forms suitable for injectable use include sterile aqueous solutions or dispersions and sterile powders for the extemporaneous preparation of sterile injectable solutions or dispersions. Dispersions may also be prepared in glycerol, liquid polyethylene glycols, and mixtures thereof and in oils. Under ordinary conditions of storage and use, these preparations contain a preservative to prevent the growth of microorganisms. In many cases the form is sterile and fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

The AAV vector compositions disclosed herein may also be formulated in a neutral or salt form. Pharmaceutically-acceptable salts, include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug-release capsules, and the like.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Supplementary active ingredients can also be incorporated into the compositions. The phrase "pharmaceutically-acceptable"

refers to molecular entities and compositions that do not produce an allergic or similar untoward reaction when administered to a host.

Delivery vehicles such as liposomes, nanocapsules, microparticles, microspheres, lipid particles, vesicles, and the like, may be used for the introduction of the compositions of the present disclosure into suitable host cells. In particular, the AAV vector delivered transgenes may be formulated for delivery either encapsulated in a lipid particle, a liposome, a vesicle, a nanosphere, or a nanoparticle or the like.

Such formulations may be preferred for the introduction of pharmaceutically acceptable formulations of the nucleic acids or the AAV constructs disclosed herein. The formation and use of liposomes is generally known to those of skill in the art. Recently, liposomes were developed with improved serum stability and circulation half-times (U.S. Pat. No. 5,741,516). Further, various methods of liposome and liposome like preparations as potential drug carriers have been described (U.S. Pat. Nos. 5,567,434; 5,552,157; 5,565,213; 5,738,868 and 5,795,587).

Liposomes are formed from phospholipids that are dispersed in an aqueous medium and spontaneously form multilamellar concentric bilayer vesicles (also termed multilamellar vesicles (MLVs). MLVs generally have diameters of from 25 nm to 4 μm. Sonication of MLVs results in the formation of small unilamellar vesicles (SUVs) with diameters in the range of 200 to 500 Å, containing an aqueous solution in the core.

Alternatively, nanocapsule formulations of the AAV vector may be used. Nanocapsules can generally entrap substances in a stable and reproducible way. To avoid side effects due to intracellular polymeric overloading, such ultrafine particles (sized around 0.1 μm) should be designed using polymers able to be degraded in vivo. Biodegradable polyalkyl-cyanoacrylate nanoparticles that meet these requirements are contemplated for use.

EXAMPLES

The number of diseases that are potentially treatable by gene therapy is rapidly expanding. AAV vectors are proving to be safe, versatile vehicles for in vivo gene therapy applications (1-3). However, delivery challenges impede the application of gene therapy, particularly in the context of the brain, which is protected by the blood-brain barrier (BBB). To improve gene delivery across the central nervous system (CNS), AAV capsids have been engineered using in vivo selection and directed evolution (4-11). Previously engineered AAV9 variants include AAV-PHP.B (5) and its further evolved, more efficient variant, AAV-PHP.eB (4), that cross the adult BBB and enable efficient gene transfer to the mouse CNS. Since then, AAV-PHP.B and AAV-PHP.eB have been applied across a wide range of neuroscience experiments in mice (4, 12, 13), including genetic deficit correction (14, 15) and neurological disease modeling (16).

One critical question has been whether AAV-PHP.B and AAV-PHP.eB can facilitate efficient CNS gene transfer in other species. The enhanced CNS tropism of AAV-PHP.B and AAV-PHP.eB appears to extend to rats (17, 18), whereas studies testing AAV-PHP.B or related capsids in nonhuman primates (NHPs) have yielded differing outcomes (19-21). Surprisingly, the enhanced CNS tropism of AAV-PHP.B (5, 12, 15-18, 22, 23) was starkly absent in BALB/cJ mice (19). These findings indicate that the ability of AAV-PHP.B to cross the BBB is affected by genetic factors that vary by species and mouse line. Studies described herein leverage this strain-dependence to identify LY6A as the cellular receptor responsible for the enhanced CNS tropism exhibited by the AAV-PHP.B capsid family. It was demonstrated that the LY6A-mediated mechanism of transduction is independent of known AAV9 receptors and is a unique means for AAV-PHP.B capsids to cross the mouse BBB. This has widespread implications for guiding the selection of disease models in studies utilizing AAV-PHP.B capsids, as well as ongoing efforts to rationally engineer AAVs that cross the BBB in other species.

Example 1: Materials and Methods

Mouse Strain Permutation Analysis

Access to whole-genome sequencing data for 36 commercially available mouse lines made it possible to estimate the number of lines necessary to produce an adequately short list of candidate variants. Starting from the known permissive C57BL/6J non-permissive BALB/cJ strains, the Hail software library was used to simulate permissivity phenotypes among other mouse lines and compute the number of candidate variants in both the high and high-and-medium predicted functional impact classes. First, a permissivity frequency was sampled from a Beta(2, 2) distribution based on the two known mouse phenotypes. Second, one or more additional mouse lines were sampled from 26 commercially available lines (Table 1). Third, phenotypes for these mice were simulated using the generated permissivity frequency. Finally, the number of variants with perfect allelic segregation between simulated permissive and non-permissive lines was calculated and recorded. This simulation model ran for 500 iterations for 3 mice up to 12 mice, providing a distribution over the number of candidate variants at each mouse sample size, and enabling an informed decision about how many mouse lines to order and test in parallel.

TABLE 1

Permissive or nonpermissive AAV-PHP.eB CNS transduction phenotypes for inbred mouse lines with available whole genome sequencing (WGS) data. The lines highlighted in bolded text were used in the analysis presented in FIG. 2A.

| Strain | Enhanced CNS tropism | References |
|---|---|---|
| **AKR/J** | Present | This study |
| **BTBR/T+/Itpr3tf/J** | Present | Predicted |
| **C57BL/6J** | Present, previously reported | (2, 6-8) |
| **C57BL/6N** | Present, previously reported | (9) |
| **C57BL/10J** | Present | Predicted |
| **C57BR/cdJ** | Present | Predicted |
| **C57L/J** | Present | This study |
| C58/J | Present | Predicted |
| **DBA/1J** | Present | Predicted |
| **DBA/2J** | Present | This study |
| **FVB/NJ** | Present | This study |
| I/LnJ | Present | Predicted |
| KK/HiJ | Present | Predicted |
| **LP/J** | Present | This study |
| **NZW/LacJ** | Present | Predicted |
| RF/J | Present | Predicted |
| **MOLF/EiJ** | Present | This study |
| 129P2/OlaHsd | Present | Predicted |
| **129S1/SvImJ** | Present | Predicted |
| 129S5SvEvBrd | Present | Predicted |
| **A/J** | Absent | Predicted |
| **BALB/cJ** | Absent, previously reported | (10); this study |
| BUB/BnJ | Absent | Predicted |
| **CAST/EiJ** | Absent | This study |
| **CBA/J** | Absent | This study |
| C3H/HeH | Absent | Predicted |
| **C3H/HeJ** | Absent | Predicted |
| **LEWES/EiJ** | Absent | Predicted |

TABLE 1-continued

Permissive or nonpermissive AAV-PHP.eB CNS transduction phenotypes for inbred mouse lines with available whole genome sequencing (WGS) data. The lines highlighted in bolded text were used in the analysis presented in FIG. 2A.

| Strain | Enhanced CNS tropism | References |
|---|---|---|
| **NOD/ShiLtJ** | Absent | This study |
| **NZB/B1NJ** | Absent | This study |
| **NZO/HlLtJ** | Absent | Predicted |
| **PWK/PhJ** | Absent | This study |
| SEA/GnJ | Absent | Predicted |
| **SPRET/EiJ** | Absent | Predicted |
| SEA/GnJ | Absent | Predicted |
| ST/bJ | Absent | Predicted |
| **WSB/EiJ** | Absent | Predicted |
| ZALENDE/EiJ | Absent | Predicted |

Plasmids and Primers

The AAV-PHP.eB Rep-Cap trans plasmid was generated by gene synthesis (GenScript). AAV9, AAV-PHP.B, AAV-PHP.B2, and AAV-PHP.B3 were generated by replacing the AAV-PHP.eB variant region with that of AAV9, AAV-PHP.B, B2, or B3 using isothermal HiFi DNA Assembly (NEB). AAV-CAG-NLS-GFP and AAV-CAG-NLS-mScarlet vectors were synthesized using the N-terminal SV40 NLS sequence present in the Addgene plasmid #99130 as a gBlock (IDT) and GFP was subcloned in place of mScarlet to produce the NLS-GFP cassette. Ly6a and Ly6c1 (splice variant 1) cDNAs were synthesized as gBlocks (IDT). Reporter and Ly6 expression vectors were cloned into an AAV-CAG-WPRE-hGH pA backbone obtained from Addgene (#99122). The CMV-SaCAS9 vector (AAV-CMV::NLS-SaCas9-NLS-3xHA-bGHpA; U6::BsaI-sgRNA) was obtained from Dr. Feng Zhang through Addgene (#61591). sgRNAs specifically targeting Ly6a or Ly6c1 were cloned after the U6 promoter using a single bridge oligo for each reaction as recommended (HiFi DNA Asssembly, NEB). The Broad GPP sgRNA tool for SaCAS9 was used to identify suitable SaCAS9 target sites (1).

The following primers were used for Ly6a sgRNA cloning:

(SEQ ID NO: 1)
5'-CTTGTGGAAAGGACGAAACACCGAATTACCTGCCCCTACCCTGAGT
TTTAGTACTCTGGAAACAG (SEQ ID NO: 2)
5'-CTTGTGGAAAGGACGAAACACCGCTTTCAATATTAGGAGGGCAGGT
TTTAGTACTCTGGAAACAG (SEQ ID NO: 3)
5'-CTTGTGGAAAGGACGAAACACCGAATATTGAAAGTATGGAGATCGT
TTTAGTACTCTGGAAACAG

The following primers were used for Ly6c1 sgRNAs cloning:

(SEQ ID NO: 4)
5'-CTTGTGGAAAGGACGAAACACCGACTGCAGTGCTACGAGTGCTAGT
TTTAGTACTCTGGAAACAG (SEQ ID NO: 5)
5'-CTTGTGGAAAGGACGAAACACCGCAGTTACCTGCCGCGCCTCTGGT
TTTAGTACTCTGGAAACAG (SEQ ID NO: 6)
5'-CTTGTGGAAAGGACGAAACACCGGATTCTGCATTGCTCAAAACAGT
TTTAGTACTCTGGAAACAG qPCR primers used for biodistribution and in vitro binding:

GFP:
(SEQ ID NO: 7)
5'-TACCCCGACCACATGAAGCAG (SEQ ID NO: 8)
5'-CTTGTAGTTGCCGTCGTCCTTG

Mouse glucagon:
(SEQ ID NO: 9)
5'-AAGGGACCTTTACCAGTGATGTG (SEQ ID NO: 10)
5'-ACTTACTCTCGCCTTCCTCGG Human glucagon:
(SEQ ID NO: 11)
5'-ATGCTGAAGGGACCTTTACCAG (SEQ ID NO: 12)
5'-ACTTACTCTCGCCTTCCTCGG CHO glucagon:
(SEQ ID NO: 13)
5'-ATGCTGAAGGGACCTTTACCAG (SEQ ID NO: 14)
5'-CTCGCCTTCCTCTGCCTTT CRISPR/SaCas9 KO Experiments AAV-PHP.eB vectors with sgRNA sequences target Ly6a and Ly6c1 were generated and purified to knockout respective gene in C57BL/6 mouse primary brain microvascular endothelial cells (CellBiologics, Cat.# C57-6023). AAV vectors ($1\times10^6$ vg per cell) were used to transduce cells every 3 days for 3 times to achieve higher knockout efficiency. Cells were passaged as necessary.

Cell Lines and Primary Cultures

HEK293T/17 (CRL-11268), Pro5 (CRL-1781), Lec2 (CRL-1736), and Lec8 (CRL-1737) were obtained from ATCC. BMVEC cells were obtained from Cell Biologics (C57-6023) and cultured as directed by the manufacturer.

Virus Production and Purification

Recombinant AAVs were generated by triple transfection of HEK293T cells (ATCC CRL-11268) using polyethylenimine (PEI) and purified by ultracentrifugation over iodixanol gradients as previously described (2).

Western Blotting and Virus Overlay Assays

The virus overlay assay was performed as previously reported (3) with some modifications. Briefly, protein lysates were separated on Bolt 4-12% Bis-Tris Plus gels and transferred onto nitrocellulose membranes. After incubation with AAV9 or PHP.eB at 5e11 vg/ml, the membranes were fixed with 4% PFA at room temperature for 20 minutes to cross-link the interaction between capsid and its target protein followed by 2M HCl treatment at 37 °C for 7 minutes to expose the internal capsid epitope for detection. The blots were then rinsed and incubated with anti-AAV VP1/VP2/VP3 (1:20; American research products, Inc. cat#03-65158) followed by incubation with a horseradish peroxidase (HRP)-conjugated secondary antibody at 1:5000. The detection of binding was by SuperSignal West Femo Maximum Sensitivity Substrate under a Bio-Rad ChemiDoc TM MP system #1708280.

Animals

All procedures were performed as approved by the Broad Institute IACUC or Massachusetts General Hospital IACUC (AAVR experiments). AKR/J (000648), BALB/cJ (000651), CBA/J (000656), CAST/EiJ (000928), C57Bl/6J (000664), C57BL/J (000668), DBA/2J (000671), FVB/NJ (001800), LP/J (000676), MOLF/EiJ (000550), NOD/ShiLtJ (001976), NZB/B1NJ (000684), and PWK/PhJ (003715) were obtained from The Jackson Laboratory (JAX). AAVR mice were a generous gift from Dr. J.E. Carette (Stanford) to Dr. Balazs. Recombinant AAV vectors were administered intravenously via the retro-orbital sinus in young adult male or female mice. Mice were randomly assigned to groups based on predetermined sample sizes. No mice were excluded from the analyses. Experimenters were not blinded to sample groups.

Tissue Processing, Immunohistochemistry and Imaging

Mice were anesthetized with Euthasol (Broad) or ketamine (MGH) and transcardially perfused with phosphate buffered saline (PBS) at room temperature followed by 4% paraformaldehyde (PFA) in PBS. Tissues were post-fixed overnight in 4% PFA in PBS and sectioned by vibratome. IHC was performed on floating sections with antibodies diluted in PBS containing 10% donkey serum, 0.1% Triton X-100, and 0.05% sodium azide. Primary antibodies were incubated at room temperature overnight. The sections were then washed and stained with secondary (Alexa-conjugated antibodies, 1:1000) for 4 hours or overnight. Primary antibodies used were mouse anti-AAV capsid (1:20; American Research Products, 03-65158, clone B1), LY6A (1:250; BD Bioscience, 553333 or ThermoFisher, 701919), LY6C1 (1:250; Millipore-Sigmam MABN668), Glut1 (Millipore Sigma, 07-1401). To expose the internal B1 Capsid epitope in intact capsids, tissue sections or cells on coverslips were treated for 15 or 7 minutes, respectively, with 2M HCl at 37 °C. The treated samples were then washed extensively prior to addition of the primary antibody.

In Vivo Vector and Capsid Biodistribution 5- to 6-week-old C57Bl/6J mice, BALB/cJ mice AAVR WT or AAVR KO mice (FVB/NJ background) were injected intravenously with $10^{11}$ vg of AAV vector packaged into the indicated capsid. One or two hours after injection, the mice were perfused with PBS and tissues were collected and frozen at −80 °C. Samples were processed for AAV genome biodistribution analysis and normalized to the number of copies of mouse genomes using qPCR for the GFP element and mouse glucagon by qPCR as previously described (2). To visualize the capsid distribution, mice were perfused with 4% PFA after dosing with AAV vector and brain were section into 100 micrometer and labeled with indicated antibodies.

Microscopy

Images were taken on an Axio Imager.Z2 Basis Zeiss 880 laser scanning confocal microscope fitted with the following objectives: PApo 10×/0.45 M27, Plan-Apochromat 20×/0.8 M27, or Plan-APO 40×/1.4 oil DIC (UV) VIS-IR. All images compared within an experiment were acquired and processed under identical conditions.

In Vitro Binding Assays

Ly6 family members (0.5 μg/well) were transfected into HEK293T cells ($3\times10^5$/well) using PEI or into CHO cells ($1.5\times10^5$/well) with lipofectamine 3000 reagent (ThermoFisher, L3000001) in 24-well plates. 48 hours later, the cells were chilled to 4 °C and the media was exchanged with fresh cold media containing the indicated recombinant AAV ($10^5$ copies per cell). One hour later, cells were washed with cold PBS for 3 times, then fixed with 4% PFA for IHC or lysed for genomic DNA extraction and qPCR analyses.

For BMVECs, $2\times10^4$ cells/well were seeded in 12 well plate the day before exposure to virus. The assay was performed as above except AAV vectors were added at $10^6$ copies/cell.

HEK293T/17 cells were seeded at $2\times10^7$ per T75 flask 12-24 hours prior to being transfected with 20 μs of cDNA encoding eGFP, Ly6a, or Ly6c1. At 24-48 hours post transfection, the cells were incubated with an AAV9 K449R library (7-mer insertion between amino acids 588 and 589) at $10^{11}$ vg/T75 at 4 °C for 2 hours. Afterwards, the media was exchanged with PBS for 3 times in order to wash away unbound viruses. The viruses that remained bound to the cells were extracted with TRIzol (Invitrogen) or with whole genomic DNA isolation reagents (DNeasy, Qiagen) in order to isolate their viral genomes. The viral genomes were then prepared for next generation sequencing (NGS) to quantify the enrichment of peptides that conferred increased capsid ability to bind cells expressing the target protein.

Luciferase Transduction Assay

Figure 3A:
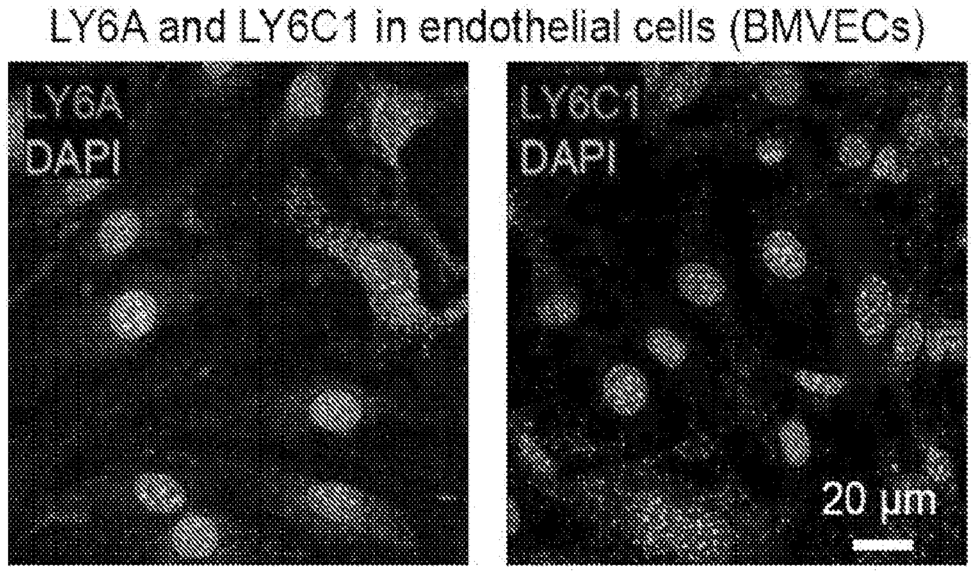
FIG. 3A shows images of LY6A (left) and LY6C1 (right) immunostaining with nuclei (dapi) in BMVECs.
Figure 3B:
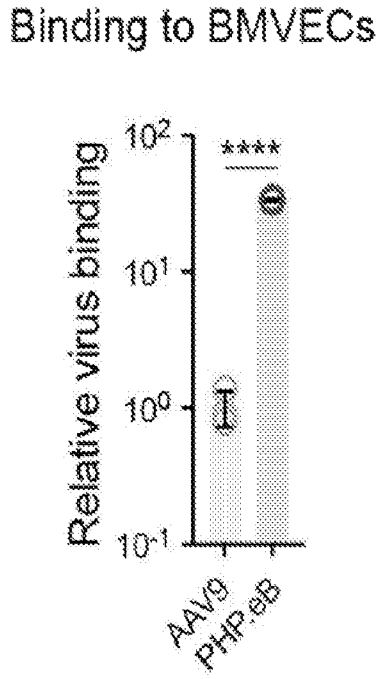
FIG. 3B shows a graph of AAV9 and AAV-PHP.eB binding of BMVECs. Binding was assessed by qPCR of the viral genome.
Figure 3C:
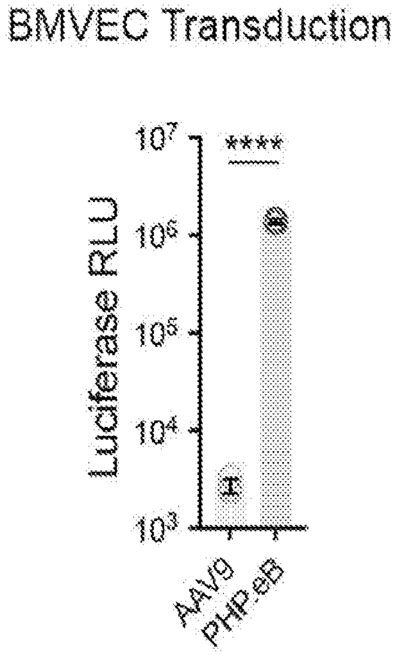
FIG. 3C shows a graph of AAV9 and AAV-PHP.eB transduction of BMVECs. Transduction was assessed by measuring Luciferase luminescence in relative light units (RLU).
Figure 3D:
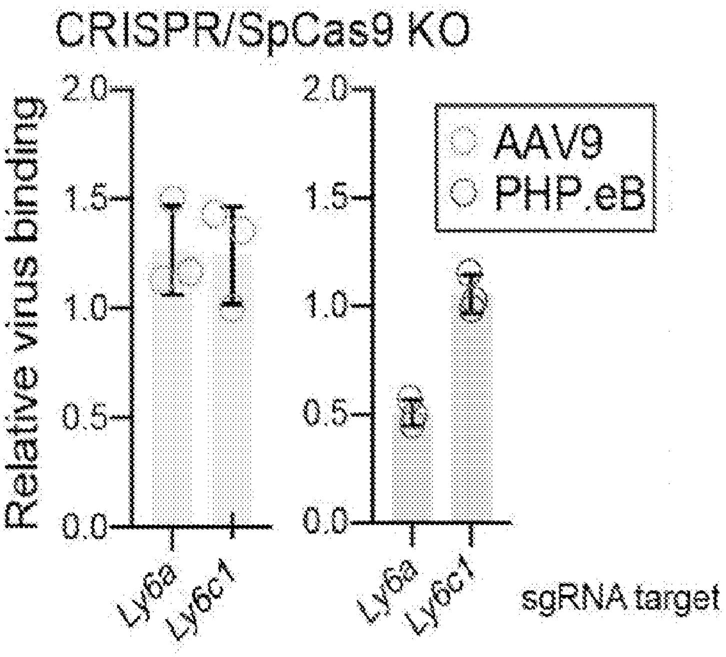
FIG. 3D shows a graph of binding (2-way ANOVA, Dunnett's multiple comparison test) by the indicated virus in cells treated with a vector containing an sgRNA to disrupt Ly6a or Ly6c1 or no sgRNA. Each data point represents cells that received a different sgRNA.
Figure 3E:
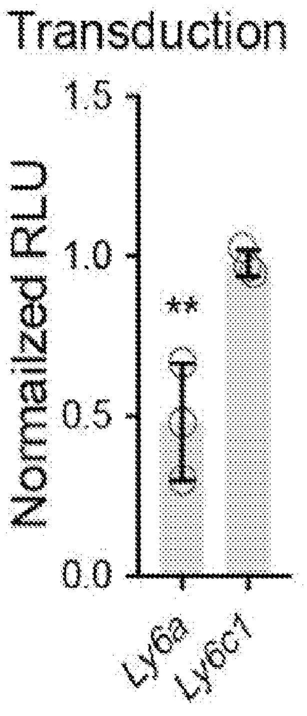
FIG. 3E shows a graph of transduction (1-way ANOVA, Sidak's post test) by the indicated virus in cells treated with a vector containing an sgRNA to disrupt Ly6a or Ly6c1 or no sgRNA. Each data point represents cells that received a different sgRNA.

Ly6 family members (0.1 μg/well) were transfected into the indicated cells (HEK293/17: $4\times10^5$/well; CHO: $2.5\times10^4$/well, BMVECs: $5\times10^3$/well) in 96-well plates (PerkinElmer, 6005680) in triplicate. 48 hours later, cells were transduced with AAV-CAG-GFP-2A-Luciferase-WPRE packaged into AAV9 or AAV-PHP.eB. Luciferase assays were performed with Britelite plus Reporter Gene Assay System (PerkinElmer, 6066766). Luciferase activity was reported as relative light units (RLU) as raw data or normalized to non-transfected control wells transduced with AAV9, or a control transduced without a sgRNA (FIG. 3E).

Statistical Analysis and Experimental Design

Figure 6:
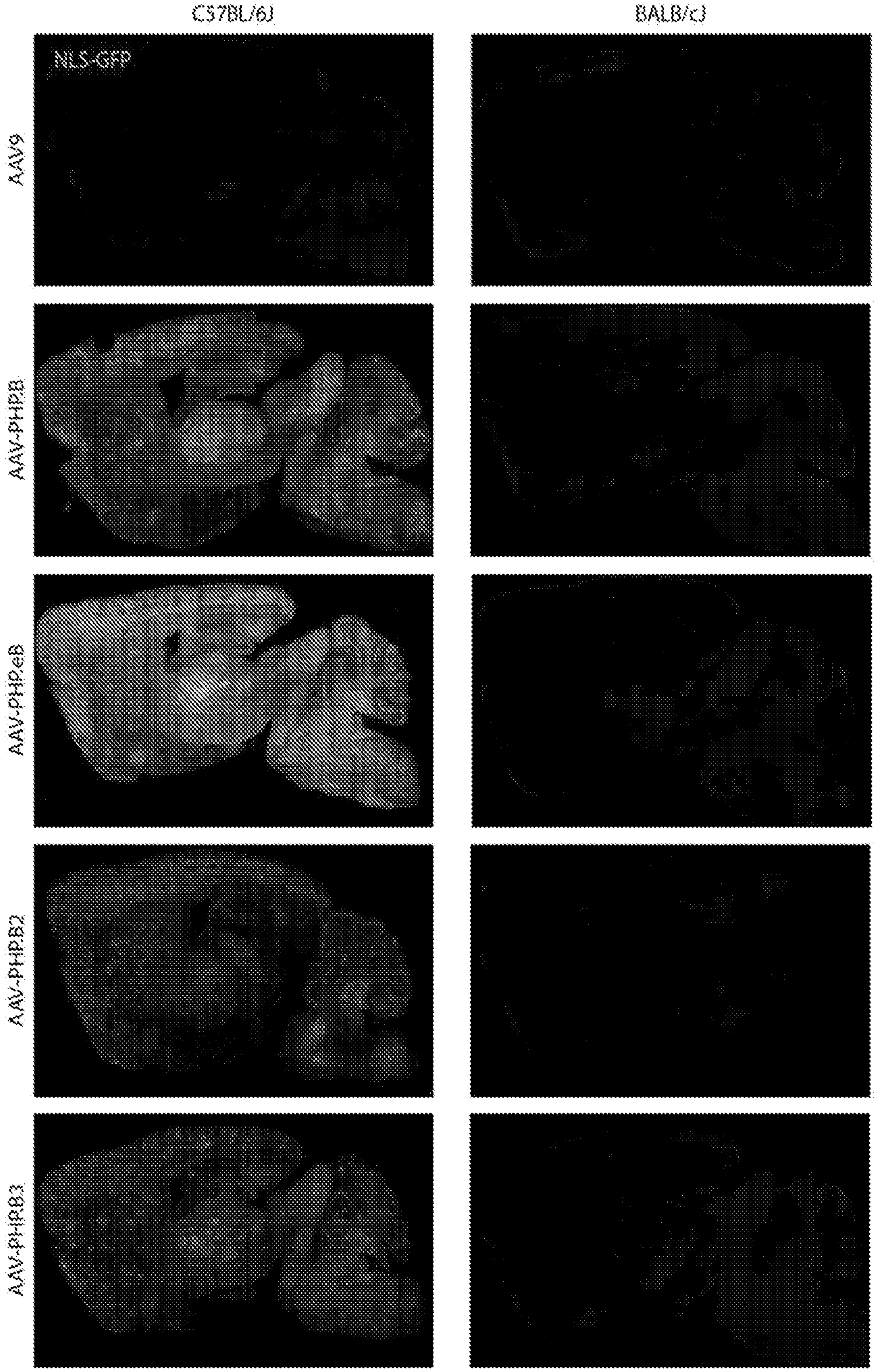
FIG. 6 shows images of GFP fluorescence in whole brain sagittal sections from C57BL/6J (left column) or BALB/cJ (right column) two weeks after intravenous injection of $1\times10^{11}$ vg/mouse AAV-CAG-NLS-GFP packaged into the indicated capsid.
Figure 8A:
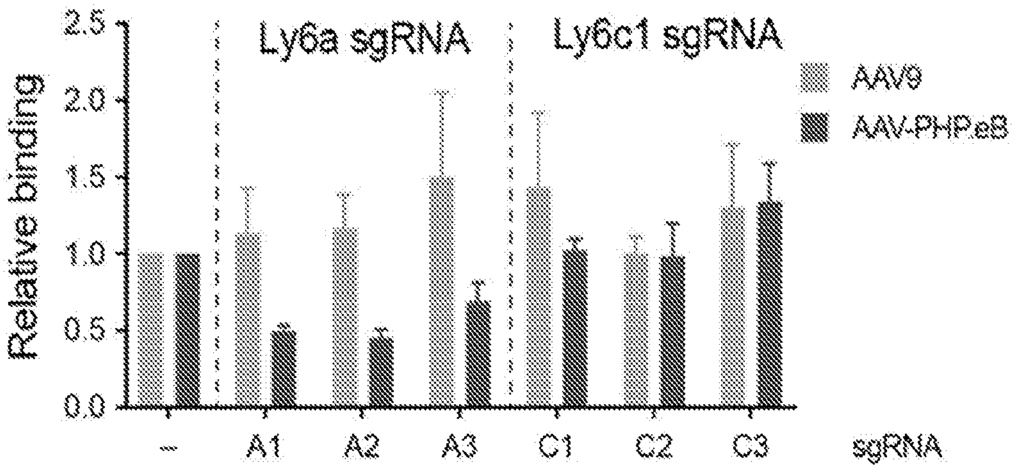
FIG. 8A shows a graph of individual sgRNA data used to generate FIG. 3D.
Figure 8B:
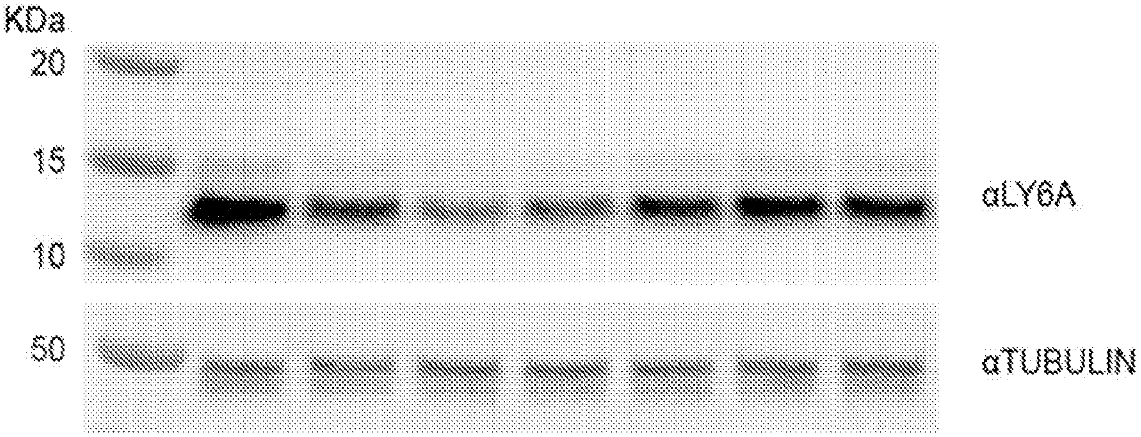
FIG. 8B shows western blots for LY6A (top) or TUBULIN (bottom) in lysates prepared from BMVECs treated with the individual sgRNAs shown in FIG. 7A.

Microsoft Excel and Prism 8 were used for data analysis. For the comparison between AAV9 and AAV-PHP.eB biodistribution, a group size of 6 per group (3 males and 3 females) was used based on prior data that indicated a large effect size (mean±SEM). No animals or samples were excluded from the analysis. FIG. 6 shows images representative of two animals per group. To evaluate AAV-PHP.eB in the 13 mouse lines, AAV9 (n=1, 1011 vg/animal) or AAV-PHP.eB (n=2; 1 per dose at $10^{11}$ and $10^{12}$ vg/animal). LY6A IHC in FIG. 6 are representative of 2 animals/line. In vitro transduction and binding experiments are means from three independent experiments. In FIGS. 3D and 3E, each data point represents a different sgRNA, each averaged from 3 independent experiments. Data were normalized to cells transduced with SpCas9 vectors without a sgRNA. FIGS. 8A-8B presents the same data as FIG. 3D separated by each individual sgRNA. Data from AAVR WT and KO mice are representative of 2 mice per genotype per time point post injection.

RNA Selection Plasmids:

To construct an adeno-associated virus (AAV) RNA expression system for the selection of functional AAV vectors and the recovery of AAV capsid transcripts, the ubiquitous promoter cytomegalovirus (CMV) was cloned into a recombinant AAV plasmid containing inverted terminal repeats from adeno-associated virus type 2 (AAV2). Downstream of the CMV promoter a synthetic intron containing a consensus donor motif (CAGGTAAGT), consensus splice motif (TTTTTTCTACAGGT) (SEQ ID NO: 30229) and branch point sequence was cloned. Downstream of the artificial intron, the AAV5 P41 promoter along with the 3' end of the AAV2 Rep gene, which includes the splice donor sequences for the capsid RNA was cloned. The capsid gene splice donor sequence in AAV2 Rep was modified from a non consensus donor sequence CAGGTACCA to a consensus donor sequence CAGGTAAGT. The wildtype adeno-associated virus serotype 9 (AAV9) capsid gene sequence was synthesized with nucleotide changes at S448 (TCA to TCT, silent mutation), K449R (AAG to AGA), and G594 (GGC to GGT, silent mutation) to introduce XbaI and AgeI restriction enzyme recognition sites for library fragment cloning. The AAV2 polyadenylation sequence was replaced with a simian virus 40 (SV40) late polyadenylation signal to terminate the capsid RNA transcript.

AAV Library Generation:

To assemble an oligonucleotide Library Synthesis Pool (oligo pool; Agilent) into an AAV genome, the oligo pool was amplified and extended using 10 ng of a DNA plasmid template containing a fragment of AAV9 and a forward primer Assembly-XbaI-F. Specifically, the reaction conditions were as follows: approximately 5 pM of the OLS pool, 0.5 μM of primer Assembly-XbaI-F for 5 cycles using Q5® High-Fidelity 2× Master Mix (NEB #M0492S) following the manufacturer's protocol. After the 5-cycle amplification and extension of the oligo pool, the reaction was spiked with 0.5 μM of primer Assembly_AgeI-R and amplified for an additional 25 cycles. The PCR product was then purified using Agencourt AMPure XP SPRI paramagnetic beads (Beckman Coulter #A63880) or column purified using a Zymo Research DNA Clean & Concentrator-5 kit (Zymo Research #D4013) following the manufacturer's protocol.

For generating 7-mer NNK libraries, the hand-mixed primer (Assembly-NNK-AAV9-588; IDT) encoding a 7mer peptide insertion between AA 588 and 589 of AAV9 was used as the reverse primer along with the Assembly-XbaI-F oligo as a forward primer in a PCR reaction using Q5® High-Fidelity 2× Master Mix (NEB #M0492S) following the manufacturer's protocol for 30 cycles with 10 ng plasmid containing AAV9 as the template. The oligo pool or 7-mer NNK PCR products were assembled into the RNA expression plasmid with previous described methods in Deverman et al. *Nature Biotechnology* 2016.

Virus Production and Purification:

Recombinant AAVs were generated and titered with previously described methods in Deverman et al. *Nature Biotechnology* 2016.

RNA Isolation:

To isolate total RNA containing AAV Cap transcripts, a RNeasy Mini Kit (Qiagen #74104), along with a QIAshredder kit (Qiagen #79654) and a RNase-Free DNase kit (Qiagen #79254) was used following the manufacturer's protocol. In some variations, TRIzol™ Reagent (Invitrogen™ #15596026) was used to isolate total RNA from homogenized tissue following the manufacturer's protocol prior to additional cleanup with the RNeasy Mini, QIAshredder and RNase-Free DNase kits listed above. Isolated RNA was resuspended in RNase free water and stored in −80 C conditions until conversion to cDNA.

RT Reaction:

RNA was reverse transcribed to cDNA using Maxima H Minus Reverse Transcriptase (Thermo Scientific™ #EP0752) following the manufacturer's protocol with an anchored oligo dT primer (IDT #51-01-15-08).

PCR Recovery of Library Sequences:

The cDNA was prepared for next-generation sequencing (NGS) with two rounds of polymerase chain reaction (PCR). In the first round of PCR (PCR1), a set of forward primers (Table 1) and reverse primers (Table 2) containing gene specific priming regions and a overhang sequence containing a portion of the Illumina Read 1 sequence (forward primers) or Illumina Read 2 sequence (reverse primers) were used to selectively amplify AAV genomes from the cDNA with Q5® High-Fidelity 2× Master Mix (NEB #M0492S), with 0.5 μM of each primer.

The forward and reverse primers contain zero or up to eight N nucleotides inserted in between the gene specific priming region and the partial Illumina Read 1 (forward primers) or Read 2 (reverse primers) overhang sequence. This is to introduce diversity into amplicon during NGS and to offset the constant region of the AAV genome to improve cluster diversity and to increase sequencing quality during Illumina NGS. The forward and reverse primers were paired to produce amplicons of the same size (i.e., SEQ1_F was paired with SEQ1_R, SEQ2_F was paired with SEQ2_R, etc.).

The number of cycles performed in PCR1 was chosen to stop before the exponential amplification phase and was determined with qPCR using FastStart Universal SYBR Green Master (Millipore Sigma #4913850001) or Q5® High-Fidelity 2× Master Mix (NEB #M0492S) with SYBR® Green I nucleic acid stain (VWR #12001-798) diluted from 10,000× to 8× per reaction. The qPCR primers used were SEQ9_F and SEQ1_R with 1 μL cDNA input.

Following PCR1, the amplified DNA was cleaned up using Agencourt AMPure XP SPRI paramagnetic beads (Beckman Coulter #A63880) or column purified using a Zymo Research DNA Clean & Concentrator-5 kit (Zymo Research #D4013) following the manufacturer's protocol. PCR1 samples were then barcoded for Illumina NGS with NEBNext Multiplex Oligos for Illumina Dual Index Primers Set 1 and 2 (NEB #E7600S and #E7780S) with 2 μL PCR1 input and amplified for 5 cycles to generate PCR2 products. The PCR2 products were again purified using Agencourt AMPure XP SPRI paramagnetic beads or column purified using a Zymo Research DNA Clean & Concentrator-5 kit (Zymo Research #D4013) following the manufacturer's protocol.

Preparation of Amplified Sequences for NGS:

The concentrations of purified PCR2 samples were determined using a Qubit™ dsDNA HS Assay Kit (Invitrogen™ #Q32854) then diluted and pooled according to the Illumina Nextseq System Denature and Dilute Libraries Guide or MiSeq System Denature and Dilute Libraries Guide along with 10-15% PhiX Control v3 (Illumina #FC-110-3001) spiked in. The pooled samples were quantified and checked for correct sizes using an Agilent High Sensitivity DNA Kit (Agilent #5067-4626) on an Agilent 2100 Electrophoresis Bioanalyzer.

Then samples were either sequenced on an Illumina NextSeq or Miseq machine using a NextSeq 500/550 High Output Kit v2.5 (150 Cycles) (Illumina #20024907), NextSeq 500/550 Mid Output Kit v2.5 (150 Cycles) (Illumina #20024904) or MiSeq Reagent Kit v3 (150-cycle) #MS-102-3001) with the indexes read from both ends after 150 read cycles.

NGS Analysis:

Following NGS, sequences were aligned to an AAV9 template with 21 N nucleotides insertion between amino acid 588 and 589 to represent the 7mer insertion using Bowtie 2. Further post processing was performed using SAMtools, Python 3, NumPy and Pandas. Briefly, the flanking regions up to the 7mer (prefix) and after the 7mer (suffix) region were clipped. The resulting sequence was checked to be 21 bp in length. The nucleotide sequences were converted to amino acid sequences and exported using Pandas. Read counts associated with each nucleotide sequence were converted to normalized read counts (reads per million) to adjust for sequencing depth differences between samples. Enrichment scores for each sequence are calculated by log 2 (normalized read count post screening/normalized read count in the initial virus library). Primersequences are listed below.

| PCR ROUND 1 FORWARD PRIMERS | SEQUENCES | SEQ ID NO: |
|---|---|---|
| SEQ1_F | CTTTCCCTACACGACGCTCTTCCGATCTNNNNNNNNCCAACGAAGAAGAAATTAAAAC TACTAACCCG | 30229 |
| SEQ2_F | CTTTCCCTACACGACGCTCTTCCGATCTNNNNNNNCCAACGAAGAAGAAATTAAAACT ACTAACCCG | 30230 |
| SEQ3_F | CTTTCCCTACACGACGCTCTTCCGATCTNNNNNNCCAACGAAGAAGAAATTAAAACTA CTAACCCG | 30231 |
| SEQ4_F | CTTTCCCTACACGACGCTCTTCCGATCTNNNNNCCAACGAAGAAGAAATTAAAACTAC TAACCCG | 30232 |
| SEQ5_F | CTTTCCCTACACGACGCTCTTCCGATCTNNNNCCAACGAAGAAGAAATTAAAACTACT AACCCG | 30233 |
| SEQ6_F | CTTTCCCTACACGACGCTCTTCCGATCTNNNCCAACGAAGAAGAAATTAAAACTACTA ACCCG | 30234 |
| SEQ7_F | CTTTCCCTACACGACGCTCTTCCGATCTNNCCAACGAAGAAGAAATTAAAACTACTAA CCCG | 30235 |
| SEQ8_F | CTTTCCCTACACGACGCTCTTCCGATCTNCCAACGAAGAAGAAATTAAAACTACTAAC CCG | 30236 |
| SEQ9 F | CTTTCCCTACACGACGCTCTTCCGATCTCCAACGAAGAAGAAATTAAAACTACTAACC CG | 30237 |

| PCR ROUND 1 REVERSE PRIMERS | SEQUENCES | SEQ ID NO: |
|---|---|---|
| SEQ1_R | GGAGTTCAGACGTGTGCTCTTCCGATCTCATCTCTGTCCTGCCAAACCATACC | 30238 |
| SEQ2_R | GGAGTTCAGACGTGTGCTCTTCCGATCTNCATCTCTGTCCTGCCAAACCATACC | 30239 |
| SEQ3_R | GGAGTTCAGACGTGTGCTCTTCCGATCTNNCATCTCTGTCCTGCCAAACCATACC | 30240 |
| SEQ4_R | GGAGTTCAGACGTGTGCTCTTCCGATCTNNNCATCTCTGTCCTGCCAAACCATACC | 30241 |
| SEQ5_R | GGAGTTCAGACGTGTGCTCTTCCGATCTNNNNCATCTCTGTCCTGCCAAACCATACC | 30242 |
| SEQ6_R | GGAGTTCAGACGTGTGCTCTTCCGATCTNNNNNCATCTCTGTCCTGCCAAACCATAC C | 30243 |
| SEQ7_R | GGACTTCAGACGTGTGCTCTTCCGATCTNNNNNNCATCTCTGTCCTGCCAAACCATA CC | 30244 |
| SEQ8_R | GGAGTTCAGACGTGTGCTCTTCCGATCTNNNNNNNCATCTCTGTCCTGCCAAACCAT ACC | 30245 |
| SEQ9_R | GGACTTCAGACGTGTCCTCTTCCGATCTNNNNNNNNCATCTCTGTCCTGCCAAACCA TACC | 30246 |

Assembly Primers

| ASSEMBLY PRIMER | SEQUENCES | SEQ ID NO: |
|---|---|---|
| Assembly-XbaI-F | CACTCATCGACCAATACTTGTACTATCTCT | 30247 |
| Assembly_AgeI-R | GTATTCCTTGGTTTTGAACCCAACCG | 30248 |
| Assembly-NNK-AAV9-588 | GTATTCCTTGGTTTTGAACCCAACCGGTCTgcgcctgtgc(M:50500000)(N:2525 2525)(N)(M)(N)(N)(M)(N)(N)(M)(N)(N)(M)(N)(N) M)(N)(N)(M)(N) (N)TTGGGCACTCTGGTGGTTTGTG | 30249 |

Ly6-Fc Fusion Protein Production

The coding regions including the signal peptide and mature protein sequences were amplified with the primers below and inserted into pCMV6-XL4 FLAG-NGRN-Fc (Addgene #115773) with EcoRV and XbaI sites.

| Protein | Sequence | SEQ ID NO: |
|---|---|---|
| Ly6A | GAGCTCGTTTAGTGAACCGTCAGATATCGCCACCATGGACACTTC | 30250 |
| | CAGGCCCCTGGAAGAGCACCTCTAGACCGCCTCCATTGGGAAC | 30251 |
| Ly6C | GAGCTCGTTTAGTGAACCGTCAGATATCGCCACCATGGACACTTC | 30252 |
| | AGGCCCCTGGAAGAGCACCTCTAGACCACCTGCAGTGGGAACTGC | 30253 |
| hCD59 | GCTCGTTTAGTGAACCGTCAGATATCGCCACCATGGGAATCCAAG | 30254 |
| | CCTGGAAGAGCACCTCTAGACCATTTTCAAGCTGTTCGTTAAAGTTACAC | 30255 |
| hLy6E | GTTTAGTGAACCGTCAGATATCGCCACCATGAAGATCTTCTTGCC | 30256 |
| | GGCCCCTGGAAGAGCACCTCTAGACCACTGAAATTGCACAGAAAGCTCTG | 30257 |

Expression and Purification of Fc-Tagged Protein in HEK293-FT Cells 26 million HEK293-FT cells were seated per 150 mm plate the day before transfection. The next day, complete media was changed to Pro293™a-CDM™ media with two brief rinses with Pro293™a-CDM™ media to remove serum. Cells were transduced with PEI and 40 ug DNA per plate a few hours after media change. The media was replaced 18 hours after transfection. At the second day post-transfection, cell supernatants containing secreted recombinant protein were passed through a 0.45-mm pore size filter and purified on Protein A-Sepharose. 200 ul Protein A-Sepharose were incubated with 100 ml cell culture supernatant overnight at 4 C with shaking. The next day, the beads were collected and washed 3 times with 10 ml of PBS, and the proteins were eluted in 200 ul of 100 mM glycine (pH2.7). Then 1/10 volume of 1M Tris (pH8.8) was added to the eluted protein fractions to neutralize the pH.

Virus Pull Down with Purified Fc-Tagged Protein 0.5 or 1 ug of purified recombinant Fc fusion proteins or Fc control protein was incubated with 10 ul magnetic Protein A beads for 4 hrs at 4 C with rotation in PBS with 0.05% Tween-20. Supernatant was removed and 1E10 vg of an AAV9 K449R 7-mer virus library in PBS was added into beads pellet and incubated overnight. The next day, after three washes, bound virus were released with Proteinase K treatment and the viral DNA genomes were purified with Agencourt AMPure XP. The viral genomes were then amplified by PCR and processed and indexed for NGS.

Example 2: Ly6 Genetic Variants Associate with the CNS Tropism of AAV-PHP.eB

Figure 1B:
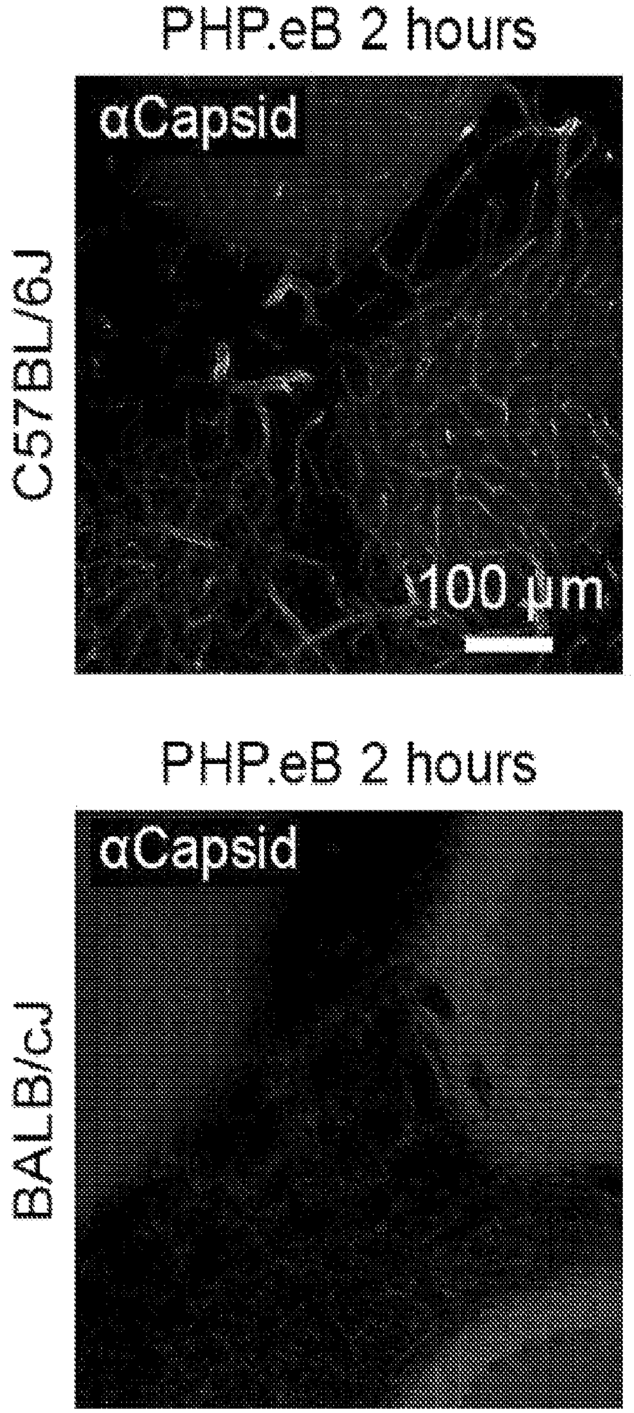
FIG. 1B shows images of AAV capsid IHC within the cerebellum one hour after intravenous injection of AAV-PHP.eB.
Figure 1C:
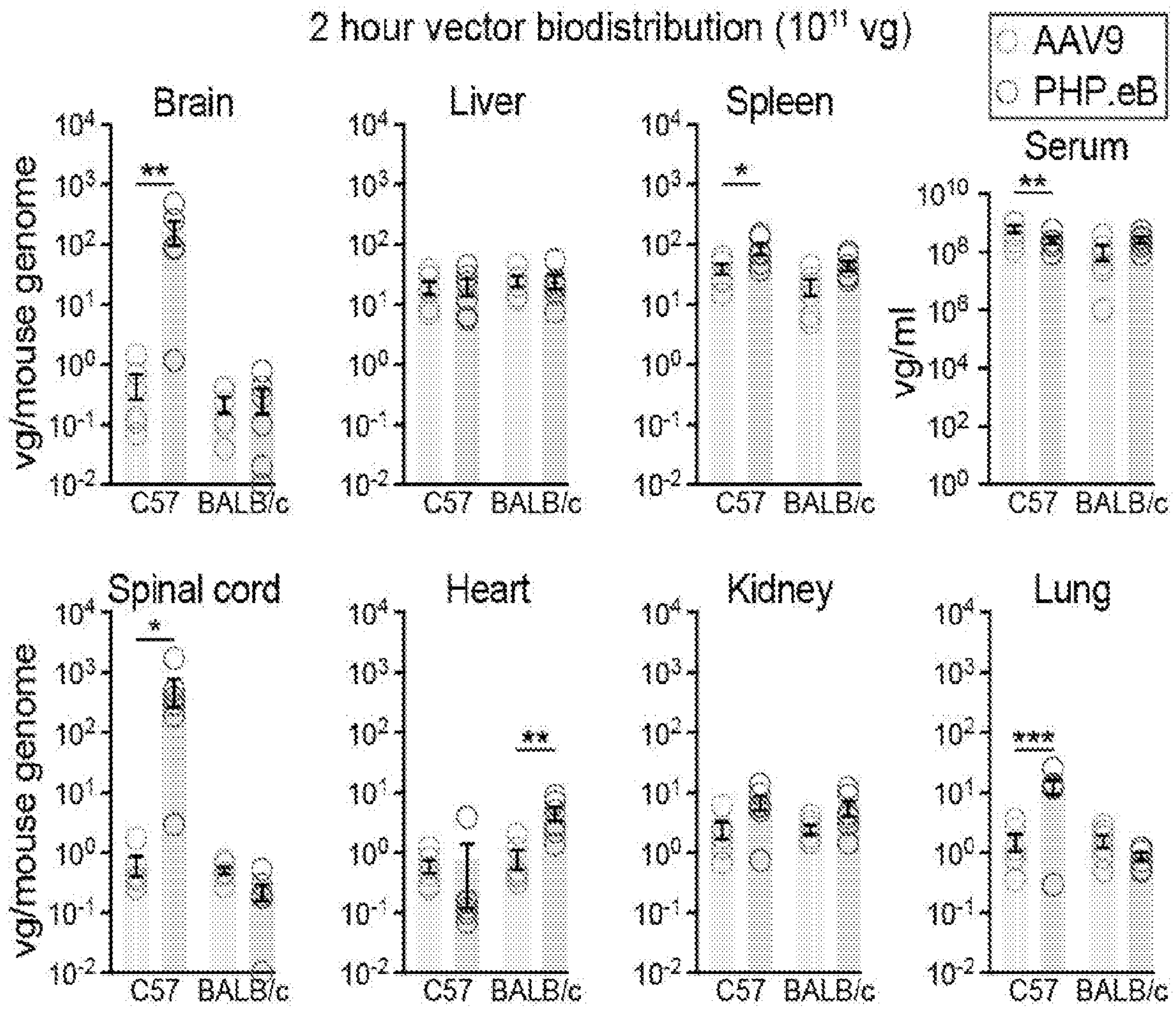
FIG. 1C shows graphs of vector genome (vg) biodistribution of AAV-PHP.eB or AAV9 two hours after intravascular administration to C57BL/6J or BALB/cJ mice (n=6/virus/line, mean±s.e.m.; 2-way ANOVA; *p<0.05, p<0.01, *p<0.001).
Figure 1D:
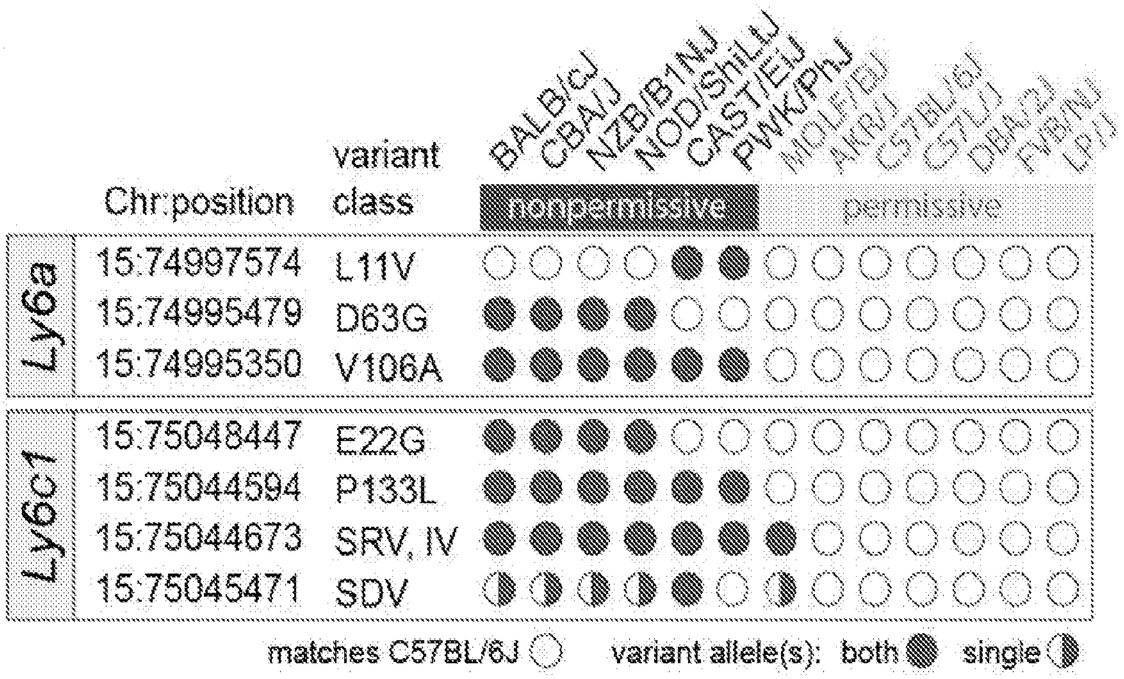
FIG. 1D shows data of Ly6a and Ly6c1 SNPs correlated with the nonpermissive phenotype. Missense SNPs relative to C57BL/6J are listed as the amino acid change. SRV, splice region variant; IV, intron variant; SDV, splice donor variant.

The dramatic difference in the CNS tropism of AAV-PHP.B in C57BL/6J versus BALB/cJ mice (19) extends to AAV-PHP.eB (FIG. 1A) and is consistent with reduced AAV-PHP.eB association with the endothelium (FIG. 1B), which partially constitutes the BBB. The increased accumulation of AAV-PHP.eB relative to AAV9 in the brain and spinal cord of C57BL/6J mice is absent in BALB/cJ mice (FIG. 1C). Two AAV-PHP.B capsids, AAV-PHP.B2 and AAV-PHP.B3 (5), were similarly unable to transduce the BALB/cJ CNS (FIG. 6).

These results prompted a search for candidate genes associated with enhanced AAV-PHP.B CNS transduction. Studies were aimed to test the AAV-PHP.B capsids across a panel of mouse lines, and harness the natural genetic variation between mice to identify the genetic variants and, subsequently, candidate gene(s) responsible for the difference in CNS transduction by AAV-PHP.eB. Using the open-source software Hail (24), a genome-wide database of variants across 36 mouse lines (25) was analyzed. Starting from millions of genetic variants, comprised of single-nucleotide polymorphisms (SNPs) as well as insertions and deletions (indels), the analysis was narrowed to variants predicted to affect expression, splicing, or protein coding regions (Table 2). As in a genetic linkage study, the aim was to rapidly identify variants whose alleles segregate across mice with the observed phenotype (permissive or non-permissive). Using a statistical simulation framework, it was estimated that 12 mouse lines would be sufficient to narrow our search to ~10 high/medium impact variants (FIG. 9, Table 2) that could feasibly be experimentally interrogated for the enhanced AAV-PHP.eB CNS tropism.

TABLE 2

The types of genetic variants included in the linkage study. The variant types, their count among all 36 mouse strains in the in the mouse genome project (4, 5) database, and their predicted impact is shown. Analysis was restricted to variant types with high or medium likelihood of impacting gene expression or coding sequence.

| Abbreviation | Variant type | Count | Impact |
|---|---|---|---|
| INT | Intron variant | 38745814 | Low |
| DWNGV | Downstream gene variant | 9820625 | Low |
| UPGV | Upstream gene variant | 9709435 | Low |
| NTV | Noncoding transcript variant | 5864559 | Low |
| NTEV | Noncoding transcript exon variant | 1041185 | Low |
| 3UTR | 3' Prime UTR variant | 823815 | Low |
| SYN | Synonymous variant | 344244 | Low |
| MS | Missense variant | 216611 | Medium |
| 5UTR | 5' UTR variant | 128375 | Low |
| NMD | NMD transcript variant | 123148 | Low |
| SRV | Splice region variant | 80431 | Medium |
| INFD | Inframe deletion | 3502 | Medium |
| FST | Frameshift variant | 2711 | High |
| SDV | Splice donor variant | 2609 | HIgh |
| INFI | Inframe insertion | 2452 | Medium |
| SG | Stop gained | 2450 | HIgh |
| SAV | Splice acceptor variant | 1922 | High |
| MIR | Mature miRNA variant | 1220 | Low |
| STPRV | Stop retained variant | 370 | Low |
| STPL | Stop lost | 332 | High |
| SRTL | Start lost | 322 | Medium |
| CSV | Coding sequence variant | 193 | Low |
| PAV | Protein altering variant | 87 | Low |
| ITCV | Incomplete terminal codon variant | 75 | Low |
| STPRV | Start retained variant | 31 | Low |

Figure 9:
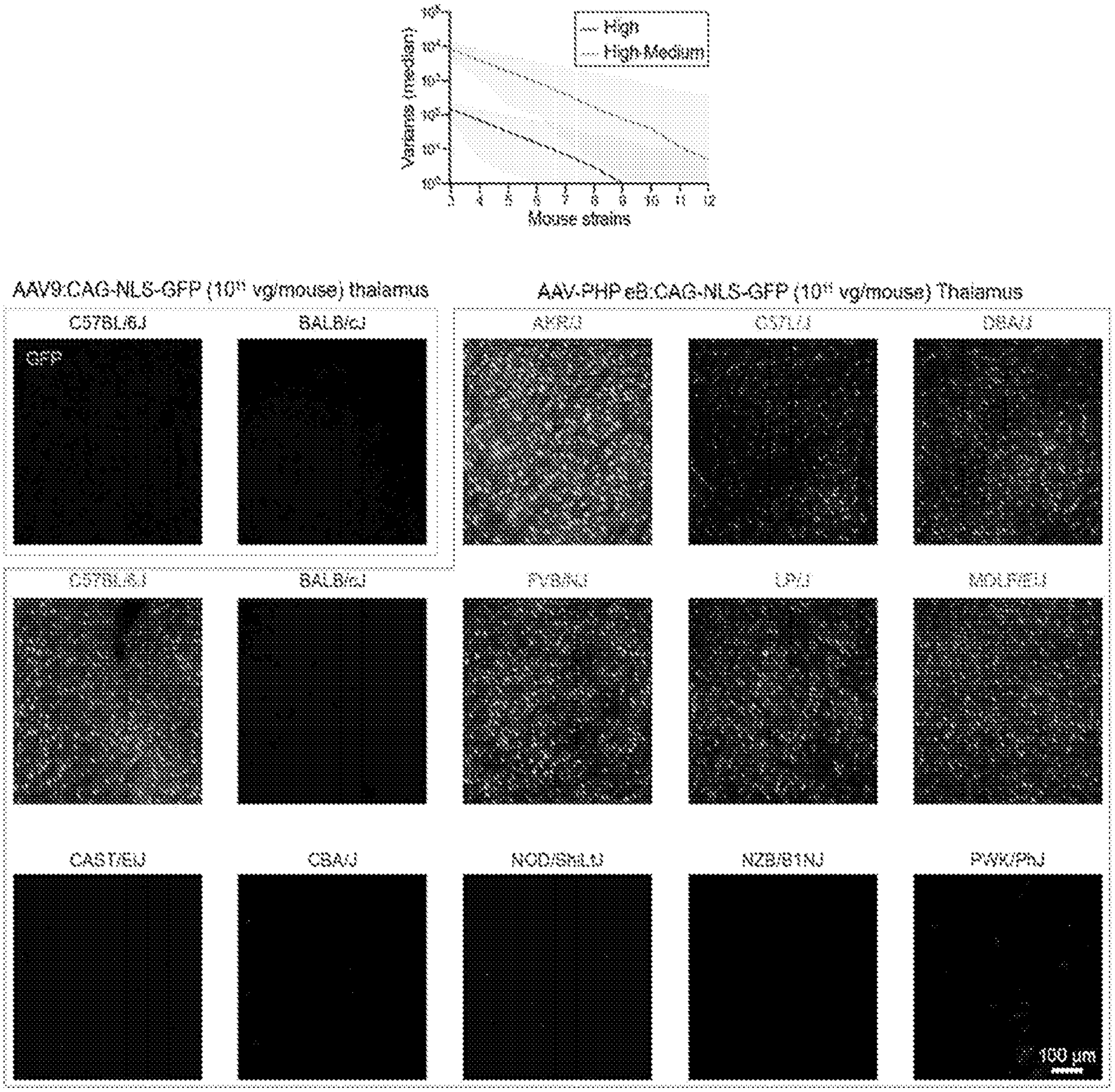
FIG. 9 shows the predicted number of mouse strains required to reduce the number of candidate gene variants associated with AAV-PHP.eB permissivity. The plotted lines depict the median number of simulated candidate variants; high (loss-of-function; blue) or high+medium (loss-of-function, missense, splicing variant; orange). Shaded regions represent 5-95$^{th}$ percentiles. Images show data of native GFP fluorescence in the mouse thalamus two weeks after intravenous injection of $1\times10^{11}$ vg/mouse CAG-NLS-GFP packaged into AAV9 (first two panels from top left) or AAV-PHP.eB.

Accordingly, mice from 13 commercially available lines were acquired, including C57BL/6J and BALB/cJ, and administered $10^{11}$ vector genomes (vg)/animal of AAV-PHP.eB, which packaged an AAV genome encoding an enhanced green fluorescent protein (GFP) with a nuclear localization signal (NLS-GFP). As observed with AAV-PHP.B, intravenous administration of AAV-PHP.eB resulted in GFP expression throughout the brain of permissive lines such as C57BL/6J, but not those of nonpermissive mice such as BALB/cJ; seven permissive and six nonpermissive lines were identified (FIG. 9).

Figure 1E:
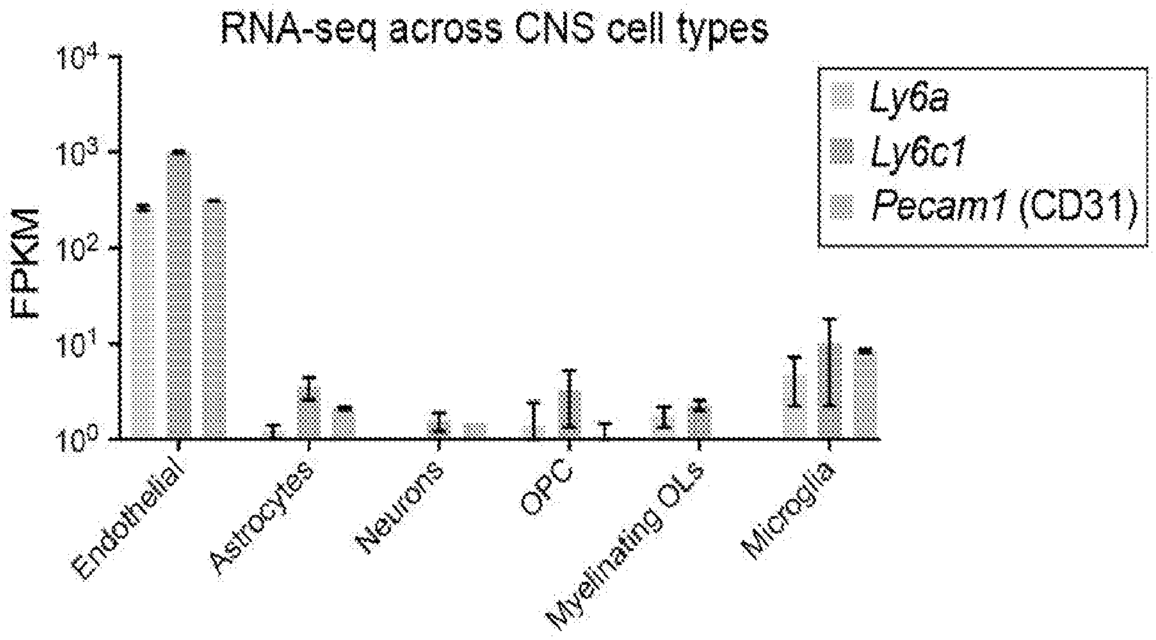
FIG. 1E shows expression data (mean fragments per kilobase-million±s.d.) for Ly6a, Ly6c1, and Pecam1 (Hail; available at github.com/hail-is/hail).

Hail analysis reduced the number of high or medium impact gene variants to missense SNPs in the related Ly6a and Ly6c1 genes (FIG. 1E). RNA sequencing data from sorted mouse brain cells (www.BrainRNAseq.org) (26) indicates that Ly6a and Ly6c1 are highly expressed in brain endothelial cells (FIG. 1F). Intriguingly, the mouse Ly6 locus has been linked to susceptibility to mouse adenovirus (MAV1) (27), which possesses a tropism for endothelial cells that causes fatal hemorrhagic encephalomyelitis in C57BL/6 but not BALB/cJ mice (28). The Ly6 gene family also influences susceptibility to infection by HIV1 (29, 30), Flaviviridae (yellow fever virus, dengue, and West Nile virus (31), Influenza A (32), and Marek's disease virus in chickens (33).

Figure 2A:
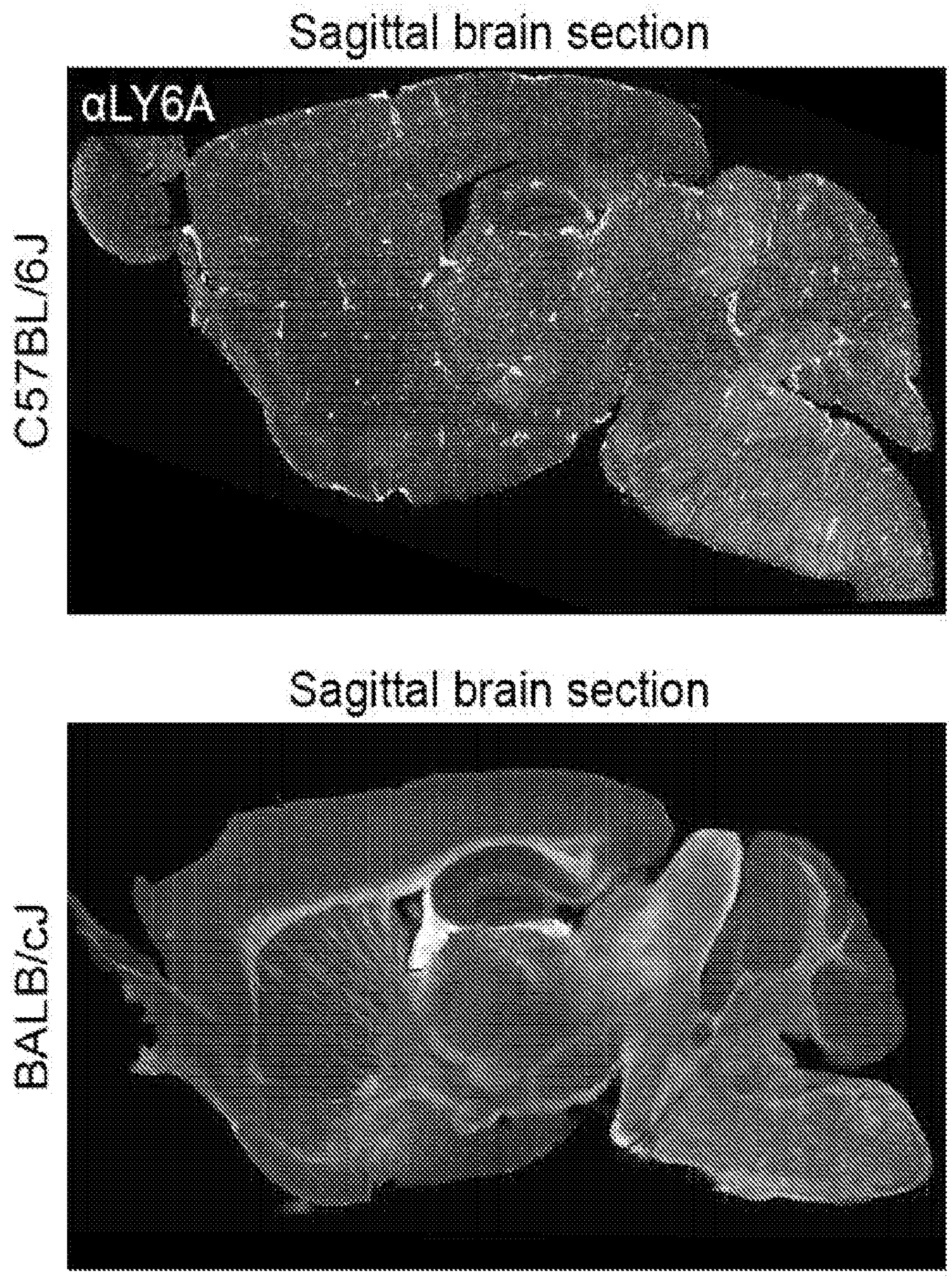
FIG. 2A shows images of LY6C$_1$ IHC in the cerebellum of C57BL/6J (top) or BALB/cJ (bottom) mice.
Figure 2B:
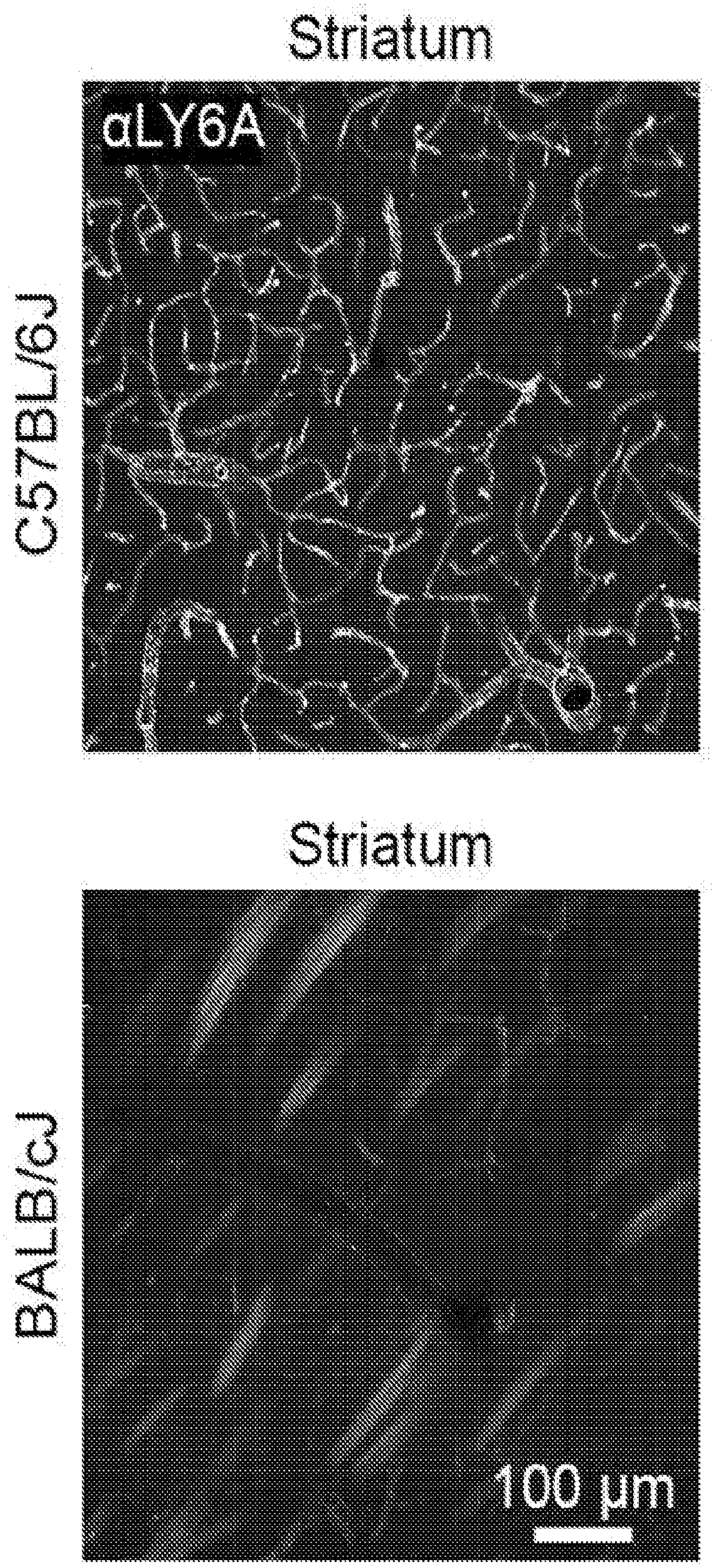
FIG. 2B shows images of LY6A IHC in the cerebellum of C57BL/6J (top) or BALB/cJ (bottom) mice.
Figure 7:
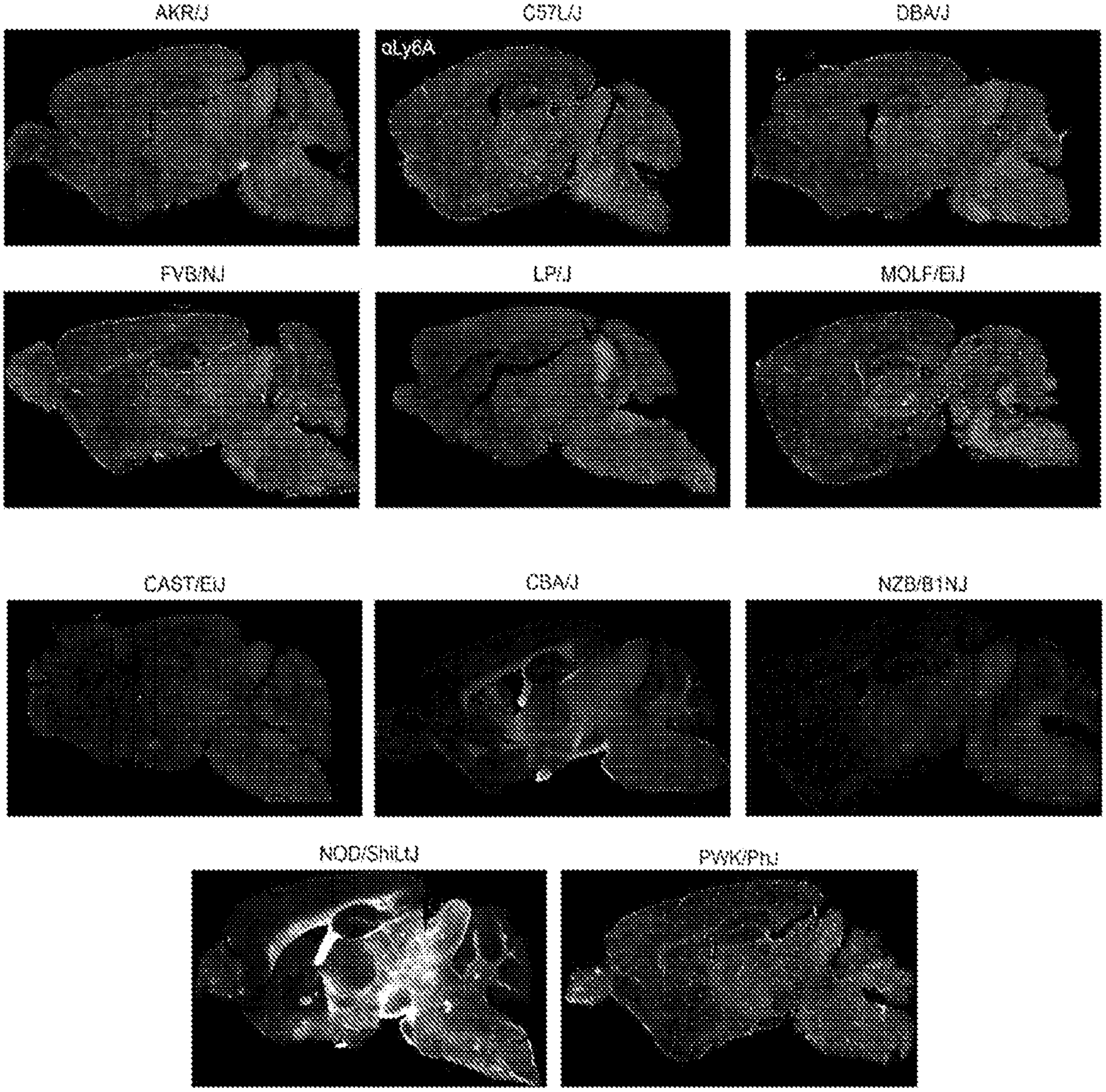
FIG. 7 shows sagittal whole brain images of LY6A IHC in several representative permissive and nonpermissive mouse lines.

Based on these findings, the possibility that genetic variation within Ly6a or Ly6c1 is associated with the differential AAV-PHP.eB tropism across mouse lines was analyzed. Immunohistochemistry (IHC) assays for LY6A and LY6C1 in C57BL/6J and BALB/cJ mice were performed to assess their expression and localization (FIG. 2B). LY6A was abundant within the CNS endothelium of C57Bl/6J mice but notably less abundant in BALB/cJ mice (FIGS. 2A-2B). The reduced LY6A on CNS vasculature correlated with the nonpermissive AAV-PHP.eB transduction phenotype across all of the tested mouse lines (FIG. 7). In contrast, Ly6c1 was expressed on the CNS endothelium of both lines (FIG. 2B). Western blotting demonstrated that LY6A is evident as multiple bands, but only the more slowly migrating band is detectable at low levels in BALB/cJ mice (FIG. 2D), suggesting that the maturation or post-translational processing differ between the two mouse lines. Interestingly, in a subset of the nonpermissive mouse lines, including BALB/cJ, LY6A immunostaining was localized to white matter tracts within the CNS (FIGS. 2A-2B). This myelin-associated immunostaining was observed with two commonly used LY6A monoclonal antibodies (D7 and E13 161-7) and has been previously reported (34, 35).

Taken together, these results suggest an association between Ly6a gene variants, the abundance of specific forms of LY6A within brain endothelial cells, and permissivity to transduction by AAV-PHP.eB.

Example 3: Ly6a is Necessary for the Enhanced CNS Transduction Phenotype of AAV-PHP.eB Whether LY6A and/or LY6C1 are necessary for the ability of AAV-PHP.eB to bind and transduce CNS endothelial cells was analyzed. To achieve this, Ly6a and Ly6c1 knockout experiments were performed in brain microvascular endothelial cells (BMVECs) from C57BL/6J mice, which express both genes and are more efficiently transduced by AAV-PHP.eB than by AAV9 (FIGS. 3A-3C). CRISPR/Sa-CAS9 (36) and Ly6a- or Ly6c1-specific sgRNAs were used to disrupt each gene. Because BMVECs are primary cells with limited expansion capabilities, assay were run on unselected cells, achieving a ~50% reduction of LY6A (FIG. 7). Nevertheless, using three different sgRNAs targeted to Ly6a, a consistent 50% reduction in binding by AAV-PHP.eB, but not AAV9 (FIG. 3D and FIGS. 8A-8B) was observed; a similar reduction in transduction by AAV-PHP.eB was observed (FIG. 3E). AAV9 transduction of BMVECs was inefficient and not included. None of the sgRNAs targeting Ly6c1 affected AAV-PHP.eB or AAV9 binding to the BMVECs (FIG. 3D). The reduction in AAV-PHP.eB binding resulting from Ly6a disruption in BMVECs, the high level of Ly6a expression within the CNS endothelium of permissive mouse lines, and the association of a V106A SNP in Ly6a with the nonpermissive phenotype, collectively suggest that LY6A functions as a receptor for AAV-PHP.eB.

Example 4: AAV-PHP.eB Directly Interacts with LY6A

Figure 3F:
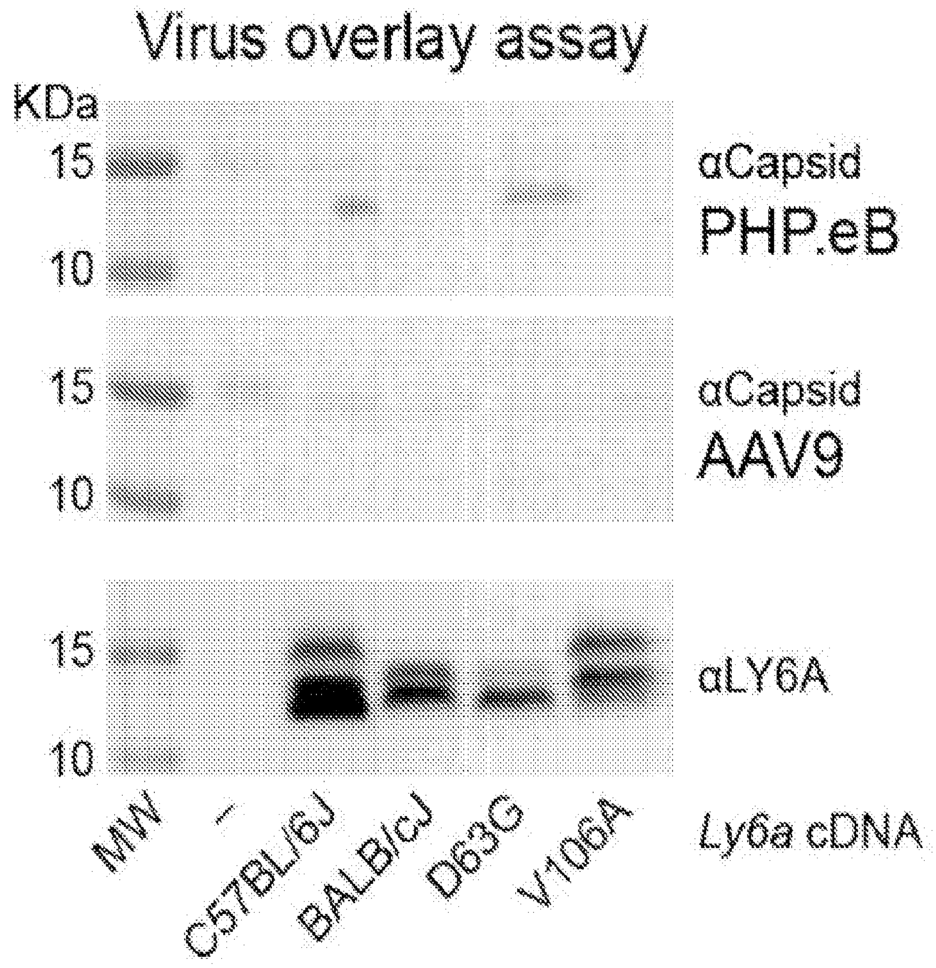
FIG. 3F shows a western blot from a virus overlay assay using lysates from HEK293T cells transfected with Ly6a cDNAs from C57BL/6J or containing one or both BALB/cJ SNPs. Panels show immunoblotting for AAV capsid proteins after overlaying with AAV-PHP.eB or AAV9. Bottom panel shows the same blot probed with αLY6A.

To determine whether AAV-PHP.eB directly binds LY6A and whether either of the missense SNPs in the BALB/cJ Ly6a gene (FIG. 1E) affect this interaction, virus overlay assays were performed (37). HEK293T cells were transfected with Ly6a cDNAs from C57BL/6J, BALB/cJ mice, or cDNAs harboring only one of the two missense SNPs (D63G or V106A). The virus overlay assays using these cell lysates revealed that AAV-PHP.eB binds a protein that co-migrates with LY6A (FIG. 3F) from cells transfected with the C57BL/6J or D63G Ly6a cDNAs, but not from cells expressing Ly6a from the BALB/cJ or V106A cDNAs. The V106A variant is located near the predicted cleavage and GPI anchoring site (w); the presence of an alanine at this position is predicted to reduce the likelihood of GPI-anchor modification (38) (Table 3).

TABLE 3

LY6A from C57Bl/6J but not BALB/cJ mice is predicted to be GPI anchored.

| Gene (strain) | co-site prediction | Specificity | Probability | Sequence | SEQ ID NO: |
|---|---|---|---|---|---|
| Ly6a (C57Bl/6J; DBA/J;AKR/J) | 110 | 100% | Highly Probable | MDTSHTTKSCLLILLVALLC AERAQGLECYQCYGVPFET SCPSITCPYPDGVCVTQEAA VIVDSQTRKVKNNLCLPICP PNIESMEILGTKVNVKTSCC QEDLCNVAVPNGGSTWTM AGVLLFSLSSVLLQTLL | 15 |
| Ly6a (CAST/EiJ; PWK/PhJ) | 110 | 0% | Not GPI-anchored | MDTSHTTKSCVLILLVALL CAERAQGLECYQCYGVPFE TSCPSITCPYPDGVCVTQEA AVIVDSQTRKVKNNLCLPIC PPNIESMEILGTKVNVKTSC CQEDLCNAAVPNGGSTWT MAGVLLFSLSSVLLQTLL | 16 |

TABLE 3-continued

| LY6A from C57Bl/6J but not BALB/cJ mice is predicted to be GPI anchored. | | | | | |
|---|---|---|---|---|---|
| Gene (strain) | co-site prediction | Specificity | Probability | Sequence | SEQ ID NO: |
| Ly6a (BALB/C; NOD/ShiLtJ) | 110 | 0% | Not GPI-anchored | MDTSHTTKSCLLILLVALLC AERAQGLECYQCYGVPFET SCPSITCPYPDGVCVTQEAA VIVGSQTRKVKNNLCLPICP PNIESMEILGTKVNVKTSCC QEDLCNAAVPNGGSTWTM AGVLLFSLSSVLLQTLL | 17 |
| Ly6c1 (C57Bl/6J) | 102 | 100% | Highly Probable | MDTSHTTKSCVLILLVALL CAERAQGLQCYECYGVPIE TSCPAVTCRASDGFCIAQNI ELIEDSQRRKLKTRQCLSFC PAGVPIRDPNIRERTSCCSE DLCNAAVPTAGSTWTMAG VLLFSLSSVVLQTLL | 18 |
| Ly6e | 107 | 100% | Highly Probable | MSATSNMRVFLPVLLAALL GMEQVHSLMCFSCTDQKN NINCLWPVSCQEKDHYCIT LSAAAGFGNVNLGYTLNK GCSPICPSENVNLNLGVASV NSYCCQSSFCNFSAAGLGL RASIPLLGLGLLLSLLALLQ LSP | 19 |

Example 5: Ly6a Expression Enhances Transduction by AAV-PHP.eB

Figure 3G:
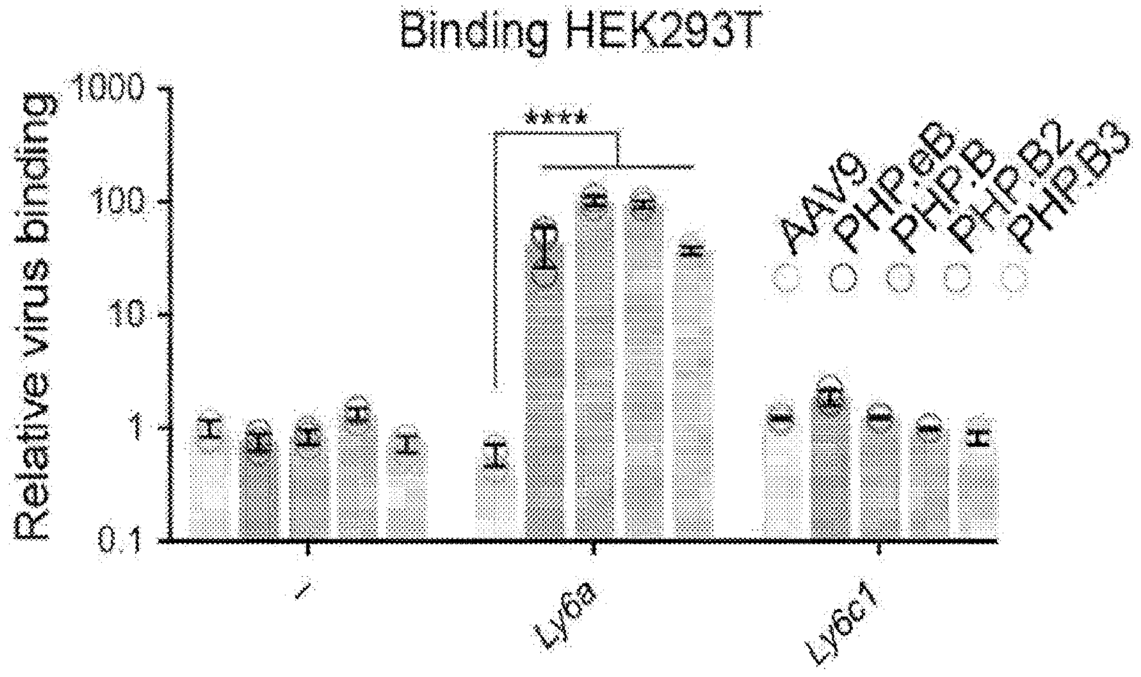
FIG. 3G shows a graph of binding of the indicated virus to HEK293T cells transfected with Ly6a. Ly6c1, or mock (−) (n=3/sgRNAs with 3 sgRNAs per gene, p<0.01, **p<0.0001; 2-way ANOVA, Tukey correction).
Figure 3H:
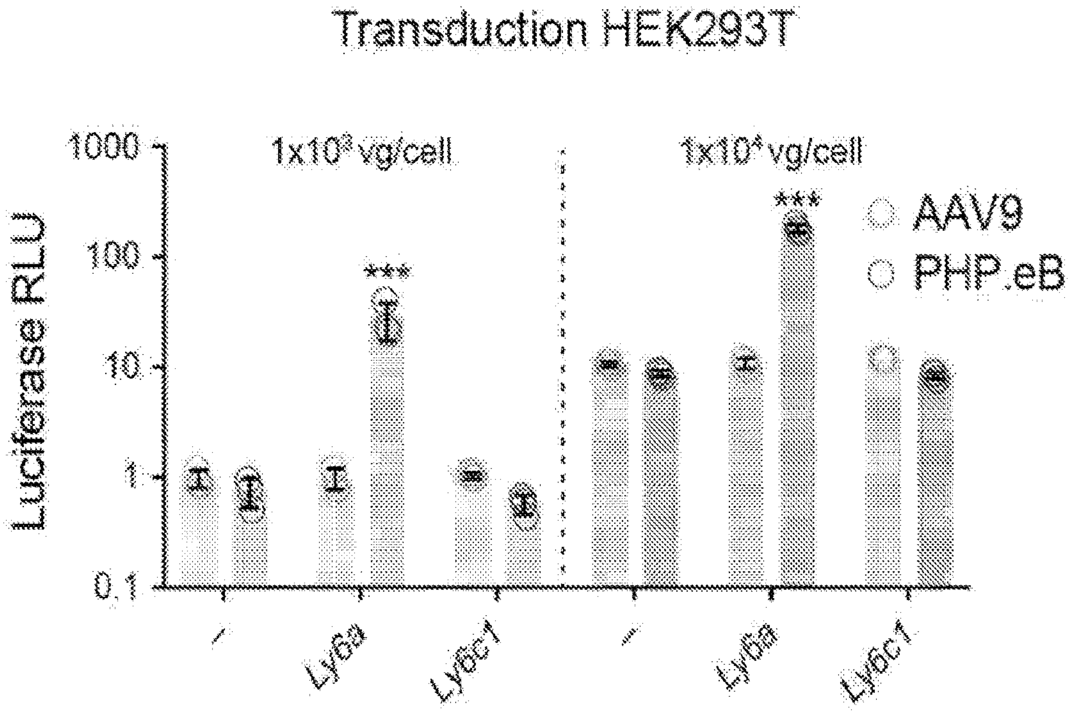
FIG. 3H shows a graph of transduction measured by Luciferase assay normalized to AAV9 on mock transfected cells (n=3, ***p<0.001, 3-way anova, Tukey correction).
Figure 3I:
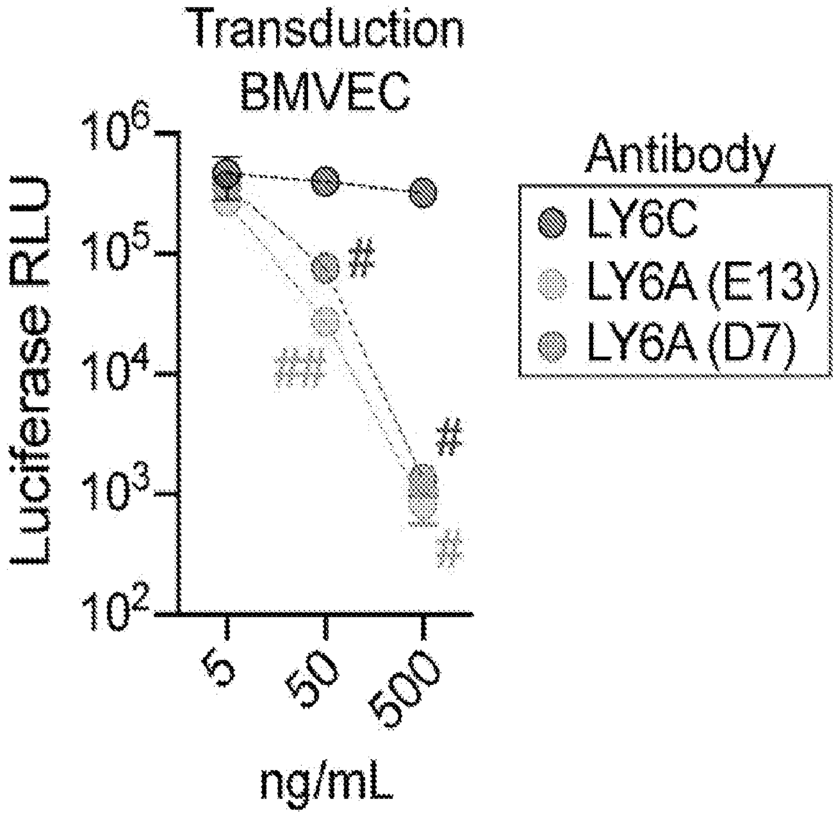
FIG. 3I shows a graph of AAV-PHP.eB-mediated transduction (Luciferase RLU) of BMVECs following the pre-incubation of cells with the indicated antibody (n=2/group, #p=0.023, ##p=0.010, *p=0.001, **p<0.0001, αLY6C vs. αLY6A, 2-way ANOVA, Tukey's correction for multiple comparisons)
Figure 3J:
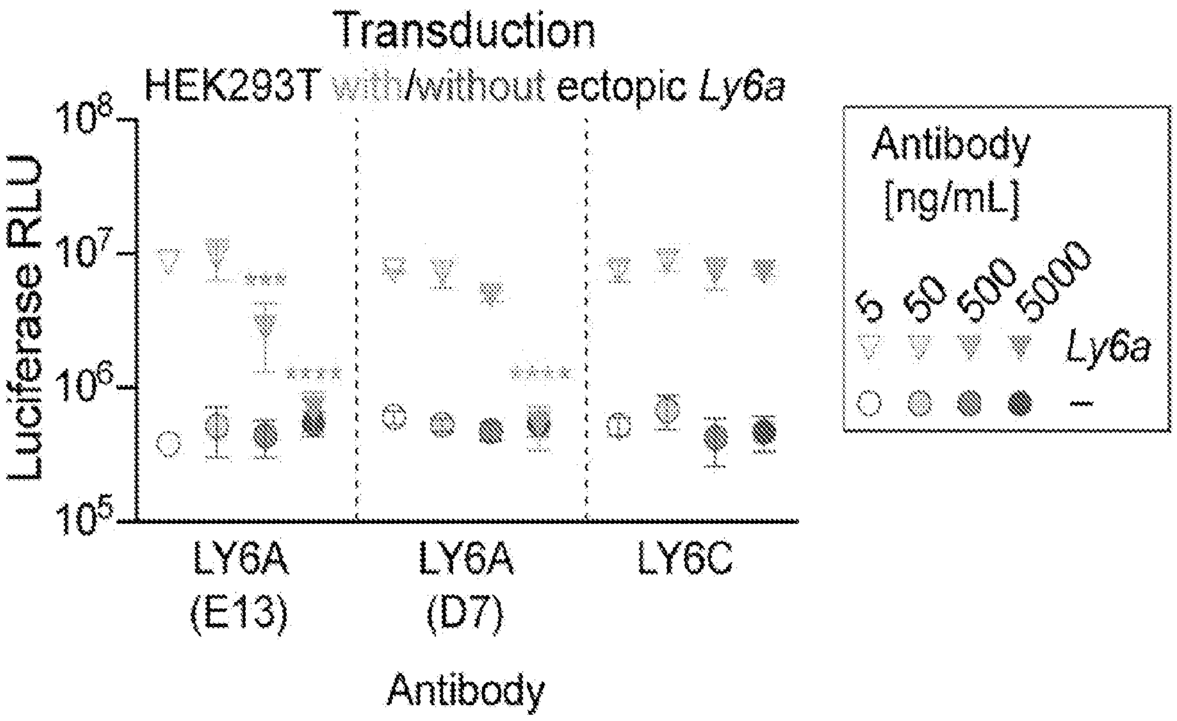
FIG. 3J shows a graph of AAV-PHP.eB-mediated transduction (Luciferase RLU) of HEK293 cells mock ransfected (—) or transfected with Ly6a (I) following the pre-incubation of cells with the indicated antibody (n=3/group, #p=0.023, ##p=0.010, *p=0.001, **p<0.0001, αLY6C vs. αLY6A, 2-way ANOVA, Tukey's correction for multiple comparisons)

Whether ectopic Ly6a expression is sufficient for increased binding and transduction by AAV-PHP.eB was investigated. HEK293T cells were transiently transfected with cDNAs encoding C57BL/6J Ly6a or Ly6c1 and the effects on binding and transduction by AAV-PHP.B capsids was evaluated. Remarkably, Ly6a expression resulted in a >50-fold increase in binding by each of the AAV-PHP.B capsids to HEK293T cells, but did not increase binding by AAV9 (FIG. 3G). Expression of Ly6a, but not Ly6c1, enhanced transduction by AAV-PHP.eB by 30-fold compared to the untransfected control (FIG. 3H).

Figure 4A:
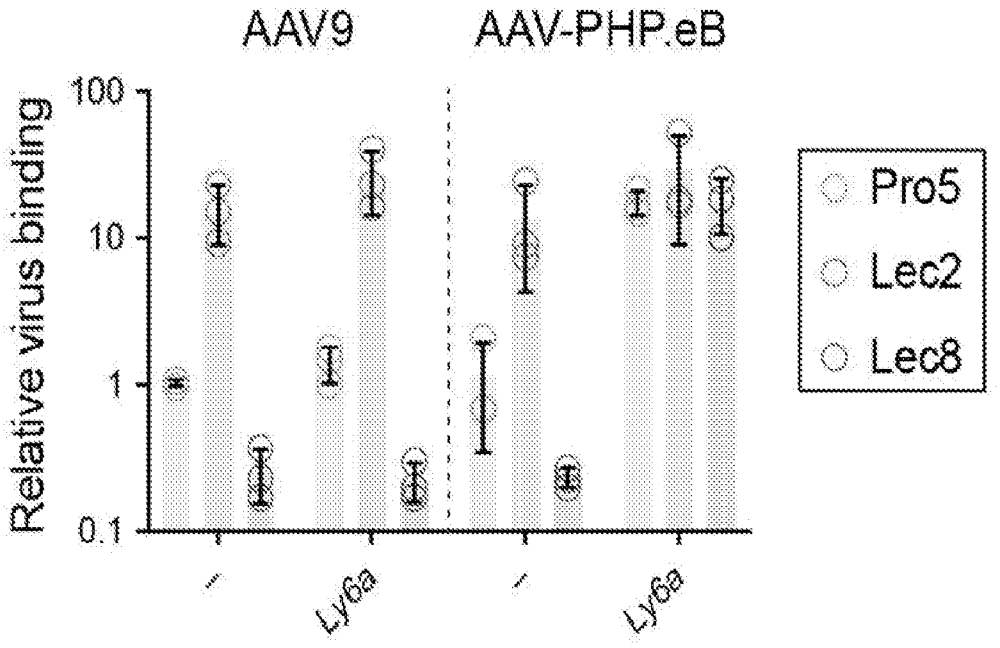
FIG. 4A shows a graph of quantification of AAV binding to CHO cell derivatives via qPCR for viral genomes. AAV-PHP.eB or AAV9 viruses were added to control Pro5 CHO cells, Lec2 CHO cells with excess galactose, or Lac8 CHO cells deficient for galactose transfer.
Figure 4B:
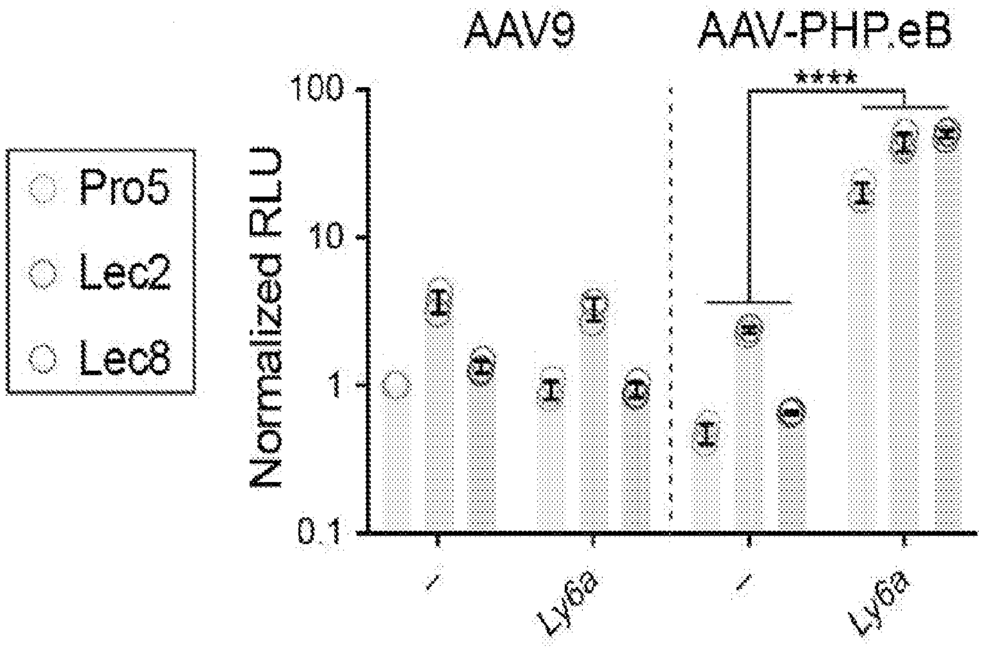
FIG. 4B shows a graph of transduction of CHO cells as measured by Luciferase assay 48 hours after virus addition, normalized to values from Pro5 cells transduced with AAV9.
Figure 4C:
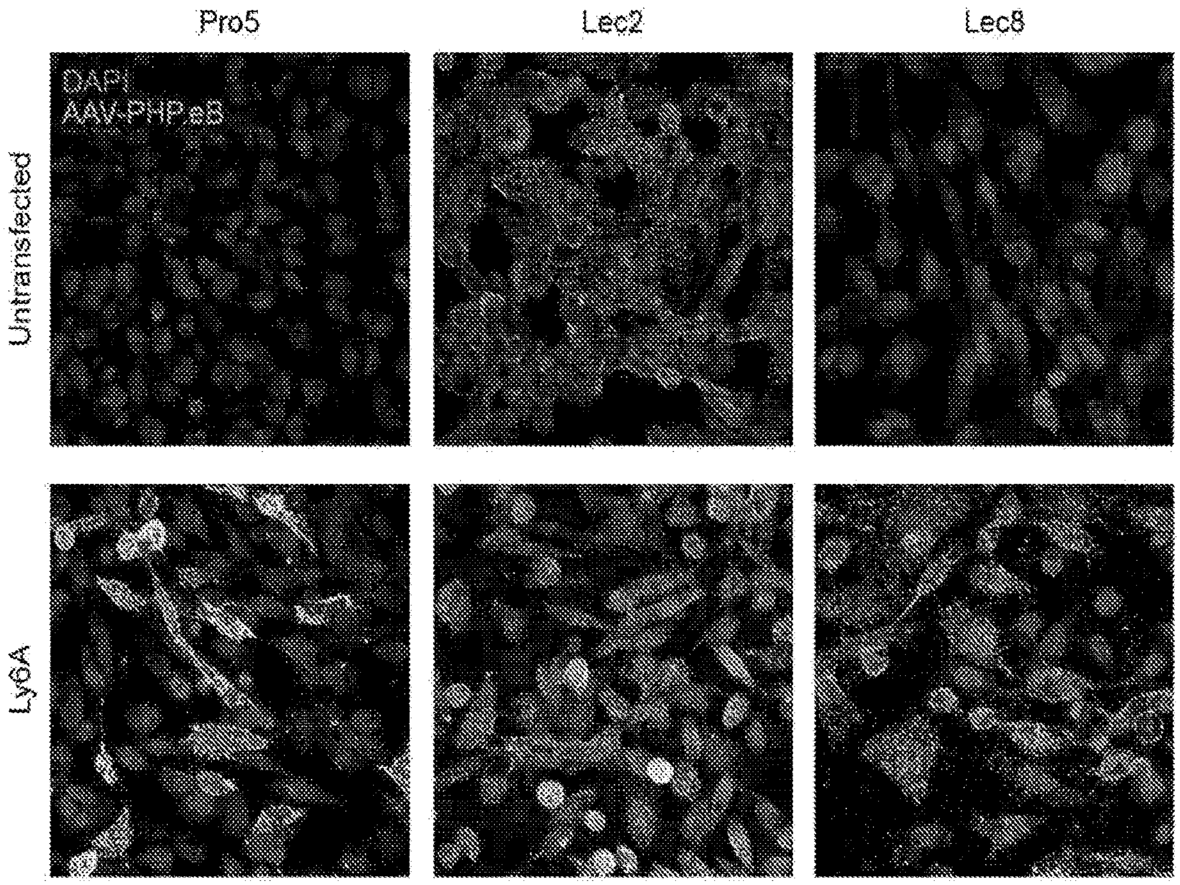
FIG. 4C shows images of AAV-PHP.eB capsid immunostaining of CHO cells that were untransfected (top row) or transfected with Ly6a (bottom row).

Example 6: LY6A Enhances AAV-PHP.eB Transduction Independently of Known AAV9 Receptors To determine whether LY6A acts solely as a primary attachment factor or has additional roles in promoting the internalization and trafficking of AAV-PHP.eB, it was explored whether AAV-PHP.eB binding and transduction are dependent on known receptor interactions. AAVs typically use a cellular receptor for attachment and secondary receptors for internalization and intracellular trafficking (39); AAV9 utilizes galactose as an attachment factor (40), and, like most AAVs, relies on the AAV receptor (AAVR) for intracellular trafficking and transduction (37). First, it was tested whether LY6A influences AAV-PHP.eB binding to Chinese Hamster ovary (CHO) cells with differing levels of galactose on their surface glycoproteins; Pro5 CHO derivative cells were previously used to map the galactose binding site on the AAV9 capsid (40). The Lec2 and Lec8 models derived from the parental Pro5 CHO cell line were utilized: Lec2 cells expose excess galactose whereas Lec8 cells are unable to add galactose to the glycoproteins (41). AAV9 and AAV-PHP.B similarly bind and transduce Lec2 cells more efficiently than Lec8 or Pro5 cells (FIGS. 4A-4B), showing that AAV-PHP.B also utilizes galactose for cell attachment. In contrast, ectopic Ly6a expression significantly increased binding of AAV-PHP.eB but not AAV9 (FIG. 4B) to Pro5 and Lec8 cells. Ly6a expression did not increase binding of AAV-PHP.eB to Lec2 cells (FIG. 4B), potentially due to the high levels of binding driven by interactions with galactose. Interestingly, Ly6a expression enhanced AAV-PHP.eB transduction of Pro5, Lec2, and Lec8 cells (FIG. 4C). The finding that Ly6a expression renders Lec8 cells as receptive to AAV-PHP.eB transduction as Pro5 cells indicates that LY6A functions as an attachment factor for AAV-PHP.eB independently of galactose. Furthermore, Ly6a expression enhances AAV-PHP.eB transduction of Lec2 cells without increasing binding, suggesting that LY6A mediates internalization and/or trafficking of AAV-PHP.eB.

Figure 4D:
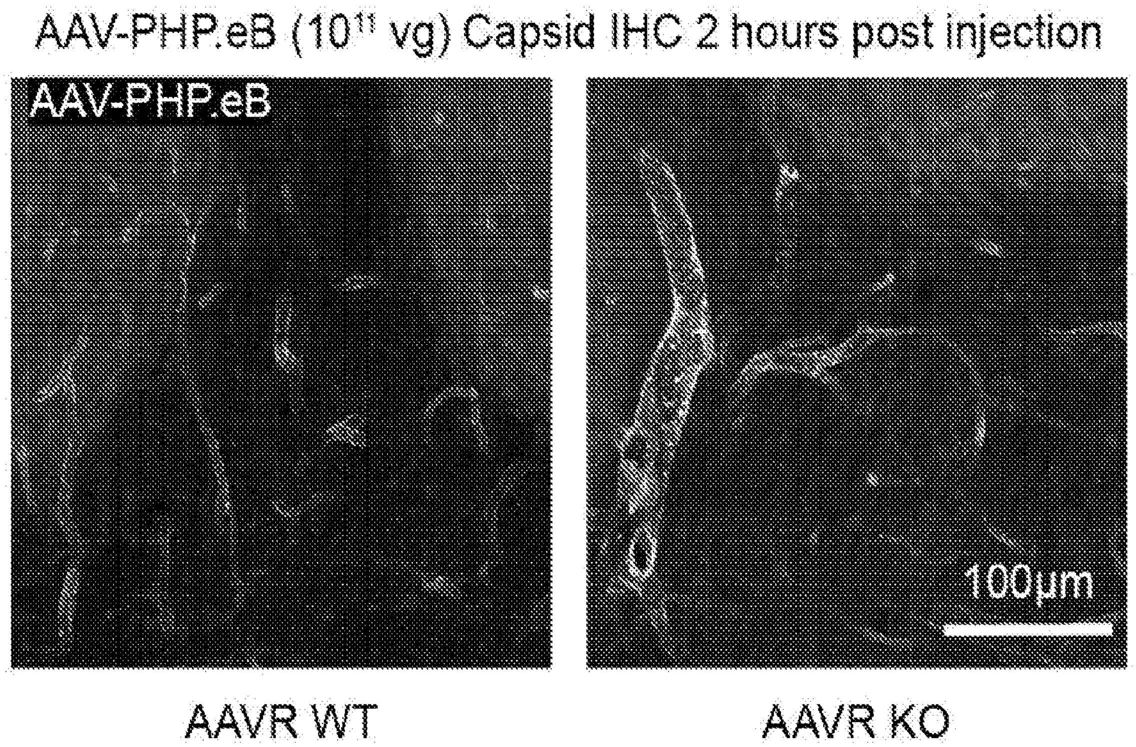
FIG. 4D shows images from AAVR WT or KO mice intravenously injected with AAV-PHP.eB:CAG-NLS-GFP ($10^{11}$ vg/mouse) and brain tissue was assessed via IHC for capsid binding at two hours.
Figure 4E:
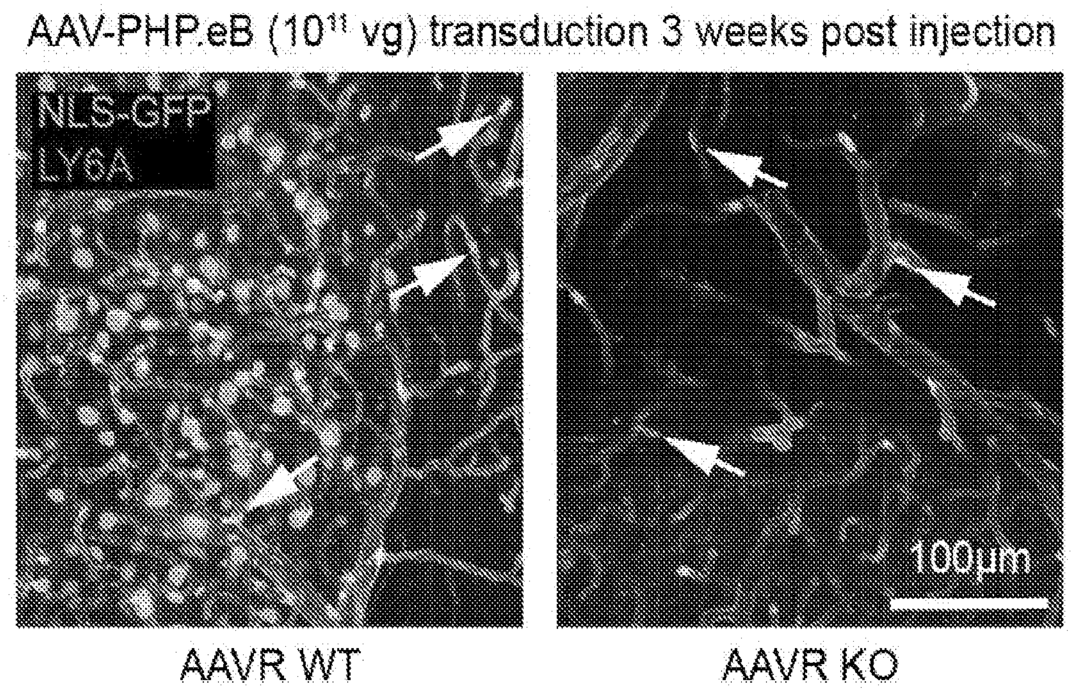
FIG. 4E shows images from AAVR WT or KO mice intravenously injected with AAV-PHP.eB:CAG-NLS-GFP ($10^{11}$ vg/mouse). Brain tissue was assessed via IHC for transduction at three weeks post injection (n=2 per group/per experiment).

However, this process may not require AAVR, which is essential for the intracellular trafficking of numerous AAV capsids including AAV9 (42). To test this possibility, AAVR WT and KO FVB/NJ mice (42) were injected with AAV-PHP.eB, and their brains were collected two hours later for capsid detection. As seen in C57BL/6J mice, AAV-PHP.eB capsids were detected along the vasculature of AAVR KO and control mice (FIG. 4D). AAV-PHP.eB transduction was assessed in a second cohort of AAVR KO and WT mice at three weeks post-administration. AAV-PHP.eB transduction of neurons and astrocytes, which do not express Ly6a, is nearly absent in the brain of AAVR KO mice. In contrast, AAV-PHP.eB transduced Ly6a-expressing endothelial cells throughout the brain (FIG. 4E) in the absence of AAVR.

Example 7: In Vitro Binding Assay for Targeted AAV Variant Discovery

Figure 5A:
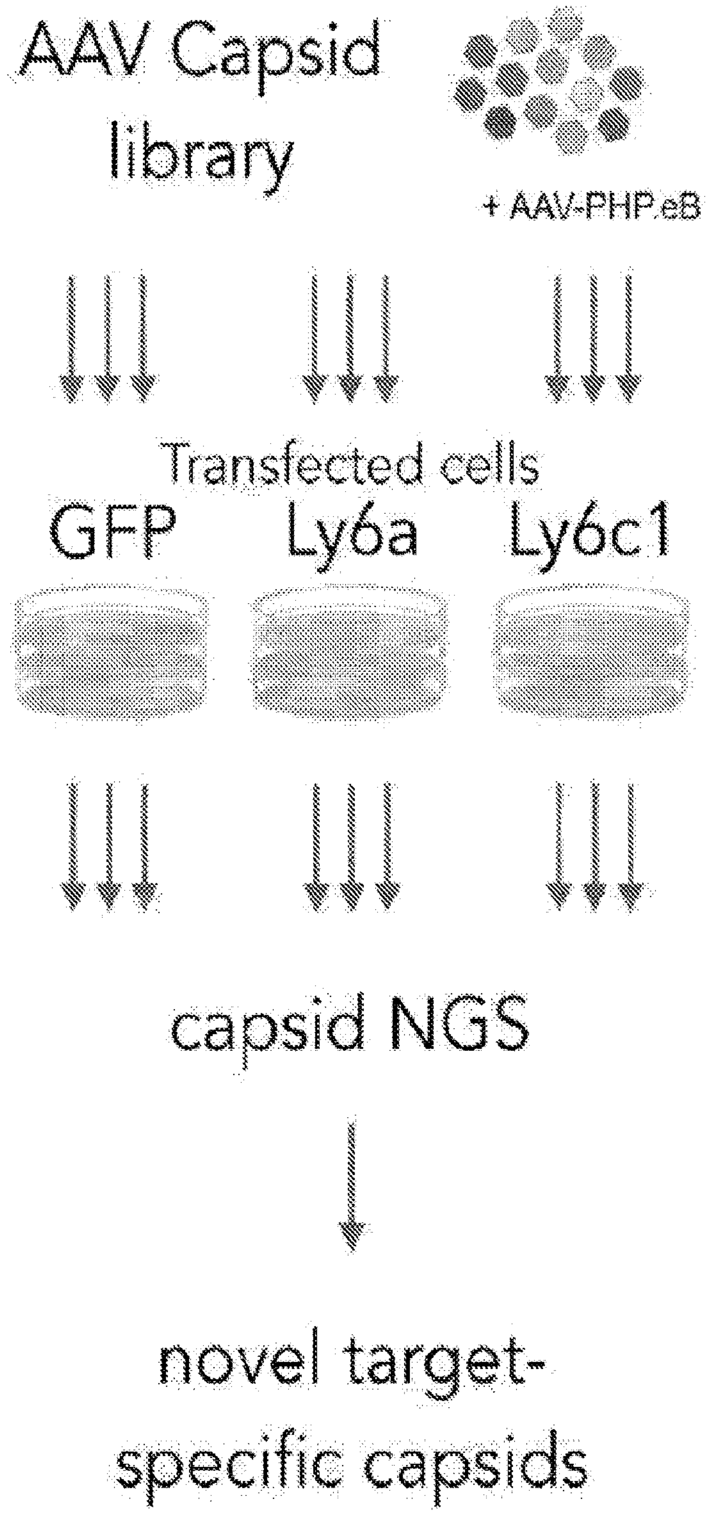
FIG. 5A shows a schematic depiction of a non-limiting example of a screening process described herein.
Figure 5B:
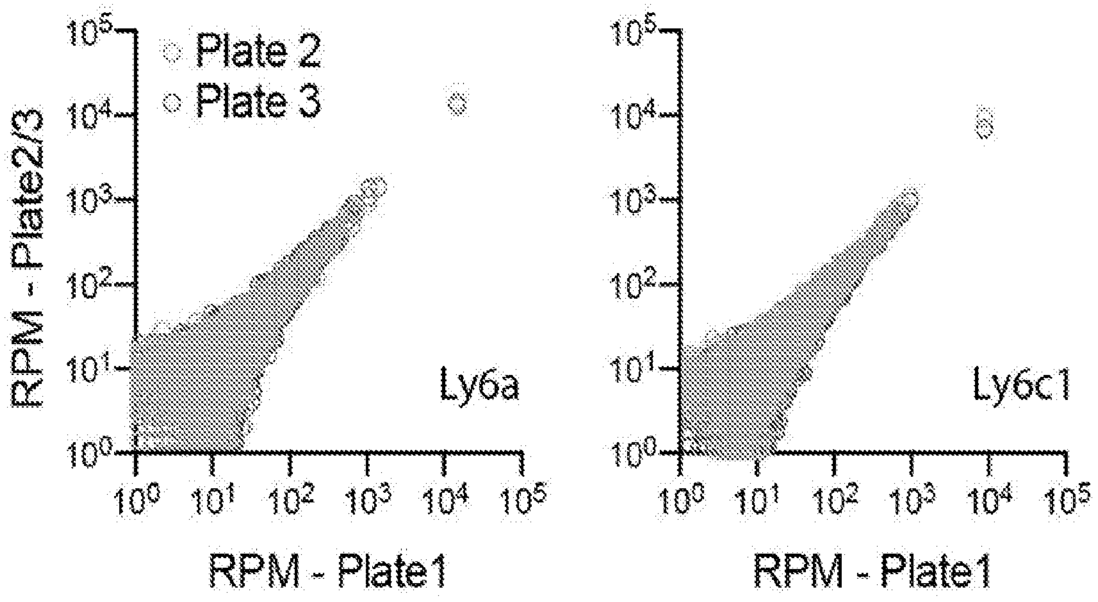
FIG. 5B shows graphs of the reads per million (RPM) correlations between replicates for the 10,000 most highly enriched capsid variants recovered from plates of cells expressing Ly6a (left) or Ly6c1 (right). Three replicates were performed for each assay with replicate 1 RPM plotted on the x-axis and replicate 2 and 3 RPMs plotted on the y-axis.
Figure 5C:
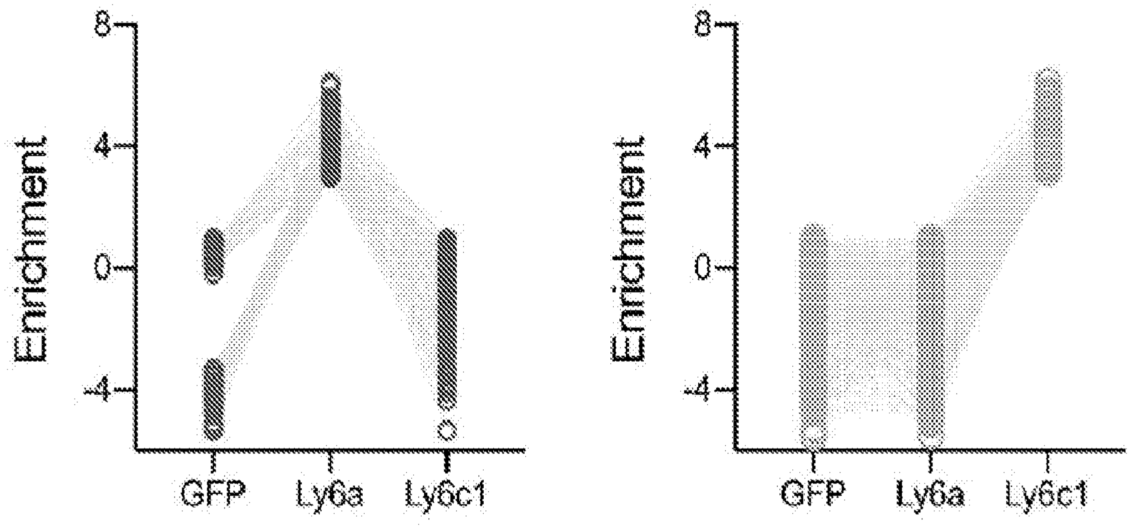
FIG. 5C shows graphs of the average enrichment scores (normalized read counts of the recovered sequence/normalized read count in the starting virus library) (log 2) on each transfected cell type for variants with enrichment scores greater than 3 on Ly6a-expressing (left) or Ly6c1-expressing (right) cells.
Figure 5D:
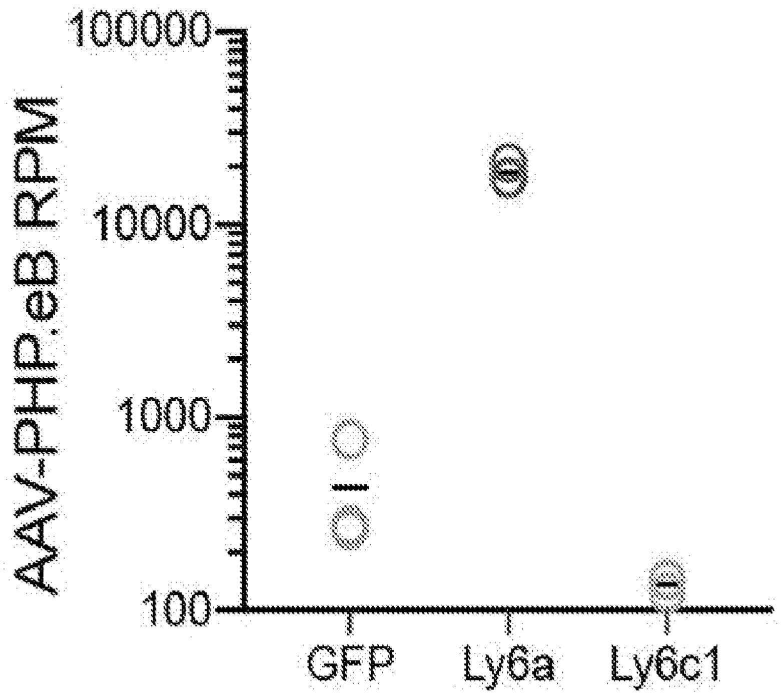
FIG. 5D shows a graph of AAV-PHP.eB that is highly enriched from an AAV library selected by binding to HEK293 cells expressing Ly6a but not cells expressing Ly6c1 or GFP.

The >30-fold increase in AAV-PHP.eB binding and transduction of cells from three different species following ectopic LY6A expression highlighted the potential application of this assay for screening or selecting novel capsids that bind to specific cell surface proteins (FIG. 5A). To test this, HEK293T/17 cells were transfected in triplicate with cDNAs for eGFP, Ly6a, or Ly6c1, and incubated the cells with an AAV9 K449R library (7-mer insertion between amino acids 588 and 589) 24-48 hours post-transfection. The viruses that remained bound to the transfected cells were isolated with TRIzol (Invitrogen) or a DNeasy Blood and Tissue Kit (Qiagen #69504) and analyzed by next generation sequencing (NGS) to quantify the enrichment of peptides that conferred upon the capsid the ability to bind cells expressing the target protein. The recovery of the top 10,000 most enriched capsid sequences bound to Ly6a or Ly6c1 transfected cells was reproducible and quantified based on the tight correlation of reads per million (RPM) between the three replicates (FIG. 5B, Pearson's correlation>0.996 or 0.994, respectively, for all pairwise correlations). Remarkably, using this assay, capsid variants were identified that were selectively enriched on either Ly6a or Ly6c1 expressing cells (FIG. 5C). As a positive control. AAV-PHP.eB was included in the library. AAV-PHP.eB was highly enriched in the screen for capsids that bind to cells transfected with Ly6A but not Ly6c1 or GFP. Furthermore, among capsids selectively enriched on Ly6a-expressing cells, additional sequences were identified that shared partial sequence similarity with AAV-PHP.B and AAV-PHP.B2 (Table 4). A distinct pattern of enriched sequences was detected among those selectively and highly enriched on Ly6c1-expressing cells (Table 5).

Taken together, these results indicate that the in vitro ectopic expression assay can rapidly and quantitatively identify binding interactions between AAV capsids and specific cell surface proteins.

TABLE 4

Sequences (7-mer) with similarity to AAV-PHP.B family peptides that specifically enhance binding to Ly6A expressing cells. The table shows sequences that conform or closely conform to the AAV-PHP.B consensus (T/S)-(L/I/V/M)-(A/x-V/x-P-F-K) (SEQ ID NO: 30225)(top). the AAV-PHP.B2 consensus (S/T)-(V/x)-(S/T/x)-(K/R)-P-F-(L/I/V/A) (SEQ ID NO: 30226) (middle), or x-x-x-F-K-(D/N)-(I/V/P) (SEQ ID NO: 30227), where x is any amino acid. AA that match the consensus are shown in bold. The Ly6A and Ly6c1 columns provide the fold enrichment (log2) for each sequence following screening on Ly6a- or Ly6c1-transfected cells relative to the abundance in the prescreened virus library.

| Sequences with similarity to PHP.B (TLAVPFK) (SED ID NO: 30258) | | | | | |
|---|---|---|---|---|---|
| 7-mer | SEQ ID NO: | Nucleotide sequence | SEQ ID NO: | Ly6A | Ly6c1 |
| VAER**PFK** | 20 | GTGGCTGAGCGTCCTTTTAAG | 34 | 6.38 | 1.22 |
| **T**VMA**PFK** | 21 | ACGGTGATGGCGCCGTTTAAG | 35 | 5.53 | -0.19 |
| YVGN**PFK** | 22 | TATGTGGGGAATCCTTTTAAG | 36 | 4.53 | 0.58 |
| DMER**PFK** | 23 | GATATGGAGCGTCCGTTTAAG | 37 | 4.51 | -3.91 |
| R**I**DN**PFK** | 24 | AGGATTGATAATCCTTTTAAG | 38 | 4.48 | -1.89 |
| **T**RDL**PFK** | 25 | ACGAGGGATCTGCCTTTTAAG | 39 | 4.34 | -1.36 |
| ALHV**PFK** | 26 | GCTTTGCATGTTCCTTTTAAG | 40 | 4.11 | 0.26 |
| **TLA**Y**PFK** | 27 | ACGCTGGCGTATCCGTTTAAG | 41 | 3.93 | -0.72 |
| GVDR**PFK** | 28 | GGTGTTGATCGGCCGTTTAAG | 42 | 3.84 | -1.13 |
| **SL**TT**PFK** | 29 | AGTTTGACGACGCCGTTTAAG | 43 | 3.18 | -1.85 |
| ESTR**PFK** | 30 | GAGTCTACTAGGCCGTTTAAG | 44 | 2.87 | 0.28 |
| GDNR**PFK** | 31 | GGGGATAATAGGCCGTTTAAG | 45 | 2.65 | 0.57 |
| AISA**PFK** | 32 | GCTATTAGTGCGCCTTTTAAG | 46 | 2.56 | -0.06 |
| **T**GTS**PFK** | 33 | ACTGGGACTTCGCCGTTTAAG | 47 | 2.22 | -3.32 |
| Seq. with similarity to PHP.B2 (SVSKPFL) (SEQ ID NO: 1906) (S/T)-(V/L/I)-x-(K/R)-P-F-(L/I/V/A) (SEQ ID NO: 30226) | | | | | |
| 7-mer | SEQ ID NO: | Nucleotide sequence | SEQ ID NO: | Ly6A | Ly6c1 |
| **S**ND**RPFI** | 48 | AGTAATGATCGTCCTTTTATT | 78 | 5.43 | -1.02 |
| **S**HT**KPFA** | 49 | AGTCATACGAAGCCGTTTGCT | 79 | 4.79 | 0.97 |
| **SI**N**KPFV** | 50 | TCGATTAATAAGCCTTTTGTT | 80 | 4.74 | -0.30 |
| DKQ**KPFL** | 51 | GATAAGCAGAAGCCGTTTCTG | 81 | 4.60 | 0.94 |
| MMA**KPFL** | 52 | ATGATGGCTAAGCCTTTTCTT | 82 | 4.53 | -0.49 |
| NER**RPFL** | 53 | AATGAGCGTAGGCCTTTTCTG | 83 | 4.31 | 0.77 |

TABLE 4-continued

Sequences (7-mer) with similarity to AAV-PHP.B family peptides that specifically enhance binding to Ly6A expressing cells. The table shows sequences that conform or closely conform to the AAV-PHP.B consensus (T/S)-(L/I/V/M)-(A/x-V/x-P-F-K) (SEQ ID NO: 30225)(top). the AAV-PHP.B2 consensus (S/T)-(V/x)-(S/T/x)-(K/R)-P-F-(L/I/V/A) (SEQ ID NO: 30226) (middle), or x-x-x-F-K-(D/N)-(I/V/P) (SEQ ID NO: 30227), where x is any amino acid. AA that match the consensus are shown in bold. The Ly6A and Ly6c1 columns provide the fold enrichment (log2) for each sequence following screening on Ly6a- or Ly6c1-transfected cells relative to the abundance in the prescreened virus library.

| | | | | | |
|---|---|---|---|---|---|
| TDTRPFI | 54 | ACTGATACTAGGCCTTTTATT | 84 | 4.19 | -3.32 |
| SQKTPFL | 55 | AGTCAGAAGACTCCGTTTCTG | 85 | 3.81 | -3.55 |
| GSERPFL | 56 | GGTTCTGAGAGGCCGTTTTTG | 86 | 3.78 | -4.20 |
| TSMKPFL | 57 | ACGAGTATGAAGCCTTTTCTG | 87 | 3.49 | -0.98 |
| GESRPFI | 58 | GGTGAGTCTCGTCCTTTTATT | 88 | 3.32 | -2.08 |
| NDQRPFL | 59 | AATGATCAGCGGCCTTTTCTG | 89 | 3.27 | -4.33 |
| AADRPFL | 60 | GCTGCTGATCGTCCGTTTCTG | 90 | 2.73 | -3.32 |
| DSQRPFI | 61 | GATAGTCAGCGTCCGTTTATT | 91 | 2.63 | -3.55 |
| ALAKPFI | 62 | GCTCTTGCTAAGCCTTTTATT | 92 | 1.91 | -0.19 |
| SEGRPFI | 63 | TCGGAGGGGAGGCCTTTTATT | 93 | 1.85 | -3.55 |
| ASSKPFL | 64 | GCGTCTAGTAAGCCGTTTCTT | 94 | 3.90 | 1.19 |
| SIARPFV | 65 | AGTATTGCTCGTCCGTTTGTG | 95 | 3.79 | -3.55 |
| NIIRPFA | 66 | AATATTATTCGGCCTTTTGCT | 96 | 3.23 | 0.40 |
| ESSKPFR | 67 | GAGAGTAGTAAGCCGTTTCGT | 97 | 3.15 | 1.28 |
| TSFKPFP | 68 | ACTTCTTTTAAGCCGTTTCCT | 98 | 3.11 | 0.48 |
| NMERPFR | 69 | AATATGGAGCGGCCGTTTAGG | 99 | 2.96 | 0.95 |
| TTMKPFN | 70 | ACGACGATGAAGCCTTTTAAT | 100 | 2.95 | -3.74 |
| NLKRPFA | 71 | AATTTGAAGAGGCCGTTTGCT | 101 | 2.80 | 0.85 |
| SVSKPFS | 72 | AGTGTGTCGAAGCCTTTTAGT | 102 | 2.73 | -1.53 |
| SSEKPFQ | 73 | AGTTCGGAGAAGCCGTTTCAG | 103 | 2.69 | -3.55 |
| TKSTPFI | 74 | ACTAAGTCGACTCCGTTTATT | 104 | 2.60 | -1.85 |
| YENRPFV | 75 | TATGAGAATCGTCCTTTTGTG | 105 | 2.23 | -3.32 |
| SLSKPFS | 76 | AGTTTGTCGAAGCCGTTTTCT | 106 | 2.19 | -2.08 |
| QNARPFV | 77 | CAGAATGCTCGTCCGTTTGTG | 107 | 1.52 | 1.42 |
| Sequences related to the consensus x-x-x-F-K-(D/N)-(I/V/P)(SEQ ID NO: 30227) | | | | | |
| 7-mer | SEQ ID NO: | Nucleotide sequence | SEQ ID NO: | Ly6A | Ly6c1 |
| TITFKDV | 108 | ACTATTACGTTTAAGGATGTT | 120 | 5.15 | -0.78 |
| SLDFKNI | 109 | AGTCTTGATTTTAAGAATATT | 121 | 4.61 | -1.29 |
| VAVFKNV | 110 | GTGGCTGTGTTTAAGAATGTG | 122 | 4.23 | -0.91 |
| AGSFKDI | 111 | GCTGGTTCGTTTAAGGATATT | 123 | 3.96 | -2.87 |
| PPSFKNV | 112 | CCTCCGAGTTTTAAGAATGTG | 124 | 3.69 | -4.33 |
| RSDFKDI | 113 | CGGAGTGATTTTAAGGATATT | 125 | 3.45 | -2.44 |
| STTFKDI | 114 | AGTACTACTTTTAAGGATATT | 126 | 3.44 | -3.32 |
| KDKFKDI | 115 | AAGGATAAGTTTAAGGATATT | 127 | 3.38 | -2.08 |
| QTLFKNI | 116 | CAGACGTTGTTTAAGAATATT | 128 | 3.07 | -0.72 |

TABLE 4-continued

Sequences (7-mer) with similarity to AAV-PHP.B family peptides that specifically enhance binding to Ly6A expressing cells. The table shows sequences that conform or closely conform to the AAV-PHP.B consensus (T/S)-(L/I/V/M)-(A/x-V/x-P-F-K) (SEQ ID NO: 30225)(top). the AAV-PHP.B2 consensus (S/T)-(V/x)-(S/T/x)-(K/R)-P-F-(L/I/V/A) (SEQ ID NO: 30226) (middle), or x-x-x-F-K-(D/N)-(I/V/P) (SEQ ID NO: 30227), where x is any amino acid. AA that match the consensus are shown in bold. The Ly6A and Ly6c1 columns provide the fold enrichment (log2) for each sequence following screening on Ly6a- or Ly6c1-transfected cells relative to the abundance in the prescreened virus library.

| | | | | | |
|---|---|---|---|---|---|
| RLS**FKDV** | 117 | CGGCTTAGTTTTAAGGATGTG | 129 | 2.39 | -1.62 |
| HNV**FKNP** | 118 | CATAATGTGTTTAAGAATCCT | 130 | 2.09 | 0.33 |
| KTQ**FKDV** | 119 | AAGACGCAGTTTAAGGATGTG | 131 | 2.09 | -3.55 |

TABLE 5

Sequences (7-mer) with the consensus x-(K/R/Y)-(x/R/K/Y/F)-(G/Y/K/R/x)-(Y/W/F/L/M)-(S/A)-(S/T/A/Q) (SEQ ID NO: 30228) are enriched on cells expressing Ly6c1. The table lists example 7-mer peptides that match closely match the above consensus sequence, where x is any amino acid. AA that match the consensus are shown in bold. The Ly6A and Ly6c1 columns provide the fold enrichment (log2) for each sequence following screening on Ly6a- or Ly6c1-transfected cells relative to the abundance in the prescreened virus library.

| 7-mer | SEQ ID NO: | Nucleotide sequence | SEQ ID NO: | Ly6A | Ly6c1 |
|---|---|---|---|---|---|
| V**R**P**GWST** | 132 | GTGCGTCCGGGGTGGTCGACG | 219 | 1.02 | 5.89 |
| TQQ**GYSS** | 133 | ACTCAGCAGGGGTATAGTTCT | 220 | -0.92 | 5.80 |
| **TK**S**GYST** | 134 | ACGAAGTCTGGTTATAGTACT | 221 | 0.68 | 5.71 |
| **TR**N**GYST** | 135 | ACTCGTAATGGTTATAGTACG | 222 | 0.82 | 5.58 |
| ID**RGYS**V | 136 | ATTGATCGGGGTTATAGTGTG | 223 | -1.04 | 5.30 |
| P**Y**Q**GASS** | 137 | CCTTATCAGGGGGCGAGTAGT | 224 | -0.53 | 5.24 |
| S**Y**Q**GYSS** | 138 | AGTTATCAGGGTTATAGTAGT | 225 | 1.47 | 5.21 |
| VN**RGYSS** | 139 | GTGAATCGTGGGTATAGTTCG | 226 | 0.89 | 5.18 |
| L**R**TA**YSS** | 140 | CTTAGGACGGCTTATAGTAGT | 227 | 1.13 | 5.12 |
| SYI**GASS** | 141 | AGTTATATTGGGGCGTCGAGT | 228 | -1.01 | 5.08 |
| NG**YKGST** | 142 | AATGGTTATAAGGGTTCGACG | 229 | 1.24 | 4.98 |
| EI**RGYSS** | 143 | GAGATTAGGGGGTATTCTAGT | 230 | 0.75 | 4.92 |
| DV**KYGSS** | 144 | GATGTGAAGTATGGGTCTTCG | 231 | -0.36 | 4.92 |
| GG**RG**L**SS** | 145 | GGGGGGAGGGGGCTTTCTAGT | 232 | 2.00 | 4.90 |
| **FR**I**GGSS** | 146 | TTTAGGATTGGTGGTTCTAGT | 233 | 1.34 | 4.89 |
| L**KYG**T**ST** | 147 | TTGAAGTATGGTACGTCTACG | 234 | 1.24 | 4.88 |
| KQ**Y**Q**GST** | 148 | AAGCAGTATCAGGGGTCTACT | 235 | 1.54 | 4.88 |
| N**Y**T**GYSS** | 149 | AATTATACTGGTTATTCTTCT | 236 | 0.44 | 4.83 |
| RAT**GYSS** | 150 | CGTGCTACTGGGTATTCTTCG | 237 | 2.49 | 4.75 |
| ES**RGFSS** | 151 | GAGAGTAGGGGTTTTAGTTCT | 238 | -0.58 | 4.70 |
| QH**F**GQ**SS** | 152 | CAGCATTTTGGTCAGAGTTCT | 239 | -0.37 | 4.68 |
| **TR**T**GYST** | 153 | ACGAGGACGGGTTATAGTACG | 240 | 0.89 | 4.63 |
| A**K**A**GYAS** | 154 | GCGAAGGCGGGTTATGCTAGT | 241 | -0.03 | 4.54 |
| N**R**G**GYAS** | 155 | AATAGGGGGGGGTATGCTAGT | 242 | -0.18 | 4.53 |
| SI**Y**L**GSQ** | 156 | AGTATTTATCTGGGTTCTCAG | 243 | -0.76 | 4.47 |

TABLE 5-continued

Sequences (7-mer) with the consensus x-(K/R/Y)-(x/R/K/Y/F)-(G/Y/K/R/x)-(Y/W/F/L/M)-(S/A)-(S/T/A/Q) (SEQ ID NO: 30228) are enriched on cells expressing Ly6c1. The table lists example 7-mer peptides that match closely match the above consensus sequence, where x is any amino acid. AA that match the consensus are shown in bold. The Ly6A and Ly6c1 columns provide the fold enrichment (log2) for each sequence following screening on Ly6a- or Ly6c1-transfected cells relative to the abundance in the prescreened virus library.

| | | | | | |
|---|---|---|---|---|---|
| YLKGYSA | 157 | TATCTTAAGGGGTATAGTGCT | 244 | 0.15 | 4.46 |
| EKKQYSS | 158 | GAGAAGAAGCAGTATAGTAGT | 245 | 0.89 | 4.45 |
| NYTGYSS | 159 | AATTATACTGGGTATTCTTCT | 246 | -0.46 | 4.44 |
| SKTGYST | 160 | TCTAAGACGGGTTATAGTACG | 247 | -3.55 | 4.43 |
| TEKWTSS | 161 | ACTGAGAAGTGGACGTCGAGT | 248 | 0.98 | 4.43 |
| DRIHGYS | 162 | GATCGGATTCATGGTTATAGT | 249 | -0.11 | 4.34 |
| TRFGAST | 163 | ACTCGTTTTGGTGCTAGTACT | 250 | 0.00 | 4.32 |
| GKHFSST | 164 | GGGAAGCATTTTAGTTCGACG | 251 | 2.64 | 4.25 |
| TKYMHSS | 165 | ACTAAGTATATGCATAGTTCG | 252 | 1.35 | 4.24 |
| VKVGFSS | 166 | GTTAAGGTTGGTTTTTCGTCG | 253 | -2.25 | 4.22 |
| LRMGASS | 167 | CTGAGGATGGGGGCGTCTTCT | 254 | 0.91 | 4.17 |
| LNRGSST | 168 | TTGAATCGGGGTAGTTCTACG | 255 | 1.72 | 4.15 |
| LYAGRSS | 169 | CTTTATGCGGGTCGGAGTTCG | 256 | 1.03 | 4.13 |
| DTKWSSS | 170 | GATACTAAGTGGAGTAGTAGT | 257 | 0.53 | 4.11 |
| SSTGYSS | 171 | TCGTCTACTGGTTATAGTAGT | 258 | -1.93 | 4.00 |
| MRTFGSA | 172 | ATGCGTACGTTTGGTAGTGCG | 259 | 1.00 | 3.97 |
| LAHTYSS | 173 | CTGGCTCATACTTATAGTTCG | 260 | 0.04 | 3.97 |
| LTKWEST | 174 | CTTACTAAGTGGGAGAGTACT | 261 | 0.82 | 3.91 |
| LWAKGST | 175 | TTGTGGGCGAAGGGTAGTACG | 262 | 1.42 | 3.90 |
| GKTHGYS | 176 | GGTAAGACGCATGGTTATTCG | 263 | 1.65 | 3.87 |
| MRTLMSS | 177 | ATGCGGACGCTTATGTCGTCT | 264 | -0.52 | 3.85 |
| TRTSGAS | 178 | ACGAGGACGAGTGGTGCGTCG | 265 | 0.43 | 3.85 |
| MERYGSS | 179 | ATGGAGCGTTATGGGAGTTCT | 266 | -2.28 | 3.83 |
| TYKSGSS | 180 | ACGTATAAGTCGGGTTCGAGT | 267 | 1.95 | 3.78 |
| TRFGSST | 181 | ACTAGGTTTGGTAGTTCGACT | 268 | 1.29 | 3.63 |
| DKAWGST | 182 | GATAAGGCTTGGGGGTCGACT | 269 | 0.19 | 3.56 |
| VPRYGSS | 183 | GTTCCGCGTTATGGTTCGAGT | 270 | -1.01 | 3.55 |
| LSKGLSS | 184 | CTTAGTAAGGGTCTTTCGAGT | 271 | -3.55 | 3.55 |
| STRGYSA | 185 | AGTACTAGGGGGTATAGTGCT | 272 | 1.08 | 3.55 |
| IRVGYST | 186 | ATTAGGGTGGGGTATTCTACT | 273 | -3.55 | 3.46 |
| GNENFSS | 187 | GGTAATTTTAATTTTAGTTCT | 274 | -1.43 | 3.45 |
| DKYNFSS | 188 | GATAAGTATAATTTTAGTAGT | 275 | -0.13 | 3.43 |
| EDHRYSS | 189 | GAGGATCATCGGTATAGTAGT | 276 | 0.17 | 3.40 |
| VKGGYSS | 190 | GTGAAGGGGGGTTATTCTAGT | 277 | 0.07 | 3.30 |
| VTHGYSS | 191 | GTTACTCATGGTTATAGTAGT | 278 | -0.84 | 3.25 |
| MVRNYST | 192 | ATGGTGAGGAATTATTCGACT | 279 | -0.94 | 3.25 |
| HKTHYSS | 193 | CATAAGACGCATTATTCTAGT | 280 | 0.86 | 3.24 |

TABLE 5-continued

Sequences (7-mer) with the consensus x-(K/R/Y)-(x/R/K/Y/F)-(G/Y/K/R/x)-(Y/W/F/L/M)-(S/A)-(S/T/A/Q) (SEQ ID NO: 30228) are enriched on cells expressing Ly6c1. The table lists example 7-mer peptides that match closely match the above consensus sequence, where x is any amino acid. AA that match the consensus are shown in bold. The Ly6A and Ly6c1 columns provide the fold enrichment (log2) for each sequence following screening on Ly6a- or Ly6c1-transfected cells relative to the abundance in the prescreened virus library.

| | | | | | |
|---|---|---|---|---|---|
| IV**RGLSS** | 194 | ATTGTTCGTGGTCTGAGTTCG | 281 | -1.14 | 3.24 |
| TVT**GYSS** | 195 | ACTGTTACGGGTTATTCGTCT | 282 | -3.91 | 3.22 |
| NKV**GYST** | 196 | AATAAGGTGGGGTATTCTACG | 283 | -3.74 | 3.13 |
| NSP**GWSS** | 197 | AATAGTCCGGGTTGGTCGAGT | 284 | -0.93 | 3.08 |
| HEHR**YST** | 198 | CATGAGCATAGGTATAGTACT | 285 | -4.06 | 3.06 |
| LSM**GYST** | 199 | CTGTCTATGGGGTATAGTACT | 286 | -3.91 | 2.97 |
| LL**RGASS** | 200 | CTTTTGCGTGGTGCGAGTTCT | 287 | -0.33 | 2.96 |
| LKK**GYST** | 201 | TTGAAGAAGGGGTATAGTACT | 288 | 1.72 | 2.96 |
| **GKTGYST** | 202 | GGGAAGACTGGGTATTCGACG | 289 | -3.32 | 2.93 |
| W**RQGYAS** | 203 | TGGAGGCAGGGGTATGCGAGT | 290 | -0.09 | 2.89 |
| L**RGGYST** | 204 | TTGAGGGGTGGGTATAGTACG | 291 | -3.32 | 2.88 |
| D**RKGYSA** | 205 | GATCGTAAGGGGTATAGTGCT | 292 | -0.39 | 2.77 |
| LKT**GMSS** | 206 | TTGAAGACGGGGATGTCTAGT | 293 | -0.66 | 2.74 |
| SKGS**YST** | 207 | TCTAAGGGGAGTTATAGTACT | 294 | 1.54 | 2.74 |
| I**RQGYSS** | 208 | ATTCGTCAGGGGTATTCGAGT | 295 | -1.28 | 2.61 |
| QD**KGYSS** | 209 | CAGGATAAGGGTTATAGTTCG | 296 | -3.55 | 2.61 |
| QSA**GYST** | 210 | CAGTCGGCTGGGTATTCTACG | 297 | -1.58 | 2.55 |
| **FLPGYSS** | 211 | TTTCTGCCGGGGTATTCGTCG | 298 | -2.29 | 2.54 |
| GS**YGYSS** | 212 | GGGAGTTATGGTTATTCGTCG | 299 | -3.32 | 2.48 |
| MNI**GYSA** | 213 | ATGAATATTGGGTATAGTGCG | 300 | -1.48 | 2.40 |
| HTQ**GYST** | 214 | CATACGCAGGGGTATAGTACG | 301 | -3.32 | 2.26 |
| V**YPGYST** | 215 | GTTTATCCTGGTTATAGTACG | 302 | -3.32 | 2.21 |
| IAT**GYSQ** | 216 | ATTGCTACTGGTTATAGTCAG | 303 | -3.74 | 2.18 |
| SKS**GYSA** | 218 | TCTAAGAGTGGTTATAGTGCG | 304 | -3.32 | 2.14 |
| **TYGGYSQ** | 218 | ACGTATGGGGGTTATTCTCAG | 305 | -0.34 | 2.02 |

Example 8: Novel AAVs that Interact with Ly6a and Ly6c are Enriched in a High-Throughput In Vivo Screening Assay for AAVs that Express the Capsid Transgene To validate and test 7-mer modified AAV vectors that selectively bind HEK293T cells that express Ly6a, Ly6c1, marmoset CD59, or human CD59, a new synthetic oligo pool library was generated. The oligo pool (Agilent) library comprised 7-mer-modified AAV variants that were specifically enriched on HEK293T expressing one of the above genes. In addition, in cases where motifs were found within the enriched sequences, 7-mers that maintained the motif but introduced diversity adjacent to the motif were also generated. For example, X-(K/R)-(A/D/E/F/G/H/I/L/M/N/P/Q/S/T/V/W/Y)-G-Y-S-(Q/S/T) (SEQ ID NO: 30259) was generated, where X is any amino acid, based on a common motif identified through screening for 7-mer modified capsids that were selectively enriched on HEK293T cells expressing Ly6c1. Single site-saturation mutagenesis was also used to explore which amino acids within the 7-mer are critical for the selected activity of several highly enriched sequences that did not share an obvious motif with other enriched sequences. Sequences were pooled into a single oligo pool library along with several reference sequences with characterized tropisms (e.g., AAV-PHP.B2: SVSKPFL (SEQ ID NO: 1906); AAV-PHP.B3: FTLTTPK (SEQ ID NO: 1908); AAV-PHP.A: YTLSQGW (SEQ ID NO: 10689). Two copies of each 7-mer were synthesized using different codon sets. The library contained just under 60,000 unique oligos.

Figure 2C:
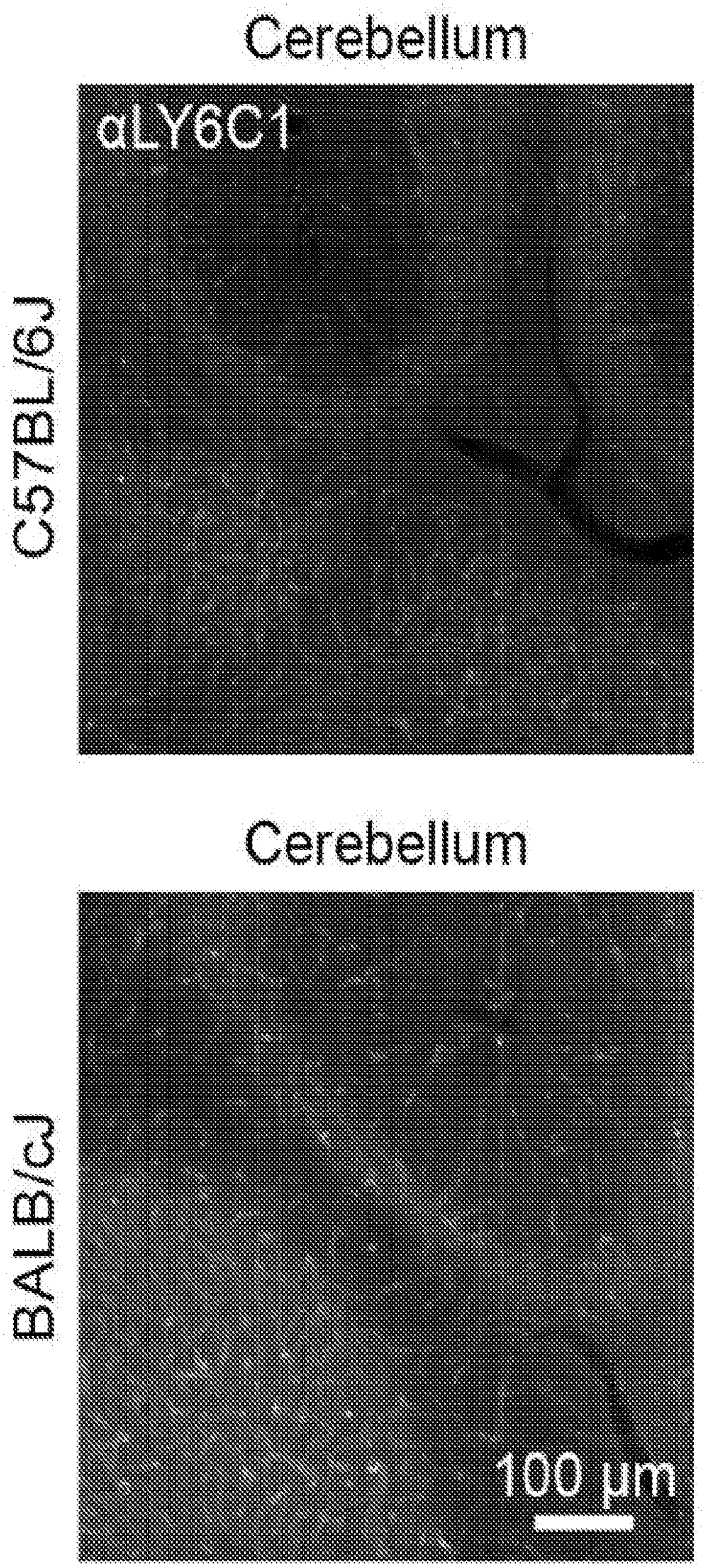
FIG. 2C shows images of whole sagittal LY6A IHC in C57BL/6J (top) or BALB/cJ (bottom) mice.
Figure 2D:
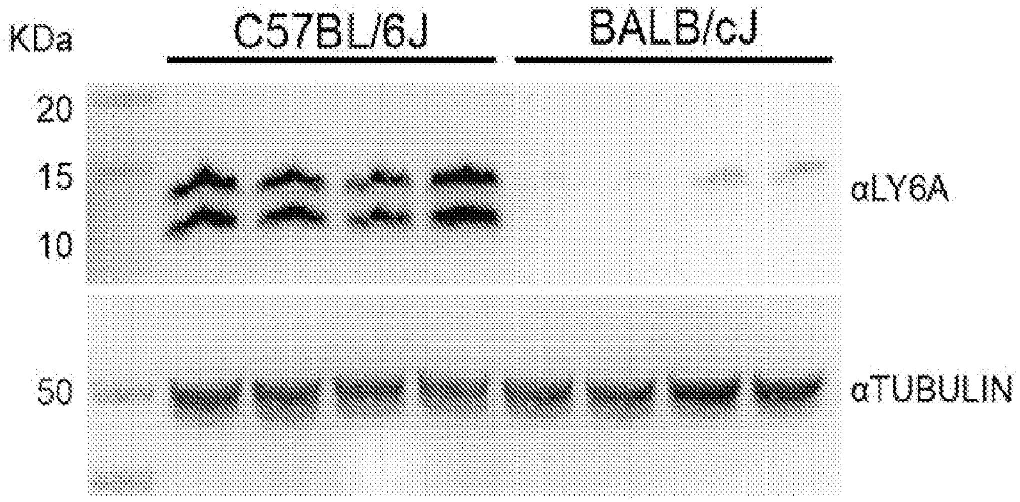
FIG. 2D shows a western blot of LY6A and αTubulin (αTUB) control from forebrain lysates providing LY6A abundance and protein states in each mouse line.
Figure 5E:
FIG. 5E shows images of the indicated AAV variants screened for binding to LY6C1 in vitro packaged into an ssAAV-CAG-NLS-GFP reporter vector and delivered to adult C57BL/6J (top row) or BALB/cJ (bottom row) at $10^{11}$ vg/animal. Transduction was assessed two weeks later.
Figure 13:
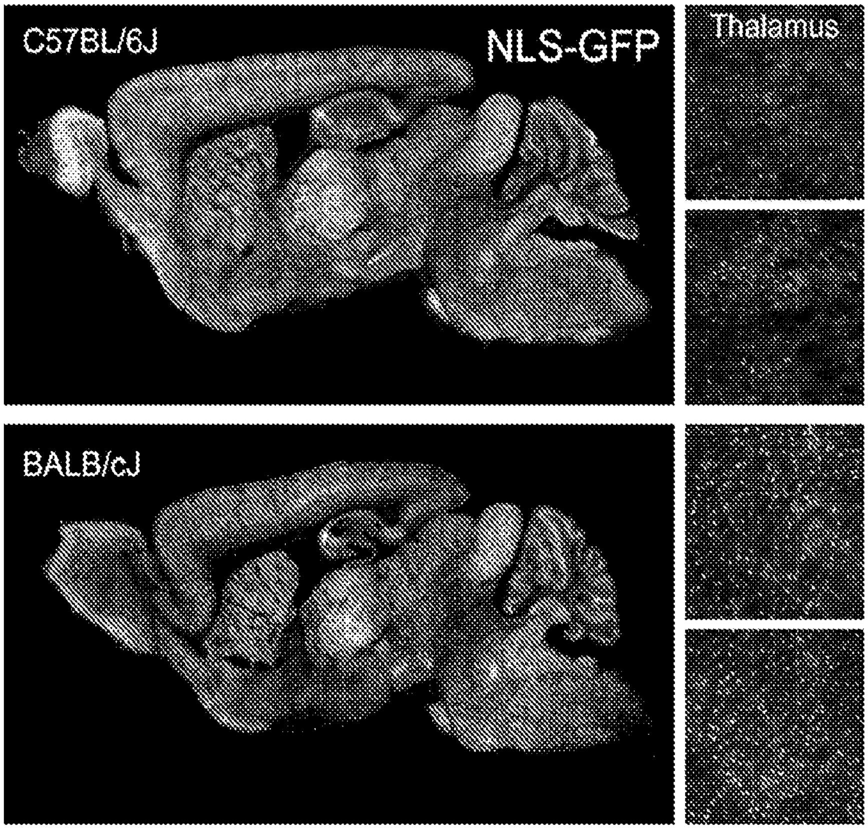
FIG. 13 shows images of GFP fluorescence in whole brain sagittal sections from C57BL/6J (top) or BALB/cJ (bottom), ten days after intravenous injection of AAV-BI28:CAG-NLS-GFP-W-pA $1\times10^{12}$ vg/mouse to 6-week-old mice. Images on the right show NLS-GFP expression in the thalamus in two replicate animals.
Figure 14:
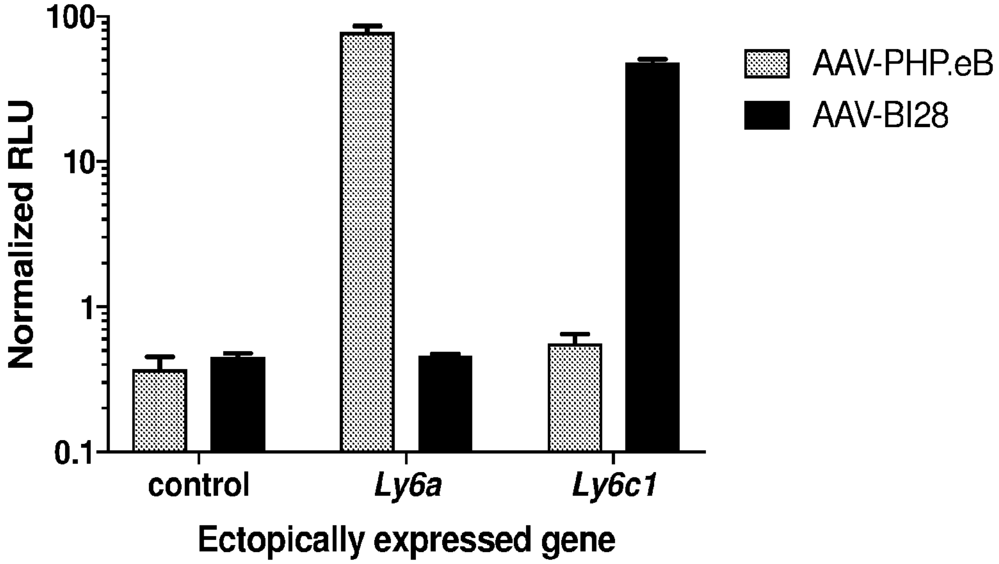
FIG. 14 is a graph showing ectopic expression of Ly6a or Ly6c1 sensitizes human brain endothelial cells to transduction by AAV-PHP.eB and AAV-BI-28, respectively. Human brain endothelial cells (hCMEC/D3) were transduced in triplicate with no virus (untransduced control), a control AAV (AAV-CAG-NLS-mScarlet), a virus encoding mouse Ly6a (AAV-CAG-Ly6a), or a virus encoding mouse Ly6c1 (AAV-CAG-Ly6c1). Viruses were delivered at $10^5$ vg/cell. Two days later, the cells were transduced with either a LY6A-specific virus (AAV-PHP.eB:CAG-GFP-2A-Luc) or a LY6C1-specific virus (AAV-BI28). 24 hours later, transduction was assessed by a firefly luciferase assay using Britelite plus kit as directed by the manufacturer (PerkinElmer). AAV-PHP.eB and AAV-BI28 were delivered at $10^4$ vg/cell.

The oligo pool was used to generate a PCR fragment that was cloned (as described in Deverman et al NBT 2016) into a novel AAV capsid selection plasmid. This AAV genome provides selective pressure for functional AAV variants (i.e., those that transcribe the viral capsid gene in vivo). In between the CMV enhancer and AAV p41 promoter contains a synthetic intron with a consensus donor motif (CAGGTAAGT), consensus splice motif (TTTTTTCTA-CAGGT) and branch point sequence. This library vector comprises a CMV enhancer upstream of the AAV p41 promoter and Cap gene. The AAV-capsid library expresses the AAV capsid gene both during virus production as well as following transduction in cultured cells and in vivo. To recover the functional capsids, cellular/tissue RNA was isolated, the capsid RNA was reverse transcribed into cDNA, and the capsid sequence containing the 7-mer was amplified by PCR. By recovering and sequencing viral RNAs, this approach applied selective pressure for functional, transcriptionally active AAV vectors.

transduction phenotype, unlike Ly6A, it remains highly expressed on endothelial cells of non-permissive strains (FIG. 2C). Therefore, the question of whether AAV capsids engineered to bind LY6C1 could transduce cells within the mouse CNS was investigated. GFP reporter viruses were generated that were packaged in five of the LY6C1-binding AAV variants and one control variant that was selected for enhanced binding to HEK293 cells. Remarkably, four of the five in vitro screened variants displayed either endothelial cell transduction and/or transduction of neurons and glia throughout the CNS of both C57BL/6J and BALB/cJ mice; in contrast, only sparse transduction was seen with the control variant (FIG. 5E; Table 6). The most potent of these variants, AAV-BI-28 is highly effective at crossing the BBB in both strains of mice (FIG. 13).

TABLE 6

Characteristics of AAV capsids comprising 7-mer sequences screened on Ly6c1 expressing cells in vivo.

| Variant | 7-mer | SEQ ID NO: | Nucleotide sequence | SEQ ID NO: | Ly6A | Ly6c | C57BL/6J | BALB/cJ | Characteristics |
|---|---|---|---|---|---|---|---|---|---|
| C1 | KSAGSIY | 306 | AAGAGTGCTGGTTCGATTTAT | 311 | 1.41 | 6.12 | ++ | + | Increased transcytosis |
| C2 | TQQGYSS | 307 | ACTCAGCAGGGGTATAGTTCT | 312 | -0.92 | 5.8 | ++++ | ++++ | Strongly increased transcytosis |
| C3 | WGTPPRG | 308 | TGGGGGACGCCTCCGAGGGGG | 313 | 1.01 | 6.35 | ++++ | + | Mostly endothelial |
| C5 | ELYKLPT | 309 | GAGCTGTATAAGCTTCCGACG | 314 | -2.26 | 5.38 | +++ | +++ | Increased transcytosis and regional variation |
| C6 | TRNGYST | 310 | ACTCGTAATGGTTATAGTACG | 315 | 0.186 | 4.05 | + | + | — |
| C28 | KSVGSVY | 10669 | AAGTCAGTAGGCTCAGTATAC | 11564 | -1.24 | 3.59 | +++++ | +++++ | Strongly increased transcytosis |

An AAV library was generated from this oligo pool library and delivered it intravenously to two C57BL/6J and two BALB/cJ mice. It was found that more than 100 of the sequences screened on Ly6a or Ly6c1 expressing cells (or sequences derived from those sequences as described above) that were enriched in at least one of the CNS RNA samples. Furthermore, the sequences that were found to bind Ly6a expressing cells were selectively enriched in the CNS of C57BL/6J mice while many of the sequences found to bind Ly6c1 expressing cells were enriched in both C57BL/6J and BALB/cJ mice. This differential tropism is consistent with the finding that genetic changes in the BALB/cJ Ly6a gene prevent it from functioning as a receptor for AAV capsids engineered to bind Ly6a (Huang et al, bioRxiv 2019). These data provide additional validation that a significant fraction of the 7-mer modified capsids that were screened for selective binding to HEK293T cells ectopically expressing Ly6a or Ly6c exhibited the predicted enhanced tropism in vivo.

Example 9: Novel AAV Capsids Screened on Ly6c1-Expressing Cells In Vitro Transduce or Transcytose the Mouse Brain Endothelium Although SNPs in Ly6c1 identified this gene as a potential factor associated with the nonpermissive AAV-PHP.eB These results demonstrate several findings. First, like LY6A, LY6C1 has the ability to traffic engineered viruses into the CNS, raising the possibility that additional Ly6 proteins and the wider class of GPI-anchored proteins may also facilitate CNS-wide gene delivery in other species including humans. Second, the novel ectopic expression and in vitro binding assay developed herein can enable the development of multiple AAV capsid variants that bind to specific proteins. Third, protein targets known to be present on specific cell populations of interest (e.g., brain endothelial cells) can be harnessed to enhance the transduction of those cells in vivo. This assay could enable the rapid development of capsids that are able to transduce target cell populations more efficiently and with greater specificity. Importantly, because the precise target receptor is known, the method and findings will be more translational to human gene therapy as compared to existing capsid engineering methods that rely on in vivo selections in model organisms and often result in the development of AAV capsids with species-specific tropisms.

Example 10: Purified Fc-Fusion Proteins can be Used to Identify Novel AAV Capsids that Bind to Specific Receptors To identify AAV capsids that selectively bind specific LY6 proteins, a purified protein pull down assay was used. To do this, a screen for viruses that interact with purified LY6A-, LY6C- or human CD59-fusion proteins was performed. This assay proved highly sensitive and resulted in the development of thousands of 7-mer modified capsid variants that selectively bind LY6A-Fc or LY6C1-Fc, but not a control Fc protein (Tables 11 and 15). A smaller number of sequences was found to specifically bind hCD59-Fc (Table 18). Encouragingly, for all three LY6-Fc fusions, a significant number of novel sequences were identified that matched motifs previously identified through HEK293T cell ectopic receptor assays and in vivo screening for each receptor (LY6A: Table 12; LY6C1: Table 16; hCD59: Table 18).

Example 11: Ectopic Expression of Ly6a or Ly6c1 can be Used to Sensitize Cells to Transduction by AAVs Engineered to Interact with LY6A or LY6C1

AAV vectors are commonly used to deliver genes in vivo because of their ability to provide long-term expression. In addition, many AAV vectors are able to transverse vascular barriers after intravenous administration and deliver genes to the cells throughout numerous tissues, including but not limited to the brain, heart, liver, skeletal muscle, lungs, bone, cartilage, bone marrow, adrenal gland, retina, pancreas, adipose tissue and kidney. However, it remains challenging to develop AAV vectors that target specific cell types or specific organs in humans.

Previously, nanoparticle and other novel delivery modalities were developed and directed toward the vasculature of specific organs (Sago et al., Proc Natl Acad Sci USA. 2018 Oct. 16; 115(42):E9944-E9952; Sago et al., J Am Chem Soc. 2018 Dec. 12; 140(49): 17095-17105.; Järvinen et al., Int J Mol Sci. 2015 Sep. 30; 16(10):23556-71.). While such nanoparticles can be developed to preferentially deliver siRNAs and mRNAs to endothelial cells in specific organs, it remains challenging to use nanoparticles or other nonviral delivery vehicles to deliver DNA to the nucleus for long-term gene therapeutic applications or to achieve gene delivery across vasculature barriers to reach parenchymal cells within the target tissue(s).

In the present disclosure, a two-step delivery method that overcomes these challenges is described. The first step involves the expression, preferably transient, of an ectopic receptor for an engineered virus in the target cell population of a patient. The second step involves the administration of an AAV that specifically interacts with the ectopic receptor to the same patient during the window of receptor expression. This approach is attractive because it breaks down the process of achieving stable gene expression in the cells of specific organs into two steps. The first step requires only transient delivery or expression of a receptor in the target organ endothelium, which could be achieved by delivery of an mRNA carried by a nanoparticle, a RNA or DNA virus (e.g. a recombinant lentivirus, SV40, anellovirus, or adenovirus) or protein with a targeting motif or conjugate. It is not necessary nor preferred that the delivery system achieves persistent gene expression or traverses the vascular barrier. The second step uses an engineered AAV, such as those presented here within, to efficiently target the cells that ectopically express the receptor for the modified AAV. The ectopic receptor then mediates the transcytosis of the engineered AAV across the vasculature where it can subsequently transduce cells within the target organ and provide durable transgene expression from the recombinant viral genome.

In step one, the receptor, which is absent or expressed at a level that limits transduction in the target cell population, is ectopically expressed in, or delivered to, the target cell population of a patient. The delivery of the receptor can be achieved with a nanoparticle carrying an mRNA for the receptor or a viral vector carrying RNA or DNA encoding the receptor, or targeted to cells through the administration of the purified protein. Preferably, the receptor is not otherwise found or expressed in the human patient. Preferably, the delivery of the receptor protein or the nucleic acid encoding the receptor results in transient delivery of the receptor protein or expression of the receptor in the target population of interest.

In step two, the AAV vector that exhibits selectively enhanced binding to, and transduction of, cells expressing the receptor is administered during the window of ectopic receptor expression. Preferably, the AAV vector is delivered to a patient through the intravascular route. However, the receptor-selective AAV can be delivered through any route that provides access to the cells expressing the receptor. Ideally the expression of Ly6a or Ly6c would be transient and the delivery of the AAV vector that transduces cells though binding to LY6A or LY6C1 would be delivered during the window of time that LY6A or LY6C is present within the target cell population of interest.

Figure 10:
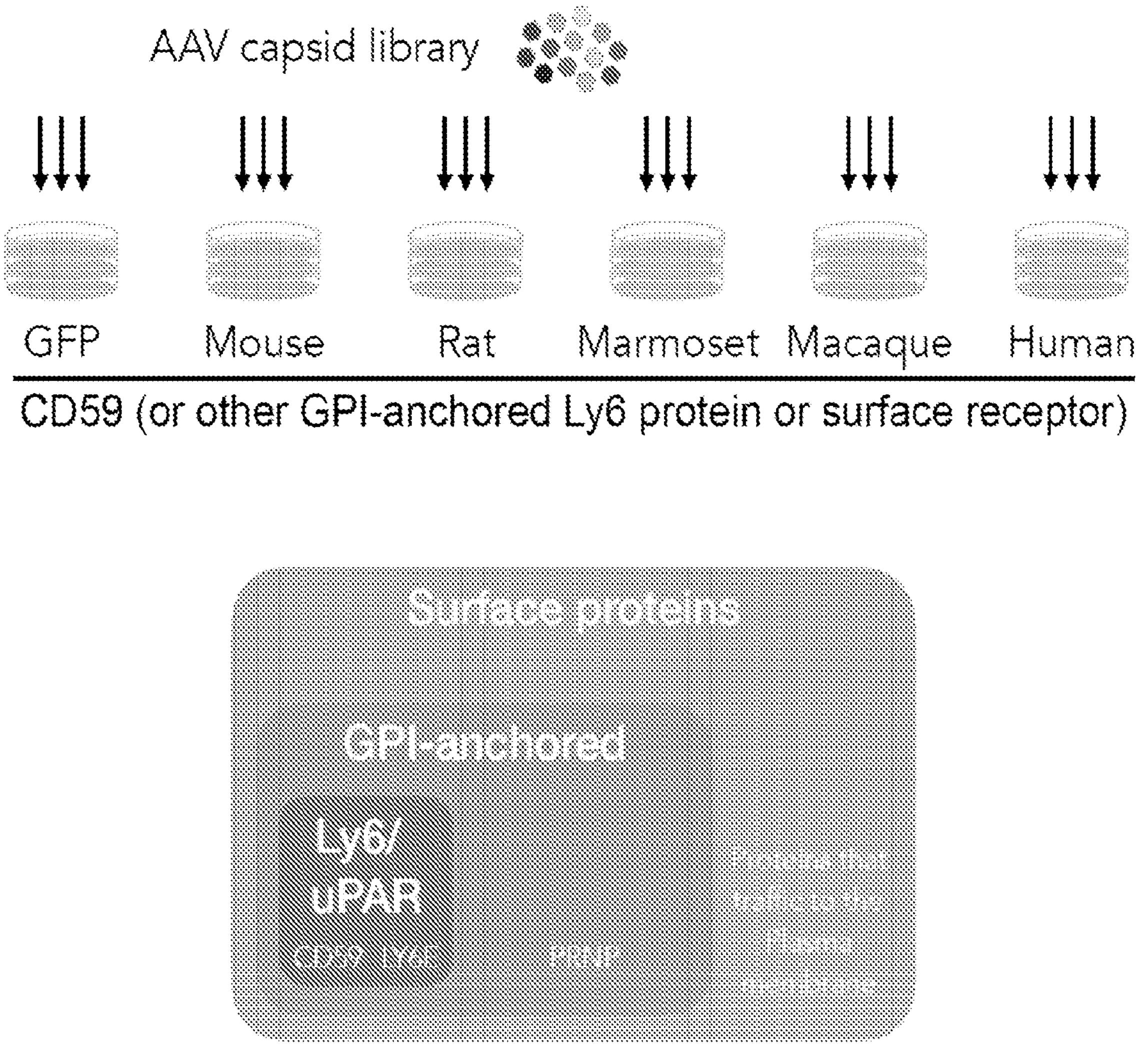
FIG. 10 shows a schematic depiction of a non-limiting example of a cell-based binding and transduction assay for high-throughput screening of capsid sequences that interact with specific target proteins.

Provided within are examples of receptor-modified AAV pairs that can be used for the above two-step delivery approach. Examples are provided of AAV capsids that have been screened for binding to and transduction of human cells that ectopically express mouse Ly6a (Tables 4, 9, 10) and Ly6c1 (Tables 5, 12, 13) or to purified LY6A-Fc or LY6C1-Fc proteins (Table 11 and 15, respectively). These receptors are attractive as ectopic AAV receptors for several reasons: (1) No homologs of these genes exist in humans or other primates. (2) These receptors are highly expressed on mouse CNS vasculature and have a demonstrated ability to efficiently transfer a subset of 7-mer modified AAVs across the vascular barrier (i.e., the BBB) and into the CNS where they can then transduce neurons and glia (Huang et al. 2019: FIG. 13). (3) These receptors can be ectopically expressed on human cells, and can be used as an assay to identify novel modified AAV capsids that selectively interact with these receptors (FIG. 10). It was found that many of these modified capsids mediate enhanced transduction of CNS vasculature and/or enhanced transduction of neural cells in the CNS after intravenous administration as demonstrated by their enrichment during in vivo Capsid mRNA-based screening assays (Table 10 and Table 14) and through the testing of the CNS tropism of individual variants (Table 6).

Example 12: Ectopic Ly6a or Ly6c1 Expression can be Used to Redirect the Tropism of Modified AAVs It was found that Ly6a expression in human HEK293T cells results in a >50-fold increase in binding by the AAV-PHP.B caspids (AAV-PHP.B, AAV-PHP.eB, AAV-PHP.B2 and AAV-PHP.B3) as compared to control cells not expressing Ly6a, but did not increase binding to the control AAV9 (Huang et al. (2019) BioRxiv, FIG. 3G). Importantly, it was also shown that ectopic expression of Ly6a in HEK293T cells enhanced the transduction by AAV-PHP.eB by 30-fold compared to cells lacking Ly6a.

To determine whether ectopic receptor expression can be used to render human endothelial cells more sensitive to transduction by viruses engineered to bind specific receptors, Ly6a, Ly6c1, or a control (mScarlet) was expressed in human hCMEC cells using a 7-mer modified AAV, AAV-BI-13, that efficiently transduces several human cultured cell types including hCMEC cells. The hCMEC cells expressing Ly6a, Ly6c1 or mScarlet were then exposed to AAV vectors that specifically interact with LY6A (represented by AAV-PHP.eB; Table 1-4) or LY6C1 (represented by AAV-BI-28; Tables 5-8). Expression of Ly6a or Ly6c1 made hCMEM cells approximately 2-logs (base 10) more sensitive to transduction by AAV-PHP.eB or AAV-BI-28, respectively. Importantly, the increased efficiency is highly specific—Ly6a expression selectively improved transduction by AAV-PHP.eB and Ly6c1 expression selectively improved transduction by AAV-BI-28. No increased transduction was observed for either vector in the cells expressing mScarlet.

Figure 11A:
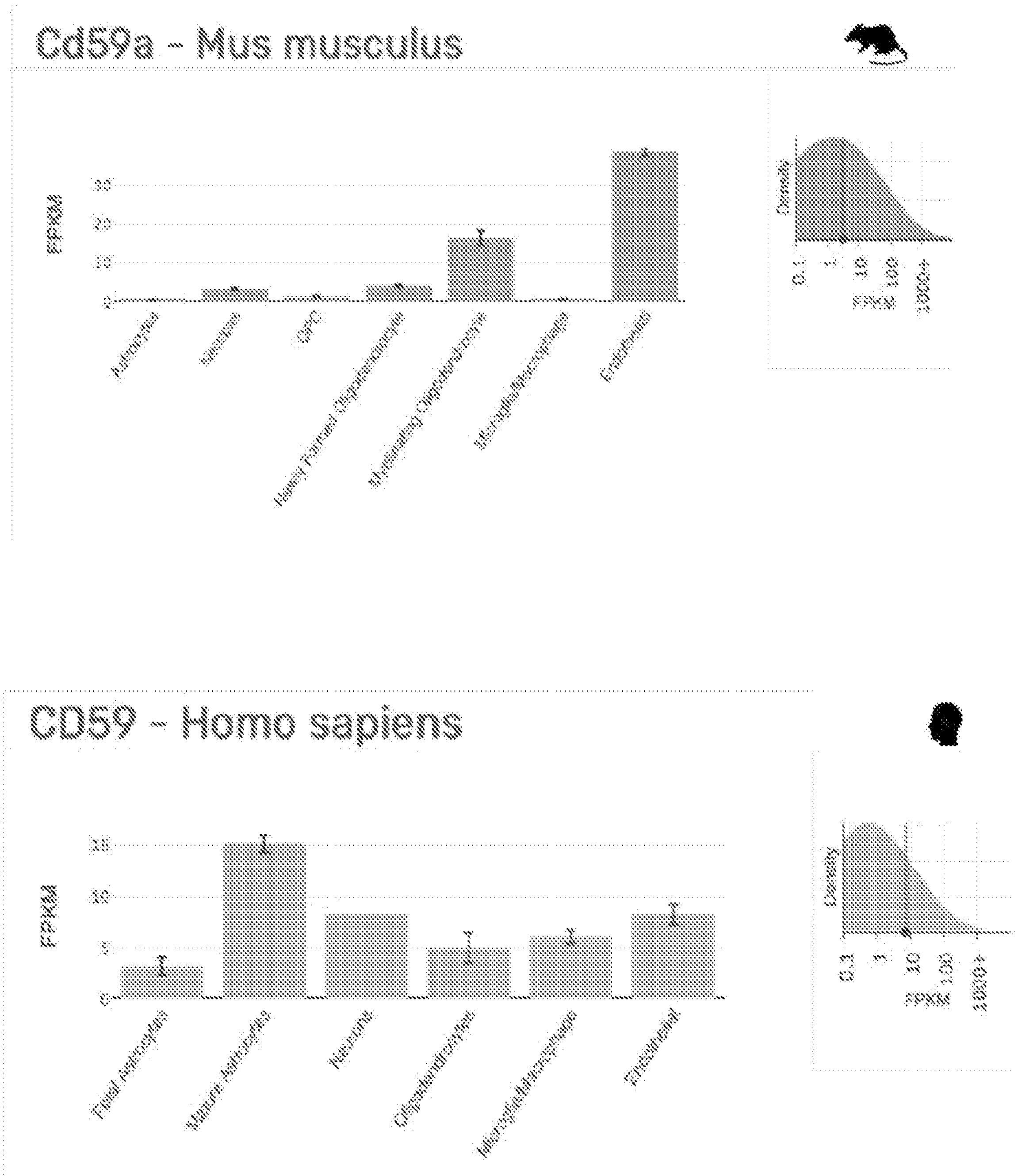
FIG. 11A shows data of CD59 expression from mouse (top) and human (below).
Figure 11B:
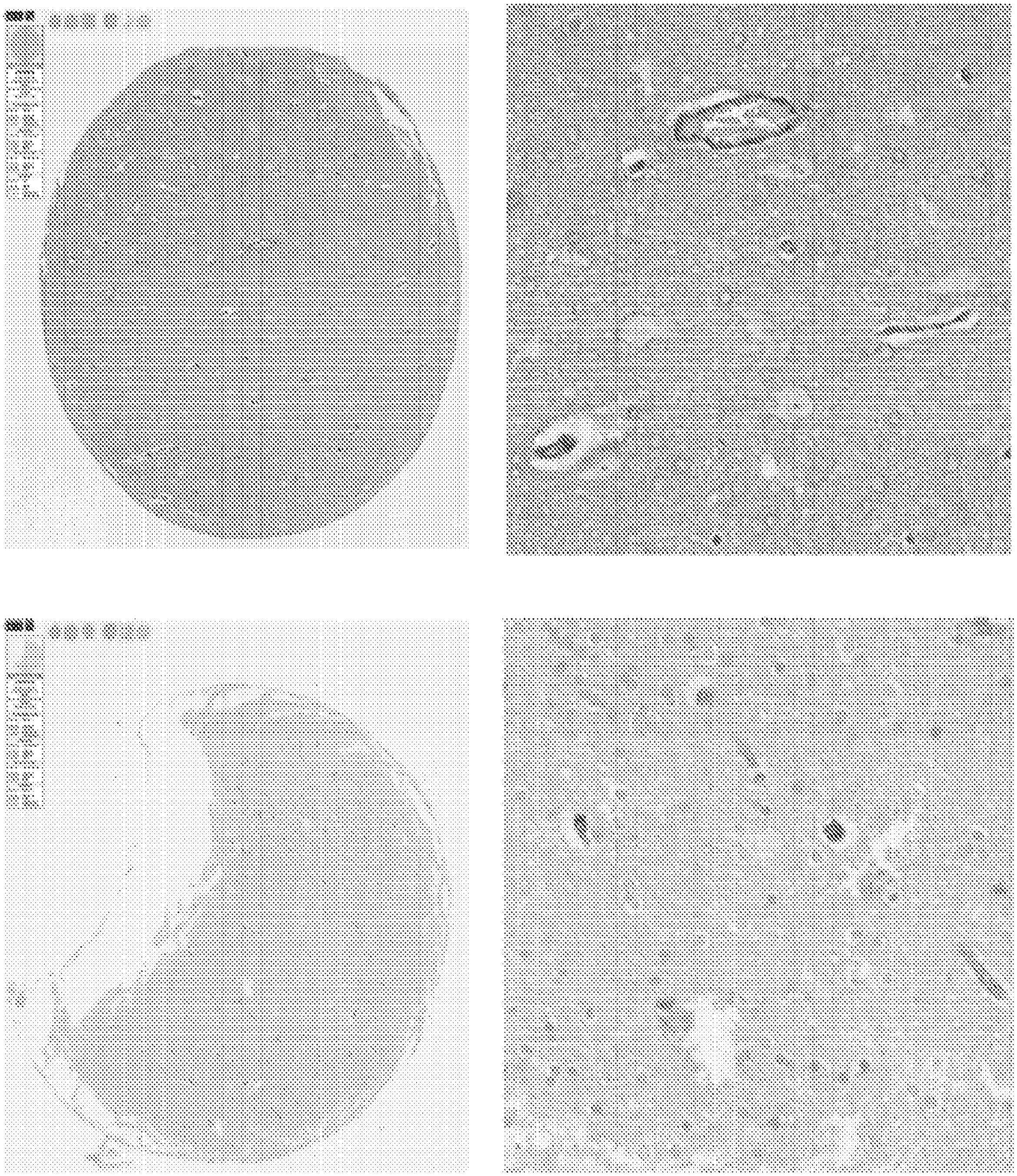
FIG. 11B shows data of CD59 expression on human brain vasculature.

Example 13: Identifying AAV Capsids that Target CD59, a LY6 Protein that is Conserved Between Mouse and Humans, and Expressed in CNS Endothelial Cells Using the in vitro binding assay, novel AAV capsids were identified that selectively bind cells overexpressing the human, marmoset, and/or mouse CD59 gene (FIG. 10 and Table 7) but not control cells expressing GFP. CD59 is a Ly6 family member that functions as a complement inhibitor and is expressed on brain vasculature. Brain RNA sequence data was obtained from Brain RNA-seq (www.BrainRNAseq.org) (FIG. 11A). CD59 tissue staining was obtained from Human Protein Atlas (www.proteinatlas.org) (FIG. 11B).

Example 14: The Use of AAV-PHP.B for Improved Efficiency of BBB Crossing Capabilities The development of AAV-PHP.B capsids provided proof-of-concept that AAV vectors with dramatically enhanced BBB crossing capabilities can be engineered, without a priori mechanistic knowledge [4,5]. AAV-PHP.B and AAV-PHP.eB are now widely used vectors for mouse neuroscience studies. However, the species-specific tropism of the AAV-PHP.B capsids reduces their appeal for human CNS gene therapy and highlights the shortcomings of performing selections and screens in model systems—the enhanced features of the identified capsids may not extend beyond the context (the genetic background) in which the selective pressure was applied. Accordingly, as compared to efforts in mice, selections in nonhuman primates (NHPs) are predicted to result in the identification of capsids whose enhanced features better translate to humans. Nonetheless, such efforts to develop clinically relevant vectors may likewise be thwarted by the identification of species- or model-specific capsids. Therefore, the pursuit of a vector that crosses the human BBB with AAV-PHP.eB-like efficiency gains will be aided by a mechanistic understanding of how naturally isolated and engineered capsids cross the BBB.

In the present disclosure, a single missense varian was rapidly identified tin Ly6a, out of a starting pool of millions of genetic variants, which segregates with efficient CNS transduction by AAV-PHP.eB. This was accomplished by first narrowing down candidates to genetic variants with a predicted high or medium impact and eliminating the bulk of the variants that did not segregate with the permissivity phenotype. This segregation study was achieved by leveraging Hail [26], the Mouse Genomes Project dataset [27], and 13 commercially available mouse lines; the code was implemented and run end-to-end on WGS data within hours, harnessing Hail's ability to scale computation across a large compute cluster, and the in vivo screening was completed in three weeks. The speed and small number of animals required for this approach is unprecedented compared to the conventional approaches of using diversity outbred lines or breeding generations of mice to determine the approximate genomic loci that segregates with a given phenotype.

After narrowing down the perfectly segregating genetic variants to two missense SNPs in two genes, molecular and biochemical studies were used to identify and validate Ly6a as the gene encoding the receptor for the AAV-PHP.B capsids. Because this approach was restricted to high and medium impact variants, the present disclosure does not rule out the possibility that other perfectly segregating noncoding variants present within Ly6a or other sites within the genome may contribute to the CNS transduction phenotype. In addition, it is possible that other genetic variants present in a subset of the nonpermissive strains within and surrounding Ly6a contribute to the nonpermissive phenotype. It is possible that one or more of these variants may influence Ly6a expression and contribute to the variation in LY6A levels and localization observed across nonpermissive strains.

The finding that Ly6a expression increases binding by the top three AAV-PHP.B variants, harboring unique peptide insertions (TLAVPFK, SVSKPFL, and FTLTTPK), identified using CREATE [5] suggests that LY6A has properties that make it an ideal receptor to engage for efficient transcytosis across the C57BL/6J BBB. Indeed, LY6A facilitates binding and transduction by AAV-PHP.eB in cells lacking either of the known AAV9 receptors, galactose and AAVR. Furthermore, ectopic expression of Ly6a is sufficient to render both human and hamster cells permissive to the enhanced binding and transduction of AAV-PHP.eB. Importantly, these findings demonstrate that AAVs can be engineered to utilize entirely new cell entry/transduction mechanisms rendering the novel capsids less dependent on interactions with the receptors that natural AAV serotypes rely on for transduction. Although there is no direct Ly6a homolog in primates, other cellular factors that share key properties with LY6A such as abundant luminal surface exposure on brain endothelium, localization within lipid micro-domains through GPI anchoring, or specific recycling/intracellular trafficking capabilities, may be prime molecular targets for gene delivery vectors in mice, NHPs, and humans. Notably, other LY6 proteins with homologs in primates are present within the CNS endothelium and can be explored and potentially harnessed for AAV capsid engineering. Developing capsids and/or other biologicals that target these receptors can open up new therapeutic avenues for treating a wide range of currently intractable neurological diseases.

```
Adeno-associated virus AAV9 capsid sequence
                                        (SEQ ID NO: 730)
MAADGYLPDWLEDNLSEGIREWWALKPGAPQPKANQQHQDNARGLVLPG

YKYLGPGNGLDKGEPVNAADAAALEHDKAYDQQLKAGDNPYLKYNHADA

EFQERLKEDTSFGGNLGRAVFQAKKRLLEPLGLVEEAAKTAPGKKRPVE

QSPQEPDSSAGIGKSGAQPAKKRLNFGQTGDTESVPDPQPIGEPPAAPS

GVGSLTMASGGGAPVADNNEGADGVGSSSGNWHCDSQWLGDRVIITSTR
```

-continued

```
IWALPTYNNHLYKQISNSTSGGSSNDNAYFGYSTPWGYFDFNRFHCHFS

PRDWQRLINNNWGFRPKRLNFKLFNIQVKEVTDNNGVKTIANNLTSTVQ

VFIDSDYQLPYVLGSAHEGCLPPFPADVFMIPQYGYLTLNDGSQAVGRS

SFYCLEYFPSQMLRTGNNFQFSYEFENVPFHSSYAHSQSLDRLMNPLID

QYLYYLSKTINGSGQNQQTLKFSVAGPSNMAVQGRNYIPGPSYRQQRVS

TIVTQNNNSEFAWPGASSWALNGRNSLMNPGPAMASHKEGEDRFFPLSG

SLIFGKQGTGRDNVDADKVMITNEEEIKTTNPVATESYGQVATNHQSAQ

AQAQTGWVQNQGILPGMVWQDRDVYLQGPIWAKIPHTDGNFHPSPLMGG

FGMKHPPPQILIKNIPVPADPPTAFNKDKLNSFITQYSTGQVSVEIEWE

LQKENSKRWNPEIQYTSNYYKSNNVEFAVNTEGVYSEPRPIGTRYLTRN

L
```

Adeno-associated virus AAV9 capsid sequence AAV9 K449R (SEQ ID NO: 731)

```
MAADGYLPDWLEDNLSEGIREWWALKPGAPQPKANQQHQDNARGLVLPG

YKYLGPGNGLDKGEPVNAADAAALEHDKAYDQQLKAGDNPYLKYNHADA

EFQERLKEDTSFGGNLGRAVFQAKKRLLEPLGLVEEAAKTAPGKKRPVE

QSPQEPDSSAGIGKSGAQPAKKRLNFGQTGDTESVPDPQPIGEPPAAPS

GVGSLTMASGGGAPVADNNEGADGVGSSSGNWHCDSQWLGDRVITTSTR

TWALPTYNNHLYKQISNSTSGGSSNDNAYFGYSTPWGYFDFNRFHCHFS

PRDWQRLINNNWGFRPKRLNFKLFNIQVKEVTDNNGVKTIANNLTSTVQ

VFTDSDYQLPYVLGSAHEGCLPPFPADVFMIPQYGYLTLNDGSQAVGRS

SFYCLEYFPSQMLRTGNNFQFSYEFENVPFHSSYAHSQSLDRLMNPLID

QYLYYLSRTINGSGQNQQTLKFSVAGPSNMAVQGRNYIPGPSYRQQRVS

TIVIQNNNSEFAWPGASSWALNGRNSLMNPGPAMASHKEGEDRFFPLSG

SLIFGKQGTGRDNVDADKVMITNEEEIKTTNPVATESYGQVATNHQSAQ

AQAQTGWVQNQGILPGMVWQDRDVYLQGPIWAKIPHTDGNFHPSPLMGG

FGMKHPPPQILIKNTPVPADPPTAFNKDKLNSFITQYSTGQVSVEIEWE

LQKENSKRWNPEIQYTSNYYKSNNVEFAVNTEGVYSEPRPIGTRYLTRN

L
```

REFERENCES

1. J. R. Mendell et al., Single-Dose Gene-Replacement Therapy for Spinal Muscular Atrophy. *N. Engl. J. Med.* 377, 1713-1722 (2017).
2. B. Ravina et al., Intraputaminal AADC gene therapy for advanced Parkinson's disease: interim results of a phase 1b Trial [abstract]. *Human Gene Therapy.* 28, A6 (Dec. 1, 2017).
3. A. C. Nathwani, A. M. Davidoff, E. G. D. Tuddenham, Advances in Gene Therapy for Hemophilia. *Hum. Gene Ther.* 28, 1004-1012 (2017).
4. K. Y. Chan et al., Engineered AAVs for efficient noninvasive gene delivery to the central and peripheral nervous systems. *Nat. Neurosci.* 20, 1172-1179 (2017).
5. B. E. Deverman et al., Cre-dependent selection yields AAV variants for widespread gene transfer to the adult brain. *Nat. Biotechnol.* 34, 204-209 (2016).
6. O. J. Müller et al., Random peptide libraries displayed on adeno-associated virus to select for targeted gene therapy vectors. *Nat. Biotechnol.* 21, 1040-1046 (2003).
7. D. S. Ojala et al., In Vivo Selection of a Computationally Designed SCHEMA AAV Library Yields a Novel Variant for Infection of Adult Neural Stem Cells in the SVZ. *Mol. Ther.* 26, 304-319 (2018).
8. D. G. R. Tervo et al., A Designer AAV Variant Permits Efficient Retrograde Access to Projection Neurons. *Neuron.* 92, 372-382 (2016).
9. M. A Kotterman, D. V. Schaffer, Engineered AAV vectors for improved central nervous system gene delivery. *Neurogenesis.* 2, e1122700 (2015).
10. K. J. D. A. Excoffon et al., Directed evolution of adeno-associated virus to an infectious respiratory virus. *Proc. Natl. Acad. Sci. U.S.A* 106, 3865-3870 (2009).
11. D. Dalkara et al., In vivo-directed evolution of a new adeno-associated virus for therapeutic outer retinal gene delivery from the vitreous. *Sci. Transl. Med.* 5, 189ra76 (2013).
12. L. Lisowski et al., Selection and evaluation of clinically relevant AAV variants in a xenograft liver model. *Nature.* 506, 382-386 (2014).
13. J. Körbelin et al., A brain microvasculature endothelial cell-specific viral vector with the potential to treat neurovascular and neurological diseases. *EMBO Mol. Med.* 8, 609-625 (2016).
14. M. Zelikowsky et al., The Neuropeptide Tac2 Controls a Distributed Brain State Induced by Chronic Social Isolation Stress. *Cell.* 173, 1265-1279.e19 (2018).
15. D. Hillier et al., Causal evidence for retina-dependent and -independent visual motion computations in mouse cortex. *Nat. Neurosci.* 20, 960-968 (2017).
16. A. L. Gibson et al., Adeno-Associated Viral Gene Therapy Using PHP.B:NPC1 Ameliorates Disease Phenotype in Mouse Model of Niemann-Pick C1 Disease (conference paper). American Society of Gene and Cell Therapy Annual Meeting. Washington, DC, USA. (May 10-13, 2017).
17. Y. Gao, L. Geng, V. P. Chen, S. Brimijoin, Therapeutic Delivery of Butyrylcholinesterase by Brain-Wide Viral Gene Transfer to Mice. *Molecules.* 22 (2017), doi: 10.3390/molecules22071145.
18. G. Morabito et al., AAV-PHP.B-Mediated Global-Scale Expression in the Mouse Nervous System Enables GBA1 Gene Therapy for Wide Protection from Synucleinopathy. *Mol. Ther.* 25, 2727-2742 (2017).
19. R. D. Dayton, M. S. Grames, R. L. Klein, More expansive gene transfer to the rat CNS: AAV PHP.EB vector dose-response and comparison to AAV PHP.B. *Gene Ther.* 25, 392-400 (2018).
20. K. L. Jackson, R. D. Dayton, B. E. Deverman, R. L. Klein, Better Targeting, Better Efficiency for Wide-Scale Neuronal Transduction with the Synapsin Promoter and AAV-PHP.B. *Front. Mol. Neurosci.* 9, 116 (2016).
21. J. Hordeaux et al., The Neurotropic Properties of AAV-PHP.B Are Limited to C57BL/6J Mice. *Mol. Ther.* 26, 664-668 (2018).
22. Y. Matsuzaki et al., Intravenous administration of the adeno-associated virus-PHP.B capsid fails to upregulate transduction efficiency in the marmoset brain. *Neurosci. Lett.* 665, 182-188 (2018).
23. Sah, D., Safety and Increased Transduction Efficiency in the Adult Nonhuman Primate Central Nervous System with Intravenous Delivery of Two Novel Adeno-Associated Virus Capsids [abstract O661]. American Society of Gene and Cell Therapy Annual Meeting. Chicago, IL, USA. *Molecular Therapy*. (May 16-19, 2018).
24. C. N. Bedbrook, B. E. Deverman, V. Gradinaru, Viral Strategies for Targeting the Central and Peripheral Nervous Systems. *Annu. Rev. Neurosci.* 41, 323-348 (2018).
25. W. E. Allen et al., Global Representations of Goal-Directed Behavior in Distinct Cell Types of Mouse Neocortex. *Neuron.* 94, 891-907.e6 (2017).
26. Hail, (available at github.com/hail-is/hail).
27. T. M. Keane et al., Mouse genomic variation and its effect on phenotypes and gene regulation. *Nature.* 477, 289-294 (2011).
28. B. Yalcin et al., Sequence-based characterization of structural variation in the mouse genome. *Nature.* 477, 326-329 (2011).
29. Y. Zhang et al., An RNA-sequencing transcriptome and splicing database of glia, neurons, and vascular cells of the cerebral cortex. *J. Neurosci.* 34, 11929-11947 (2014).
30. K. R. Spindler et al., The major locus for mouse adenovirus susceptibility maps to genes of the hematopoietic cell surface-expressed LY6 family *J. Immunol.* 184, 3055-3062 (2010).
31. J. D. Guida, G. Fejer, L. A. Pirofski, C. F. Brosnan, M. S. Horwitz, Mouse adenovirus type 1 causes a fatal hemorrhagic encephalomyelitis in adult C57BL/6 but not BALB/c mice. *J. Virol.* 69, 7674-7681(1995).
32. C. Loeuillet et al., In vitro whole-genome analysis identifies a susceptibility locus for HIV-1. *PLoS Biol.* 6, e32 (2008).
33. A. L. Brass et al., Identification of host proteins required for HIV infection through a functional genomic screen. *Science.* 319, 921-926 (2008).
34. M. N. Krishnan et al., RNA interference screen for human genes associated with West Nile virus infection. *Nature.* 455, 242-245 (2008).
35. K. B. Mar et al., LY6E mediates an evolutionarily conserved enhancement of virus infection by targeting a late entry step. *Nat. Commun.* 9, 3603 (2018).
36. H.-C. Liu, M. Niikura, J. E. Fulton, H. H. Cheng, Identification of chicken lymphocyte antigen 6 complex, locus E (LY6E, alias SCA2) as a putative Marek's disease resistance gene via a virus-host protein interaction screen. *Cytogenet. Genome Res.* 102, 304-308 (2003).
37. C. Cray, R. W. Keane, T. R. Malek, R. B. Levy, Regulation and selective expression of Ly-6A/E, a lymphocyte activation molecule, in the central nervous system. *Molecular Brain Research.* 8, 9-15 (1990).
38. M. van de Rijn, S. Heimfeld, G. J. Spangrude, I. L. Weissman, Mouse hematopoietic stem-cell antigen Sca-1 is a member of the Ly-6 antigen family. *Proc. Natl. Acad. Sci. U.S.A.* 86, 4634-4638 (1989).
39. F. A. Ran et al. In vivo genome editing using *Staphylococcus aureus* Cas9. *Nature.* 520, 186-191 (2015).
40. C. Summerford, J. S. Johnson, R. J. Samulski, AAVR: A Multi-Serotype Receptor for AAV. *Mol. Ther.* 24, 663-666 (2016).
41. M. Kikkert et al., Binding of Tomato Spotted Wilt Virus to a 94-kDa Thrips Protein. *Phytopathology.* 88, 63-69 (1998).
42. S. Pillay et al., AAV serotypes have distinctive interactions with domains of the cellular receptor AAVR. *J. Virol.* (2017), doi:10.1128/JVI.00391-17.
43. A. Pierleoni, P. L. Martelli, R. Casadio, PredGPI: a GPI-anchor predictor. *BMC Bioinformatics.* 9, 392 (2008).
44. L.-Y. Huang, S. Halder, M. Agbandje-McKenna, Parvovirus glycan interactions. *Curr. Opin.* Virol. 7, 108-118 (2014).
45. S. Shen, K. D. Bryant, S. M. Brown, S. H. Randell, A. Asokan, Terminal N-Linked Galactose Is the Primary Receptor for Adeno-associated Virus 9. *J. Biol. Chem.* 286, 13532-13540 (2011).
46. C. L. Bell, B. L. Gurda, K. Van Vliet, M. Agbandje-McKenna, J. M. Wilson, Identification of the galactose binding domain of the adeno-associated virus serotype 9 capsid. *J. Virol.* 86, 7326-7333 (2012).
47. S. Pillay et al., An essential receptor for adeno-associated virus infection. *Nature.* 530, 108-112 (2016).
48. S. L. Deutscher, C. B. Hirschberg, Mechanism of galactosylation in the Golgi apparatus. A Chinese hamster ovary cell mutant deficient in translocation of UDP-galactose across Golgi vesicle membranes. *J. Biol. Chem.* 261, 96-100 (1986).

EQUIVALENTS AND SCOPE

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the invention encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should it be understood that, in general, where the invention, or aspects of the invention, is/are referred to as comprising particular elements and/or features, certain embodiments of the invention or aspects of the invention consist, or consist essentially of, such elements and/or features. For purposes of simplicity, those embodiments have not been specifically set forth in haec verba herein. It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control.

In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended claims. Those of ordinary skill in the art will appreciate that various changes and modifications to this description may be made without departing from the spirit or scope of the present invention, as defined in the following claims.

Lengthy table referenced here

US12773462-20261027-T00001

Please refer to the end of the specification for access instructions.

Lengthy table referenced here

US12773462-20261027-T00002

Please refer to the end of the specification for access instructions.

Lengthy table referenced here

US12773462-20261027-T00003

Please refer to the end of the specification for access instructions.

Lengthy table referenced here

US12773462-20261027-T00004

Please refer to the end of the specification for access instructions.

Lengthy table referenced here

US12773462-20261027-T00005

Please refer to the end of the specification for access instructions.

Lengthy table referenced here

US12773462-20261027-T00006

Please refer to the end of the specification for access instructions.

Lengthy table referenced here

US12773462-20261027-T00007

Please refer to the end of the specification for access instructions.

Lengthy table referenced here

US12773462-20261027-T00008

Please refer to the end of the specification for access instructions.

Lengthy table referenced here

US12773462-20261027-T00009

Please refer to the end of the specification for access instructions.

Lengthy table referenced here

US12773462-20261027-T00010

Please refer to the end of the specification for access instructions.

Lengthy table referenced here

US12773462-20261027-T00011

Please refer to the end of the specification for access instructions.

Lengthy table referenced here

US12773462-20261027-T00012

Please refer to the end of the specification for access instructions.

Lengthy table referenced here

US12773462-20261027-T00013

Please refer to the end of the specification for access instructions.

LENGTHY TABLES

The patent contains a lengthy table section. A copy of the table is available in electronic form from the USPTO web site (https://seqdata.uspto.gov/docdetail?docId=US12773462B2). An electronic copy of the table will also be available from the USPTO upon request and payment of the fee set forth in 37 CFR 1.19(b)(3).

SEQUENCE LISTING (30283 sequences)

SEQ ID NO: 1 - DNA, 65 bp, Artificial Sequence
  Synthetic
cttgtggaaaggacgaaacaccgaattacctgcccctaccctgagttttagtactctggaaacag

SEQ ID NO: 2 - DNA, 65 bp, Artificial Sequence
  Synthetic
cttgtggaaaggacgaaacaccgctttcaatattaggagggcaggttttagtactctggaaacag

SEQ ID NO: 3 - DNA, 65 bp, Artificial Sequence
  Synthetic
cttgtggaaaggacgaaacaccgaatattgaaagtatggagatcgttttagtactctggaaacag

SEQ ID NO: 4 - DNA, 65 bp, Artificial Sequence
  Synthetic
cttgtggaaaggacgaaacaccgactgcagtgctacgagtgctagttttagtactctggaaacag

SEQ ID NO: 5 - DNA, 65 bp, Artificial Sequence
  Synthetic
cttgtggaaaggacgaaacaccgcagttacctgccgcgcctctggttttagtactctggaaacag

SEQ ID NO: 6 - DNA, 65 bp, Artificial Sequence
  Synthetic
cttgtggaaaggacgaaacaccggattctgcattgctcaaaacagttttagtactctggaaacag

SEQ ID NO: 7 - DNA, 21 bp, Artificial Sequence
  Synthetic
taccccgaccacatgaagcag

SEQ ID NO: 8 - DNA, 22 bp, Artificial Sequence
  Synthetic
cttgtagttgccgtcgtccttg

SEQ ID NO: 9 - DNA, 23 bp, Artificial Sequence
  Synthetic
aagggacctttaccagtgatgtg

SEQ ID NO: 10 - DNA, 21 bp, Artificial Sequence
  Synthetic
acttactctcgccttcctcgg

SEQ ID NO: 11 - DNA, 22 bp, Artificial Sequence
  Synthetic
atgctgaagggacctttaccag

SEQ ID NO: 12 - DNA, 21 bp, Artificial Sequence
  Synthetic
acttactctcgccttcctcgg

SEQ ID NO: 13 - DNA, 22 bp, Artificial Sequence
  Synthetic
atgctgaagggacctttaccag

SEQ ID NO: 14 - DNA, 19 bp, Artificial Sequence
  Synthetic
ctcgccttcctctgccttt

SEQ ID NO: 15 - protein, 134 aa, Artificial Sequence
  Synthetic
MDTSHTTKSCLLILLVALLCAERAQGLECYQCYGVPFETSCPSITCPYPDGVCVTQEAAVIVDSQTRKVKNNLCLPICPPNIESMEILGTKVNVKTSCCQEDLCNVAVPNGGSTWTMAGVLLFSLSSVLLQTLL

SEQ ID NO: 16 - protein, 134 aa, Artificial Sequence
  Synthetic
MDTSHTTKSCVLILLVALLCAERAQGLECYQCYGVPFETSCPSITCPYPDGVCVTQEAAVIVDSQTRKVKNNLCLPICPPNIESMEILGTKVNVKTSCCQEDLCNAAVPNGGSTWTMAGVLLFSLSSVLLQTLL

SEQ ID NO: 17 - protein, 134 aa, Artificial Sequence
  Synthetic
MDTSHTTKSCLLILLVALLCAERAQGLECYQCYGVPFETSCPSITCPYPDGVCVTQEAAVIVGSQTRKVKNNLCLPICPPNIESMEILGTKVNVKTSCCQEDLCNAAVPNGGSTWTMAGVLLFSLSSVLLQTLL

SEQ ID NO: 18 - protein, 131 aa, Artificial Sequence
  Synthetic
MDTSHTTKSCVLILLVALLCAERAQGLQCYECYGVPIETSCPAVTCRASDGFCIAQNIELIEDSQRRKLKTRQCLSFCPAGVPIRDPNIRERTSCCSEDLCNAAVPTAGSTWTMAGVLLFSLSSVVLQTLL

SEQ ID NO: 19 - protein, 136 aa, Artificial Sequence
  Synthetic
MSATSNMRVFLPVLLAALLGMEQVHSLMCFSCTDQKNNINCLWPVSCQEKDHYCITLSAAAGFGNVNLGYTLNKGCSPICPSENVNLNLGVASVNSYCCQSSFCNFSAAGLGLRASIPLLGLGLLLSLLALLQLSP

SEQ ID NO: 20 - protein, 7 aa, Artificial Sequence
  Synthetic
VAERPFK

SEQ ID NO: 21 - protein, 7 aa, Artificial Sequence
  Synthetic
TVMAPFK

SEQ ID NO: 22 - protein, 7 aa, Artificial Sequence
  Synthetic
YVGNPFK

SEQ ID NO: 23 - protein, 7 aa, Artificial Sequence
  Synthetic
DMERPFK

SEQ ID NO: 24 - protein, 7 aa, Artificial Sequence
  Synthetic
RIDNPFK

SEQ ID NO: 25 - protein, 7 aa, Artificial Sequence
  Synthetic
TRDLPFK

SEQ ID NO: 26 - protein, 7 aa, Artificial Sequence
  Synthetic
ALHVPFK

SEQ ID NO: 27 - protein, 7 aa, Artificial Sequence
  Synthetic
TLAYPFK

SEQ ID NO: 28 - protein, 7 aa, Artificial Sequence
  Synthetic
GVDRPFK

SEQ ID NO: 29 - protein, 7 aa, Artificial Sequence
  Synthetic
SLTTPFK

SEQ ID NO: 30 - protein, 7 aa, Artificial Sequence
  Synthetic
ESTRPFK

SEQ ID NO: 31 - protein, 7 aa, Artificial Sequence
  Synthetic
GDNRPFK

SEQ ID NO: 32 - protein, 7 aa, Artificial Sequence
  Synthetic
AISAPFK

SEQ ID NO: 33 - protein, 7 aa, Artificial Sequence
  Synthetic
TGTSPFK

SEQ ID NO: 34 - DNA, 21 bp, Artificial Sequence
  Synthetic
gtggctgagcgtccttttaag

SEQ ID NO: 35 - DNA, 21 bp, Artificial Sequence
  Synthetic
acggtgatggcgccgtttaag

SEQ ID NO: 36 - DNA, 21 bp, Artificial Sequence
  Synthetic
tatgtggggaatccttttaag

SEQ ID NO: 37 - DNA, 21 bp, Artificial Sequence
  Synthetic
gatatggagcgtccgtttaag

SEQ ID NO: 38 - DNA, 21 bp, Artificial Sequence
  Synthetic
aggattgataatccttttaag

SEQ ID NO: 39 - DNA, 21 bp, Artificial Sequence
  Synthetic
acgagggatctgccttttaag

SEQ ID NO: 40 - DNA, 21 bp, Artificial Sequence
  Synthetic
gctttgcatgttccttttaag

SEQ ID NO: 41 - DNA, 21 bp, Artificial Sequence
  Synthetic
acgctggcgtatccgtttaag

SEQ ID NO: 42 - DNA, 21 bp, Artificial Sequence
  Synthetic
ggtgttgatcggccgtttaag

SEQ ID NO: 43 - DNA, 21 bp, Artificial Sequence
  Synthetic
agtttgacgacgccgtttaag

SEQ ID NO: 44 - DNA, 21 bp, Artificial Sequence
  Synthetic
gagtctactaggccgtttaag

SEQ ID NO: 45 - DNA, 21 bp, Artificial Sequence
  Synthetic
ggggataataggccgtttaag

SEQ ID NO: 46 - DNA, 21 bp, Artificial Sequence
  Synthetic
gctattagtgcgccttttaag

SEQ ID NO: 47 - DNA, 21 bp, Artificial Sequence
  Synthetic
actgggacttcgccgtttaag

SEQ ID NO: 48 - protein, 7 aa, Artificial Sequence
  Synthetic
SNDRPFI

SEQ ID NO: 49 - protein, 7 aa, Artificial Sequence
  Synthetic
SHTKPFA

SEQ ID NO: 50 - protein, 7 aa, Artificial Sequence
  Synthetic
SINKPFV

SEQ ID NO: 51 - protein, 7 aa, Artificial Sequence
  Synthetic
DKQKPFL

SEQ ID NO: 52 - protein, 7 aa, Artificial Sequence
  Synthetic
MMAKPFL

SEQ ID NO: 53 - protein, 7 aa, Artificial Sequence
  Synthetic
NERRPFL

SEQ ID NO: 54 - protein, 7 aa, Artificial Sequence
  Synthetic
TDTRPFI

SEQ ID NO: 55 - protein, 7 aa, Artificial Sequence
  Synthetic
SQKTPFL

SEQ ID NO: 56 - protein, 7 aa, Artificial Sequence
  Synthetic
GSERPFL

SEQ ID NO: 57 - protein, 7 aa, Artificial Sequence
  Synthetic
TSMKPFL

SEQ ID NO: 58 - protein, 7 aa, Artificial Sequence
  Synthetic
GESRPFI

SEQ ID NO: 59 - protein, 7 aa, Artificial Sequence
  Synthetic
NDQRPFL

SEQ ID NO: 60 - protein, 7 aa, Artificial Sequence
  Synthetic
AADRPFL

SEQ ID NO: 61 - protein, 7 aa, Artificial Sequence
  Synthetic
DSQRPFI

SEQ ID NO: 62 - protein, 7 aa, Artificial Sequence
  Synthetic
ALAKPFI

SEQ ID NO: 63 - protein, 7 aa, Artificial Sequence
  Synthetic
SEGRPFI

SEQ ID NO: 64 - protein, 7 aa, Artificial Sequence
  Synthetic
ASSKPFL

SEQ ID NO: 65 - protein, 7 aa, Artificial Sequence
  Synthetic
SIARPFV

SEQ ID NO: 66 - protein, 7 aa, Artificial Sequence
  Synthetic
NIIRPFA

SEQ ID NO: 67 - protein, 7 aa, Artificial Sequence
  Synthetic
ESSKPFR

SEQ ID NO: 68 - protein, 7 aa, Artificial Sequence
  Synthetic
TSFKPFP

SEQ ID NO: 69 - protein, 7 aa, Artificial Sequence
  Synthetic
NMERPFR

SEQ ID NO: 70 - protein, 7 aa, Artificial Sequence
  Synthetic
TTMKPFN

SEQ ID NO: 71 - protein, 7 aa, Artificial Sequence
  Synthetic
NLKRPFA

SEQ ID NO: 72 - protein, 7 aa, Artificial Sequence
  Synthetic
SVSKPFS

SEQ ID NO: 73 - protein, 7 aa, Artificial Sequence
  Synthetic
SSEKPFQ

SEQ ID NO: 74 - protein, 7 aa, Artificial Sequence
  Synthetic
TKSTPFI

SEQ ID NO: 75 - protein, 7 aa, Artificial Sequence
  Synthetic
YENRPFV

SEQ ID NO: 76 - protein, 7 aa, Artificial Sequence
  Synthetic
SLSKPFS

SEQ ID NO: 77 - protein, 7 aa, Artificial Sequence
  Synthetic
QNARPFV

SEQ ID NO: 78 - DNA, 21 bp, Artificial Sequence
  Synthetic
agtaatgatcgtccttttatt

SEQ ID NO: 79 - DNA, 21 bp, Artificial Sequence
  Synthetic
agtcatacgaagccgtttgct

SEQ ID NO: 80 - DNA, 21 bp, Artificial Sequence
  Synthetic
tcgattaataagccttttgtt

SEQ ID NO: 81 - DNA, 21 bp, Artificial Sequence
  Synthetic
gataagcagaagccgtttctg

SEQ ID NO: 82 - DNA, 21 bp, Artificial Sequence
  Synthetic
atgatggctaagccttttctt

SEQ ID NO: 83 - DNA, 21 bp, Artificial Sequence
  Synthetic
aatgagcgtaggccttttctg

SEQ ID NO: 84 - DNA, 21 bp, Artificial Sequence
  Synthetic
actgatactaggccttttatt

SEQ ID NO: 85 - DNA, 21 bp, Artificial Sequence
  Synthetic
agtcagaagactccgtttctg

SEQ ID NO: 86 - DNA, 21 bp, Artificial Sequence
  Synthetic
ggttctgagaggccgtttttg

SEQ ID NO: 87 - DNA, 21 bp, Artificial Sequence
  Synthetic
acgagtatgaagccttttctg

SEQ ID NO: 88 - DNA, 21 bp, Artificial Sequence
  Synthetic
ggtgagtctcgtccttttatt

SEQ ID NO: 89 - DNA, 21 bp, Artificial Sequence
  Synthetic
aatgatcagcggccttttctg

SEQ ID NO: 90 - DNA, 21 bp, Artificial Sequence
  Synthetic
gctgctgatcgtccgtttctg

SEQ ID NO: 91 - DNA, 21 bp, Artificial Sequence
  Synthetic
gatagtcagcgtccgtttatt

SEQ ID NO: 92 - DNA, 21 bp, Artificial Sequence
  Synthetic
gctcttgctaagccttttatt

SEQ ID NO: 93 - DNA, 21 bp, Artificial Sequence
  Synthetic
tcggaggggaggccttttatt

SEQ ID NO: 94 - DNA, 21 bp, Artificial Sequence
  Synthetic
gcgtctagtaagccgtttctt

SEQ ID NO: 95 - DNA, 21 bp, Artificial Sequence
  Synthetic
agtattgctcgtccgtttgtg

SEQ ID NO: 96 - DNA, 21 bp, Artificial Sequence
  Synthetic
aatattattcggccttttgct

SEQ ID NO: 97 - DNA, 21 bp, Artificial Sequence
  Synthetic
gagagtagtaagccgtttcgt

SEQ ID NO: 98 - DNA, 21 bp, Artificial Sequence
  Synthetic
acttcttttaagccgtttcct

SEQ ID NO: 99 - DNA, 21 bp, Artificial Sequence
  Synthetic
aatatggagcggccgtttagg

SEQ ID NO: 100 - DNA, 21 bp, Artificial Sequence
  Synthetic
acgacgatgaagccttttaat

SEQ ID NO: 101 - DNA, 21 bp, Artificial Sequence
  Synthetic
aatttgaagaggccgtttgct

SEQ ID NO: 102 - DNA, 21 bp, Artificial Sequence
  Synthetic
agtgtgtcgaagccttttagt

SEQ ID NO: 103 - DNA, 21 bp, Artificial Sequence
  Synthetic
agttcggagaagccgtttcag

SEQ ID NO: 104 - DNA, 21 bp, Artificial Sequence
  Synthetic
actaagtcgactccgtttatt

SEQ ID NO: 105 - DNA, 21 bp, Artificial Sequence
  Synthetic
tatgagaatcgtccttttgtg

SEQ ID NO: 106 - DNA, 21 bp, Artificial Sequence
  Synthetic
agtttgtcgaagccgttttct

SEQ ID NO: 107 - DNA, 21 bp, Artificial Sequence
  Synthetic
cagaatgctcgtccgtttgtg

SEQ ID NO: 108 - protein, 7 aa, Artificial Sequence
  Synthetic
TITFKDV

SEQ ID NO: 109 - protein, 7 aa, Artificial Sequence
  Synthetic
SLDFKNI

SEQ ID NO: 110 - protein, 7 aa, Artificial Sequence
  Synthetic
VAVFKNV

SEQ ID NO: 111 - protein, 7 aa, Artificial Sequence
  Synthetic
AGSFKDI

SEQ ID NO: 112 - protein, 7 aa, Artificial Sequence
  Synthetic
PPSFKNV

SEQ ID NO: 113 - protein, 7 aa, Artificial Sequence
  Synthetic
RSDFKDI

SEQ ID NO: 114 - protein, 7 aa, Artificial Sequence
  Synthetic
STTFKDI

SEQ ID NO: 115 - protein, 7 aa, Artificial Sequence
  Synthetic
KDKFKDI

SEQ ID NO: 116 - protein, 7 aa, Artificial Sequence
  Synthetic
QTLFKNI

SEQ ID NO: 117 - protein, 7 aa, Artificial Sequence
  Synthetic
RLSFKDV

SEQ ID NO: 118 - protein, 7 aa, Artificial Sequence
  Synthetic
HNVFKNP

SEQ ID NO: 119 - protein, 7 aa, Artificial Sequence
  Synthetic
KTQFKDV

SEQ ID NO: 120 - DNA, 21 bp, Artificial Sequence
  Synthetic
actattacgtttaaggatgtt

SEQ ID NO: 121 - DNA, 21 bp, Artificial Sequence
  Synthetic
agtcttgattttaagaatatt

SEQ ID NO: 122 - DNA, 21 bp, Artificial Sequence
  Synthetic
gtggctgtgtttaagaatgtg

SEQ ID NO: 123 - DNA, 21 bp, Artificial Sequence
  Synthetic
gctggttcgtttaaggatatt

SEQ ID NO: 124 - DNA, 21 bp, Artificial Sequence
  Synthetic
cctccgagttttaagaatgtg

SEQ ID NO: 125 - DNA, 21 bp, Artificial Sequence
  Synthetic
cggagtgattttaaggatatt

SEQ ID NO: 126 - DNA, 21 bp, Artificial Sequence
  Synthetic
agtactacttttaaggatatt

SEQ ID NO: 127 - DNA, 21 bp, Artificial Sequence
  Synthetic
aaggataagtttaaggatatt

SEQ ID NO: 128 - DNA, 21 bp, Artificial Sequence
  Synthetic
cagacgttgtttaagaatatt

SEQ ID NO: 129 - DNA, 21 bp, Artificial Sequence
  Synthetic
cggcttagttttaaggatgtg

SEQ ID NO: 130 - DNA, 21 bp, Artificial Sequence
  Synthetic
cataatgtgtttaagaatcct

SEQ ID NO: 131 - DNA, 21 bp, Artificial Sequence
  Synthetic
aagacgcagtttaaggatgtg

SEQ ID NO: 132 - protein, 7 aa, Artificial Sequence
  Synthetic
VRPGWST

SEQ ID NO: 133 - protein, 7 aa, Artificial Sequence
  Synthetic
TQQGYSS

SEQ ID NO: 134 - protein, 7 aa, Artificial Sequence
  Synthetic
TKSGYST

SEQ ID NO: 135 - protein, 7 aa, Artificial Sequence
  Synthetic
TRNGYST

SEQ ID NO: 136 - protein, 7 aa, Artificial Sequence
  Synthetic
IDRGYSV

SEQ ID NO: 137 - protein, 7 aa, Artificial Sequence
  Synthetic
PYQGASS

SEQ ID NO: 138 - protein, 7 aa, Artificial Sequence
  Synthetic
SYQGYSS

SEQ ID NO: 139 - protein, 7 aa, Artificial Sequence
  Synthetic
VNRGYSS

SEQ ID NO: 140 - protein, 7 aa, Artificial Sequence
  Synthetic
LRTAYSS

SEQ ID NO: 141 - protein, 7 aa, Artificial Sequence
  Synthetic
SYIGASS

SEQ ID NO: 142 - protein, 7 aa, Artificial Sequence
  Synthetic
NGYKGST

SEQ ID NO: 143 - protein, 7 aa, Artificial Sequence
  Synthetic
EIRGYSS

SEQ ID NO: 144 - protein, 7 aa, Artificial Sequence
  Synthetic
DVKYGSS

SEQ ID NO: 145 - protein, 7 aa, Artificial Sequence
  Synthetic
GGRGLSS

SEQ ID NO: 146 - protein, 7 aa, Artificial Sequence
  Synthetic
FRIGGSS

SEQ ID NO: 147 - protein, 7 aa, Artificial Sequence
  Synthetic
LKYGTST

SEQ ID NO: 148 - protein, 7 aa, Artificial Sequence
  Synthetic
KQYQGST

SEQ ID NO: 149 - protein, 7 aa, Artificial Sequence
  Synthetic
NYTGYSS

SEQ ID NO: 150 - protein, 7 aa, Artificial Sequence
  Synthetic
RATGYSS

SEQ ID NO: 151 - protein, 7 aa, Artificial Sequence
  Synthetic
ESRGFSS

SEQ ID NO: 152 - protein, 7 aa, Artificial Sequence
  Synthetic
QHFGQSS

SEQ ID NO: 153 - protein, 7 aa, Artificial Sequence
  Synthetic
TRTGYST

SEQ ID NO: 154 - protein, 7 aa, Artificial Sequence
  Synthetic
AKAGYAS

SEQ ID NO: 155 - protein, 7 aa, Artificial Sequence
  Synthetic
NRGGYAS

SEQ ID NO: 156 - protein, 7 aa, Artificial Sequence
  Synthetic
SIYLGSQ

SEQ ID NO: 157 - protein, 7 aa, Artificial Sequence
  Synthetic
YLKGYSA

SEQ ID NO: 158 - protein, 7 aa, Artificial Sequence
  Synthetic
EKKQYSS

SEQ ID NO: 159 - protein, 7 aa, Artificial Sequence
  Synthetic
NYTGYSS

SEQ ID NO: 160 - protein, 7 aa, Artificial Sequence
  Synthetic
SKTGYST

SEQ ID NO: 161 - protein, 7 aa, Artificial Sequence
  Synthetic
TEKWTSS

SEQ ID NO: 162 - protein, 7 aa, Artificial Sequence
  Synthetic
DRIHGYS

SEQ ID NO: 163 - protein, 7 aa, Artificial Sequence
  Synthetic
TRFGAST

SEQ ID NO: 164 - protein, 7 aa, Artificial Sequence
  Synthetic
GKHFSST

SEQ ID NO: 165 - protein, 7 aa, Artificial Sequence
  Synthetic
TKYMHSS

SEQ ID NO: 166 - protein, 7 aa, Artificial Sequence
  Synthetic
VKVGFSS

SEQ ID NO: 167 - protein, 7 aa, Artificial Sequence
  Synthetic
LRMGASS

SEQ ID NO: 168 - protein, 7 aa, Artificial Sequence
  Synthetic
LNRGSST

SEQ ID NO: 169 - protein, 7 aa, Artificial Sequence
  Synthetic
LYAGRSS

SEQ ID NO: 170 - protein, 7 aa, Artificial Sequence
  Synthetic
DTKWSSS

SEQ ID NO: 171 - protein, 7 aa, Artificial Sequence
  Synthetic
SSTGYSS

SEQ ID NO: 172 - protein, 7 aa, Artificial Sequence
  Synthetic
MRTFGSA

SEQ ID NO: 173 - protein, 7 aa, Artificial Sequence
  Synthetic
LAHTYSS

SEQ ID NO: 174 - protein, 7 aa, Artificial Sequence
  Synthetic
LTKWEST

SEQ ID NO: 175 - protein, 7 aa, Artificial Sequence
  Synthetic
LWAKGST

SEQ ID NO: 176 - protein, 7 aa, Artificial Sequence
  Synthetic
GKTHGYS

SEQ ID NO: 177 - protein, 7 aa, Artificial Sequence
  Synthetic
MRTLMSS

SEQ ID NO: 178 - protein, 7 aa, Artificial Sequence
  Synthetic
TRTSGAS

SEQ ID NO: 179 - protein, 7 aa, Artificial Sequence
  Synthetic
MERYGSS

SEQ ID NO: 180 - protein, 7 aa, Artificial Sequence
  Synthetic
TYKSGSS

SEQ ID NO: 181 - protein, 7 aa, Artificial Sequence
  Synthetic
TRFGSST

SEQ ID NO: 182 - protein, 7 aa, Artificial Sequence
  Synthetic
DKAWGST

SEQ ID NO: 183 - protein, 7 aa, Artificial Sequence
  Synthetic
VPRYGSS

SEQ ID NO: 184 - protein, 7 aa, Artificial Sequence
  Synthetic
LSKGLSS

SEQ ID NO: 185 - protein, 7 aa, Artificial Sequence
  Synthetic
STRGYSA

SEQ ID NO: 186 - protein, 7 aa, Artificial Sequence
  Synthetic
IRVGYST

SEQ ID NO: 187 - protein, 7 aa, Artificial Sequence
  Synthetic
GNFNFSS

SEQ ID NO: 188 - protein, 7 aa, Artificial Sequence
  Synthetic
DKYNFSS

SEQ ID NO: 189 - protein, 7 aa, Artificial Sequence
  Synthetic
EDHRYSS

SEQ ID NO: 190 - protein, 7 aa, Artificial Sequence
  Synthetic
VKGGYSS

SEQ ID NO: 191 - protein, 7 aa, Artificial Sequence
  Synthetic
VTHGYSS

SEQ ID NO: 192 - protein, 7 aa, Artificial Sequence
  Synthetic
MVRNYST

SEQ ID NO: 193 - protein, 7 aa, Artificial Sequence
  Synthetic
HKTHYSS

SEQ ID NO: 194 - protein, 7 aa, Artificial Sequence
  Synthetic
IVRGLSS

SEQ ID NO: 195 - protein, 7 aa, Artificial Sequence
  Synthetic
TVTGYSS

SEQ ID NO: 196 - protein, 7 aa, Artificial Sequence
  Synthetic
NKVGYST

SEQ ID NO: 197 - protein, 7 aa, Artificial Sequence
  Synthetic
NSPGWSS

SEQ ID NO: 198 - protein, 7 aa, Artificial Sequence
  Synthetic
HEHRYST

SEQ ID NO: 199 - protein, 7 aa, Artificial Sequence
  Synthetic
LSMGYST

SEQ ID NO: 200 - protein, 7 aa, Artificial Sequence
  Synthetic
LLRGASS

SEQ ID NO: 201 - protein, 7 aa, Artificial Sequence
  Synthetic
LKKGYST

SEQ ID NO: 202 - protein, 7 aa, Artificial Sequence
  Synthetic
GKTGYST

SEQ ID NO: 203 - protein, 7 aa, Artificial Sequence
  Synthetic
WRQGYAS

SEQ ID NO: 204 - protein, 7 aa, Artificial Sequence
  Synthetic
LRGGYST

SEQ ID NO: 205 - protein, 7 aa, Artificial Sequence
  Synthetic
DRKGYSA

SEQ ID NO: 206 - protein, 7 aa, Artificial Sequence
  Synthetic
LKTGMSS

SEQ ID NO: 207 - protein, 7 aa, Artificial Sequence
  Synthetic
SKGSYST

SEQ ID NO: 208 - protein, 7 aa, Artificial Sequence
  Synthetic
IRQGYSS

SEQ ID NO: 209 - protein, 7 aa, Artificial Sequence
  Synthetic
QDKGYSS

SEQ ID NO: 210 - protein, 7 aa, Artificial Sequence
  Synthetic
QSAGYST

SEQ ID NO: 211 - protein, 7 aa, Artificial Sequence
  Synthetic
FLPGYSS

SEQ ID NO: 212 - protein, 7 aa, Artificial Sequence
  Synthetic
GSYGYSS

SEQ ID NO: 213 - protein, 7 aa, Artificial Sequence
  Synthetic
MNIGYSA

SEQ ID NO: 214 - protein, 7 aa, Artificial Sequence
  Synthetic
HTQGYST

SEQ ID NO: 215 - protein, 7 aa, Artificial Sequence
  Synthetic
VYPGYST

SEQ ID NO: 216 - protein, 7 aa, Artificial Sequence
  Synthetic
IATGYSQ

SEQ ID NO: 217 - protein, 7 aa, Artificial Sequence
  Synthetic
SKSGYSA

SEQ ID NO: 218 - protein, 7 aa, Artificial Sequence
  Synthetic
TYGGYSQ

SEQ ID NO: 219 - DNA, 21 bp, Artificial Sequence
  Synthetic
gtgcgtccggggtggtcgacg

SEQ ID NO: 220 - DNA, 21 bp, Artificial Sequence
  Synthetic
actcagcaggggtatagttct

SEQ ID NO: 221 - DNA, 21 bp, Artificial Sequence
  Synthetic
acgaagtctggttatagtact

SEQ ID NO: 222 - DNA, 21 bp, Artificial Sequence
  Synthetic
actcgtaatggttatagtacg

SEQ ID NO: 223 - DNA, 21 bp, Artificial Sequence
  Synthetic
attgatcggggttatagtgtg

SEQ ID NO: 224 - DNA, 21 bp, Artificial Sequence
  Synthetic
ccttatcagggggcgagtagt

SEQ ID NO: 225 - DNA, 21 bp, Artificial Sequence
  Synthetic
agttatcagggttatagtagt

SEQ ID NO: 226 - DNA, 21 bp, Artificial Sequence
  Synthetic
gtgaatcgtgggtatagttcg

SEQ ID NO: 227 - DNA, 21 bp, Artificial Sequence
  Synthetic
cttaggacggcttatagtagt

SEQ ID NO: 228 - DNA, 21 bp, Artificial Sequence
  Synthetic
agttatattggggcgtcgagt

SEQ ID NO: 229 - DNA, 21 bp, Artificial Sequence
  Synthetic
aatggttataagggttcgacg

SEQ ID NO: 230 - DNA, 21 bp, Artificial Sequence
  Synthetic
gagattagggggtattctagt

SEQ ID NO: 231 - DNA, 21 bp, Artificial Sequence
  Synthetic
gatgtgaagtatgggtcttcg

SEQ ID NO: 232 - DNA, 21 bp, Artificial Sequence
  Synthetic
ggggggagggggctttctagt

SEQ ID NO: 233 - DNA, 21 bp, Artificial Sequence
  Synthetic
tttaggattggtggttctagt

SEQ ID NO: 234 - DNA, 21 bp, Artificial Sequence
  Synthetic
ttgaagtatggtacgtctacg

SEQ ID NO: 235 - DNA, 21 bp, Artificial Sequence
  Synthetic
aagcagtatcaggggtctact

SEQ ID NO: 236 - DNA, 21 bp, Artificial Sequence
  Synthetic
aattatactggttattcttct

SEQ ID NO: 237 - DNA, 21 bp, Artificial Sequence
  Synthetic
cgtgctactgggtattcttcg

SEQ ID NO: 238 - DNA, 21 bp, Artificial Sequence
  Synthetic
gagagtaggggttttagttct

SEQ ID NO: 239 - DNA, 21 bp, Artificial Sequence
  Synthetic
cagcattttggtcagagttct

SEQ ID NO: 240 - DNA, 21 bp, Artificial Sequence
  Synthetic
acgaggacgggttatagtacg

SEQ ID NO: 241 - DNA, 21 bp, Artificial Sequence
  Synthetic
gcgaaggcgggttatgctagt

SEQ ID NO: 242 - DNA, 21 bp, Artificial Sequence
  Synthetic
aataggggggggtatgctagt

SEQ ID NO: 243 - DNA, 21 bp, Artificial Sequence
  Synthetic
agtatttatctgggttctcag

SEQ ID NO: 244 - DNA, 21 bp, Artificial Sequence
  Synthetic
tatcttaaggggtatagtgct

SEQ ID NO: 245 - DNA, 21 bp, Artificial Sequence
  Synthetic
gagaagaagcagtatagtagt

SEQ ID NO: 246 - DNA, 21 bp, Artificial Sequence
  Synthetic
aattatactgggtattcttct

SEQ ID NO: 247 - DNA, 21 bp, Artificial Sequence
  Synthetic
tctaagacgggttatagtacg

SEQ ID NO: 248 - DNA, 21 bp, Artificial Sequence
  Synthetic
actgagaagtggacgtcgagt

SEQ ID NO: 249 - DNA, 21 bp, Artificial Sequence
  Synthetic
gatcggattcatggttatagt

SEQ ID NO: 250 - DNA, 21 bp, Artificial Sequence
  Synthetic
actcgttttggtgctagtact

SEQ ID NO: 251 - DNA, 21 bp, Artificial Sequence
  Synthetic
gggaagcattttagttcgacg

SEQ ID NO: 252 - DNA, 21 bp, Artificial Sequence
  Synthetic
actaagtatatgcatagttcg

SEQ ID NO: 253 - DNA, 21 bp, Artificial Sequence
  Synthetic
gttaaggttggtttttcgtcg

SEQ ID NO: 254 - DNA, 21 bp, Artificial Sequence
  Synthetic
ctgaggatgggggcgtcttct

SEQ ID NO: 255 - DNA, 21 bp, Artificial Sequence
  Synthetic
ttgaatcggggtagttctacg

SEQ ID NO: 256 - DNA, 21 bp, Artificial Sequence
  Synthetic
ctttatgcgggtcggagttcg

SEQ ID NO: 257 - DNA, 21 bp, Artificial Sequence
  Synthetic
gatactaagtggagtagtagt

SEQ ID NO: 258 - DNA, 21 bp, Artificial Sequence
  Synthetic
tcgtctactggttatagtagt

SEQ ID NO: 259 - DNA, 21 bp, Artificial Sequence
  Synthetic
atgcgtacgtttggtagtgcg

SEQ ID NO: 260 - DNA, 21 bp, Artificial Sequence
  Synthetic
ctggctcatacttatagttcg

SEQ ID NO: 261 - DNA, 21 bp, Artificial Sequence
  Synthetic
cttactaagtgggagagtact

SEQ ID NO: 262 - DNA, 21 bp, Artificial Sequence
  Synthetic
ttgtgggcgaagggtagtacg

SEQ ID NO: 263 - DNA, 21 bp, Artificial Sequence
  Synthetic
ggtaagacgcatggttattcg

SEQ ID NO: 264 - DNA, 21 bp, Artificial Sequence
  Synthetic
atgcggacgcttatgtcgtct

SEQ ID NO: 265 - DNA, 21 bp, Artificial Sequence
  Synthetic
acgaggacgagtggtgcgtcg

SEQ ID NO: 266 - DNA, 21 bp, Artificial Sequence
  Synthetic
atggagcgttatgggagttct

SEQ ID NO: 267 - DNA, 21 bp, Artificial Sequence
  Synthetic
acgtataagtcgggttcgagt

SEQ ID NO: 268 - DNA, 21 bp, Artificial Sequence
  Synthetic
actaggtttggtagttcgact

SEQ ID NO: 269 - DNA, 21 bp, Artificial Sequence
  Synthetic
gataaggcttgggggtcgact

SEQ ID NO: 270 - DNA, 21 bp, Artificial Sequence
  Synthetic
gttccgcgttatggttcgagt

SEQ ID NO: 271 - DNA, 21 bp, Artificial Sequence
  Synthetic
cttagtaagggtctttcgagt

SEQ ID NO: 272 - DNA, 21 bp, Artificial Sequence
  Synthetic
agtactagggggtatagtgct

SEQ ID NO: 273 - DNA, 21 bp, Artificial Sequence
  Synthetic
attagggtggggtattctact

SEQ ID NO: 274 - DNA, 21 bp, Artificial Sequence
  Synthetic
ggtaattttaattttagttct

SEQ ID NO: 275 - DNA, 21 bp, Artificial Sequence
  Synthetic
gataagtataattttagtagt

SEQ ID NO: 276 - DNA, 21 bp, Artificial Sequence
  Synthetic
gaggatcatcggtatagtagt

SEQ ID NO: 277 - DNA, 21 bp, Artificial Sequence
  Synthetic
gtgaaggggggttattctagt

SEQ ID NO: 278 - DNA, 21 bp, Artificial Sequence
  Synthetic
gttactcatggttatagtagt

SEQ ID NO: 279 - DNA, 21 bp, Artificial Sequence
  Synthetic
atggtgaggaattattcgact

SEQ ID NO: 280 - DNA, 21 bp, Artificial Sequence
  Synthetic
cataagacgcattattctagt

SEQ ID NO: 281 - DNA, 21 bp, Artificial Sequence
  Synthetic
attgttcgtggtctgagttcg

SEQ ID NO: 282 - DNA, 21 bp, Artificial Sequence
  Synthetic
actgttacgggttattcgtct

SEQ ID NO: 283 - DNA, 21 bp, Artificial Sequence
  Synthetic
aataaggtggggtattctacg

SEQ ID NO: 284 - DNA, 21 bp, Artificial Sequence
  Synthetic
aatagtccgggttggtcgagt

SEQ ID NO: 285 - DNA, 21 bp, Artificial Sequence
  Synthetic
catgagcataggtatagtact

SEQ ID NO: 286 - DNA, 21 bp, Artificial Sequence
  Synthetic
ctgtctatggggtatagtact

SEQ ID NO: 287 - DNA, 21 bp, Artificial Sequence
  Synthetic
cttttgcgtggtgcgagttct

SEQ ID NO: 288 - DNA, 21 bp, Artificial Sequence
  Synthetic
ttgaagaaggggtatagtact

SEQ ID NO: 289 - DNA, 21 bp, Artificial Sequence
  Synthetic
gggaagactgggtattcgacg

SEQ ID NO: 290 - DNA, 21 bp, Artificial Sequence
  Synthetic
tggaggcaggggtatgcgagt

SEQ ID NO: 291 - DNA, 21 bp, Artificial Sequence
  Synthetic
ttgaggggtgggtatagtacg

SEQ ID NO: 292 - DNA, 21 bp, Artificial Sequence
  Synthetic
gatcgtaaggggtatagtgct

SEQ ID NO: 293 - DNA, 21 bp, Artificial Sequence
  Synthetic
ttgaagacggggatgtctagt

SEQ ID NO: 294 - DNA, 21 bp, Artificial Sequence
  Synthetic
tctaaggggagttatagtact

SEQ ID NO: 295 - DNA, 21 bp, Artificial Sequence
  Synthetic
attcgtcaggggtattcgagt

SEQ ID NO: 296 - DNA, 21 bp, Artificial Sequence
  Synthetic
caggataagggttatagttcg

SEQ ID NO: 297 - DNA, 21 bp, Artificial Sequence
  Synthetic
cagtcggctgggtattctacg

SEQ ID NO: 298 - DNA, 21 bp, Artificial Sequence
  Synthetic
tttctgccggggtattcgtcg

SEQ ID NO: 299 - DNA, 21 bp, Artificial Sequence
  Synthetic
gggagttatggttattcgtcg

SEQ ID NO: 300 - DNA, 21 bp, Artificial Sequence
  Synthetic
atgaatattgggtatagtgcg

SEQ ID NO: 301 - DNA, 21 bp, Artificial Sequence
  Synthetic
catacgcaggggtatagtacg

SEQ ID NO: 302 - DNA, 21 bp, Artificial Sequence
  Synthetic
gtttatcctggttatagtacg

SEQ ID NO: 303 - DNA, 21 bp, Artificial Sequence
  Synthetic
attgctactggttatagtcag

SEQ ID NO: 304 - DNA, 21 bp, Artificial Sequence
  Synthetic
tctaagagtggttatagtgcg

SEQ ID NO: 305 - DNA, 21 bp, Artificial Sequence
  Synthetic
acgtatgggggttattctcag

SEQ ID NO: 306 - protein, 7 aa, Artificial Sequence
  Synthetic
KSAGSIY

SEQ ID NO: 307 - protein, 7 aa, Artificial Sequence
  Synthetic
TQQGYSS

SEQ ID NO: 308 - protein, 7 aa, Artificial Sequence
  Synthetic
WGTPPRG

SEQ ID NO: 309 - protein, 7 aa, Artificial Sequence
  Synthetic
ELYKLPT

SEQ ID NO: 310 - protein, 7 aa, Artificial Sequence
  Synthetic
TRNGYST

SEQ ID NO: 311 - DNA, 21 bp, Artificial Sequence
  Synthetic
aagagtgctggttcgatttat

SEQ ID NO: 312 - DNA, 21 bp, Artificial Sequence
  Synthetic
actcagcaggggtatagttct

SEQ ID NO: 313 - DNA, 21 bp, Artificial Sequence
  Synthetic
tgggggacgcctccgaggggg

SEQ ID NO: 314 - DNA, 21 bp, Artificial Sequence
  Synthetic
gagctgtataagcttccgacg

SEQ ID NO: 315 - DNA, 21 bp, Artificial Sequence
  Synthetic
actcgtaatggttatagtacg

SEQ ID NO: 316 - protein, 7 aa, Artificial Sequence
  Synthetic
RSMKPNN

SEQ ID NO: 317 - protein, 7 aa, Artificial Sequence
  Synthetic
RKPRVHD

SEQ ID NO: 318 - protein, 7 aa, Artificial Sequence
  Synthetic
VRKMPDY

SEQ ID NO: 319 - protein, 7 aa, Artificial Sequence
  Synthetic
QKPIRIV

SEQ ID NO: 320 - protein, 7 aa, Artificial Sequence
  Synthetic
PKMTLKI

SEQ ID NO: 321 - protein, 7 aa, Artificial Sequence
  Synthetic
YADTNRR

SEQ ID NO: 322 - protein, 7 aa, Artificial Sequence
  Synthetic
RKQMNTT

SEQ ID NO: 323 - protein, 7 aa, Artificial Sequence
  Synthetic
ELYKLPT

SEQ ID NO: 324 - protein, 7 aa, Artificial Sequence
  Synthetic
GGQLRKP

SEQ ID NO: 325 - protein, 7 aa, Artificial Sequence
  Synthetic
LGKKTNS

SEQ ID NO: 326 - protein, 7 aa, Artificial Sequence
  Synthetic
NRQTVKG

SEQ ID NO: 327 - protein, 7 aa, Artificial Sequence
  Synthetic
TKSVRVV

SEQ ID NO: 328 - protein, 7 aa, Artificial Sequence
  Synthetic
GINVRPR

SEQ ID NO: 329 - protein, 7 aa, Artificial Sequence
  Synthetic
KKGSIGS

SEQ ID NO: 330 - protein, 7 aa, Artificial Sequence
  Synthetic
LRKNPNP

SEQ ID NO: 331 - protein, 7 aa, Artificial Sequence
  Synthetic
NSKTVVR

SEQ ID NO: 332 - protein, 7 aa, Artificial Sequence
  Synthetic
VRRTQLD

SEQ ID NO: 333 - protein, 7 aa, Artificial Sequence
  Synthetic
KKSTILA

SEQ ID NO: 334 - protein, 7 aa, Artificial Sequence
  Synthetic
RSKLGSG

SEQ ID NO: 335 - protein, 7 aa, Artificial Sequence
  Synthetic
DRRGHDR

SEQ ID NO: 336 - protein, 7 aa, Artificial Sequence
  Synthetic
TKSSMRP

SEQ ID NO: 337 - protein, 7 aa, Artificial Sequence
  Synthetic
NRITPNR

SEQ ID NO: 338 - protein, 7 aa, Artificial Sequence
  Synthetic
KIQNNKQ

SEQ ID NO: 339 - protein, 7 aa, Artificial Sequence
  Synthetic
KSRLTQP

SEQ ID NO: 340 - protein, 7 aa, Artificial Sequence
  Synthetic
SQKAGGR

SEQ ID NO: 341 - protein, 7 aa, Artificial Sequence
  Synthetic
ARKTPDY

SEQ ID NO: 342 - protein, 7 aa, Artificial Sequence
  Synthetic
TRKPVVI

SEQ ID NO: 343 - protein, 7 aa, Artificial Sequence
  Synthetic
NLKDKRT

SEQ ID NO: 344 - protein, 7 aa, Artificial Sequence
  Synthetic
KRDARMN

SEQ ID NO: 345 - protein, 7 aa, Artificial Sequence
  Synthetic
KGSMRQA

SEQ ID NO: 346 - protein, 7 aa, Artificial Sequence
  Synthetic
RRHLAET

SEQ ID NO: 347 - protein, 7 aa, Artificial Sequence
  Synthetic
VKTHRPV

SEQ ID NO: 348 - protein, 7 aa, Artificial Sequence
  Synthetic
KRNNVAA

SEQ ID NO: 349 - protein, 7 aa, Artificial Sequence
  Synthetic
GKIKNGL

SEQ ID NO: 350 - protein, 7 aa, Artificial Sequence
  Synthetic
SNHRRME

SEQ ID NO: 351 - protein, 7 aa, Artificial Sequence
  Synthetic
KKIQYDK

SEQ ID NO: 352 - protein, 7 aa, Artificial Sequence
  Synthetic
RKRDDPA

SEQ ID NO: 353 - protein, 7 aa, Artificial Sequence
  Synthetic
AKQGANK

SEQ ID NO: 354 - protein, 7 aa, Artificial Sequence
  Synthetic
RRPPSMG

SEQ ID NO: 355 - protein, 7 aa, Artificial Sequence
  Synthetic
VKQTKAI

SEQ ID NO: 356 - protein, 7 aa, Artificial Sequence
  Synthetic
TRKLQLG

SEQ ID NO: 357 - protein, 7 aa, Artificial Sequence
  Synthetic
IVNMRPK

SEQ ID NO: 358 - protein, 7 aa, Artificial Sequence
  Synthetic
RSGMKMA

SEQ ID NO: 359 - protein, 7 aa, Artificial Sequence
  Synthetic
SRRSLSD

SEQ ID NO: 360 - protein, 7 aa, Artificial Sequence
  Synthetic
GRARAND

SEQ ID NO: 361 - protein, 7 aa, Artificial Sequence
  Synthetic
RPKAGPS

SEQ ID NO: 362 - protein, 7 aa, Artificial Sequence
  Synthetic
KKGVTST

SEQ ID NO: 363 - protein, 7 aa, Artificial Sequence
  Synthetic
AKKVSVS

SEQ ID NO: 364 - protein, 7 aa, Artificial Sequence
  Synthetic
KKSLMTS

SEQ ID NO: 365 - protein, 7 aa, Artificial Sequence
  Synthetic
LMVKKMT

SEQ ID NO: 366 - protein, 7 aa, Artificial Sequence
  Synthetic
ESGRKNS

SEQ ID NO: 367 - protein, 7 aa, Artificial Sequence
  Synthetic
QRIQGQK

SEQ ID NO: 368 - protein, 7 aa, Artificial Sequence
  Synthetic
RGVTKEW

SEQ ID NO: 369 - protein, 7 aa, Artificial Sequence
  Synthetic
RGTRTEN

SEQ ID NO: 370 - protein, 7 aa, Artificial Sequence
  Synthetic
LNDRRSM

SEQ ID NO: 371 - protein, 7 aa, Artificial Sequence
  Synthetic
MKTNSGR

SEQ ID NO: 372 - protein, 7 aa, Artificial Sequence
  Synthetic
ANAKSVK

SEQ ID NO: 373 - protein, 7 aa, Artificial Sequence
  Synthetic
HLNTSIY

SEQ ID NO: 374 - protein, 7 aa, Artificial Sequence
  Synthetic
KAKSPGQ

SEQ ID NO: 375 - protein, 7 aa, Artificial Sequence
  Synthetic
KRNGSLT

SEQ ID NO: 376 - protein, 7 aa, Artificial Sequence
  Synthetic
KRASTSI

SEQ ID NO: 377 - protein, 7 aa, Artificial Sequence
  Synthetic
PRLGNKT

SEQ ID NO: 378 - protein, 7 aa, Artificial Sequence
  Synthetic
FKPILKS

SEQ ID NO: 379 - protein, 7 aa, Artificial Sequence
  Synthetic
TSGRRDA

SEQ ID NO: 380 - protein, 7 aa, Artificial Sequence
  Synthetic
KVKIAFT

SEQ ID NO: 381 - protein, 7 aa, Artificial Sequence
  Synthetic
RGRPNTG

SEQ ID NO: 382 - protein, 7 aa, Artificial Sequence
  Synthetic
KDRKVPN

SEQ ID NO: 383 - protein, 7 aa, Artificial Sequence
  Synthetic
KGGDKKL

SEQ ID NO: 384 - protein, 7 aa, Artificial Sequence
  Synthetic
KPRNMTG

SEQ ID NO: 385 - protein, 7 aa, Artificial Sequence
  Synthetic
KNNGQKN

SEQ ID NO: 386 - protein, 7 aa, Artificial Sequence
  Synthetic
KQAKNQA

SEQ ID NO: 387 - protein, 7 aa, Artificial Sequence
  Synthetic
KTTMNRP

SEQ ID NO: 388 - protein, 7 aa, Artificial Sequence
  Synthetic
RLRPQTS

SEQ ID NO: 389 - protein, 7 aa, Artificial Sequence
  Synthetic
KKGESRT

SEQ ID NO: 390 - protein, 7 aa, Artificial Sequence
  Synthetic
AKITPTK

SEQ ID NO: 391 - protein, 7 aa, Artificial Sequence
  Synthetic
MLKLKAQ

SEQ ID NO: 392 - protein, 7 aa, Artificial Sequence
  Synthetic
IVTRNSV

SEQ ID NO: 393 - protein, 7 aa, Artificial Sequence
  Synthetic
KTRVSEN

SEQ ID NO: 394 - protein, 7 aa, Artificial Sequence
  Synthetic
IKPMMAK

SEQ ID NO: 395 - protein, 7 aa, Artificial Sequence
  Synthetic
NAKTVMR

SEQ ID NO: 396 - protein, 7 aa, Artificial Sequence
  Synthetic
LPKYKSS

SEQ ID NO: 397 - protein, 7 aa, Artificial Sequence
  Synthetic
KLDKRMG

SEQ ID NO: 398 - protein, 7 aa, Artificial Sequence
  Synthetic
RGTRSND

SEQ ID NO: 399 - protein, 7 aa, Artificial Sequence
  Synthetic
KFDTDRR

SEQ ID NO: 400 - protein, 7 aa, Artificial Sequence
  Synthetic
KGGIVKL

SEQ ID NO: 401 - protein, 7 aa, Artificial Sequence
  Synthetic
NGSRRTD

SEQ ID NO: 402 - protein, 7 aa, Artificial Sequence
  Synthetic
HHTDSRY

SEQ ID NO: 403 - protein, 7 aa, Artificial Sequence
  Synthetic
TRRDSLF

SEQ ID NO: 404 - protein, 7 aa, Artificial Sequence
  Synthetic
TAKVAKH

SEQ ID NO: 405 - protein, 7 aa, Artificial Sequence
  Synthetic
VKRQPDS

SEQ ID NO: 406 - protein, 7 aa, Artificial Sequence
  Synthetic
LATRRDY

SEQ ID NO: 407 - protein, 7 aa, Artificial Sequence
  Synthetic
VLSRWNG

SEQ ID NO: 408 - protein, 7 aa, Artificial Sequence
  Synthetic
VRSTGKN

SEQ ID NO: 409 - protein, 7 aa, Artificial Sequence
  Synthetic
RRAQLTP

SEQ ID NO: 410 - protein, 7 aa, Artificial Sequence
  Synthetic
ITRAREI

SEQ ID NO: 411 - protein, 7 aa, Artificial Sequence
  Synthetic
GGTRSSI

SEQ ID NO: 412 - protein, 7 aa, Artificial Sequence
  Synthetic
DTTNKRY

SEQ ID NO: 413 - protein, 7 aa, Artificial Sequence
  Synthetic
DRSKLMK

SEQ ID NO: 414 - protein, 7 aa, Artificial Sequence
  Synthetic
VFDLRVK

SEQ ID NO: 415 - protein, 7 aa, Artificial Sequence
  Synthetic
SKADPRK

SEQ ID NO: 416 - protein, 7 aa, Artificial Sequence
  Synthetic
TEVRRST

SEQ ID NO: 417 - protein, 7 aa, Artificial Sequence
  Synthetic
RKHSNSD

SEQ ID NO: 418 - protein, 7 aa, Artificial Sequence
  Synthetic
SKAKVTI

SEQ ID NO: 419 - protein, 7 aa, Artificial Sequence
  Synthetic
VDRKISH

SEQ ID NO: 420 - protein, 7 aa, Artificial Sequence
  Synthetic
STKTVKL

SEQ ID NO: 421 - protein, 7 aa, Artificial Sequence
  Synthetic
KTIPPRV

SEQ ID NO: 422 - protein, 7 aa, Artificial Sequence
  Synthetic
SRAPNRT

SEQ ID NO: 423 - protein, 7 aa, Artificial Sequence
  Synthetic
TRVKHPA

SEQ ID NO: 424 - protein, 7 aa, Artificial Sequence
  Synthetic
KAKVASM

SEQ ID NO: 425 - protein, 7 aa, Artificial Sequence
  Synthetic
VKRNMMD

SEQ ID NO: 426 - protein, 7 aa, Artificial Sequence
  Synthetic
PDQRRVY

SEQ ID NO: 427 - protein, 7 aa, Artificial Sequence
  Synthetic
TKQRNPG

SEQ ID NO: 428 - protein, 7 aa, Artificial Sequence
  Synthetic
RMENSKG

SEQ ID NO: 429 - protein, 7 aa, Artificial Sequence
  Synthetic
KPQIGYS

SEQ ID NO: 430 - protein, 7 aa, Artificial Sequence
  Synthetic
SRASREN

SEQ ID NO: 431 - protein, 7 aa, Artificial Sequence
  Synthetic
GRRSLTD

SEQ ID NO: 432 - protein, 7 aa, Artificial Sequence
  Synthetic
QRSPAKR

SEQ ID NO: 433 - protein, 7 aa, Artificial Sequence
  Synthetic
LSSELRK

SEQ ID NO: 434 - protein, 7 aa, Artificial Sequence
  Synthetic
KPNKAVN

SEQ ID NO: 435 - protein, 7 aa, Artificial Sequence
  Synthetic
EMKLRNT

SEQ ID NO: 436 - protein, 7 aa, Artificial Sequence
  Synthetic
RSPYGNN

SEQ ID NO: 437 - protein, 7 aa, Artificial Sequence
  Synthetic
DDKRRMT

SEQ ID NO: 438 - protein, 7 aa, Artificial Sequence
  Synthetic
PDRRSIV

SEQ ID NO: 439 - protein, 7 aa, Artificial Sequence
  Synthetic
KVTNRHE

SEQ ID NO: 440 - protein, 7 aa, Artificial Sequence
  Synthetic
SRPPPKC

SEQ ID NO: 441 - protein, 7 aa, Artificial Sequence
  Synthetic
FNRERNN

SEQ ID NO: 442 - protein, 7 aa, Artificial Sequence
  Synthetic
KVNKVIN

SEQ ID NO: 443 - protein, 7 aa, Artificial Sequence
  Synthetic
DRRTRSE

SEQ ID NO: 444 - protein, 7 aa, Artificial Sequence
  Synthetic
RPTSKPN

SEQ ID NO: 445 - protein, 7 aa, Artificial Sequence
  Synthetic
MAGSPKK

SEQ ID NO: 446 - protein, 7 aa, Artificial Sequence
  Synthetic
YKAVGRQ

SEQ ID NO: 447 - protein, 7 aa, Artificial Sequence
  Synthetic
RISAATT

SEQ ID NO: 448 - protein, 7 aa, Artificial Sequence
  Synthetic
SNSSPRW

SEQ ID NO: 449 - protein, 7 aa, Artificial Sequence
  Synthetic
LKNGRGV

SEQ ID NO: 450 - protein, 7 aa, Artificial Sequence
  Synthetic
PQAKKPL

SEQ ID NO: 451 - protein, 7 aa, Artificial Sequence
  Synthetic
RTMPTKI

SEQ ID NO: 452 - protein, 7 aa, Artificial Sequence
  Synthetic
KSVDKKS

SEQ ID NO: 453 - protein, 7 aa, Artificial Sequence
  Synthetic
DMDLGMG

SEQ ID NO: 454 - protein, 7 aa, Artificial Sequence
  Synthetic
LNNKQVR

SEQ ID NO: 455 - protein, 7 aa, Artificial Sequence
  Synthetic
TRGKAQE

SEQ ID NO: 456 - protein, 7 aa, Artificial Sequence
  Synthetic
TNGHYKG

SEQ ID NO: 457 - protein, 7 aa, Artificial Sequence
  Synthetic
ETGKKWF

SEQ ID NO: 458 - protein, 7 aa, Artificial Sequence
  Synthetic
STDPRKK

SEQ ID NO: 459 - protein, 7 aa, Artificial Sequence
  Synthetic
KKAGTGT

SEQ ID NO: 460 - protein, 7 aa, Artificial Sequence
  Synthetic
DSRRSIV

SEQ ID NO: 461 - protein, 7 aa, Artificial Sequence
  Synthetic
SFGQQFE

SEQ ID NO: 462 - protein, 7 aa, Artificial Sequence
  Synthetic
STERKSY

SEQ ID NO: 463 - protein, 7 aa, Artificial Sequence
  Synthetic
VSSRHSN

SEQ ID NO: 464 - protein, 7 aa, Artificial Sequence
  Synthetic
RVSAANT

SEQ ID NO: 465 - protein, 7 aa, Artificial Sequence
  Synthetic
GRGNSVL

SEQ ID NO: 466 - protein, 7 aa, Artificial Sequence
  Synthetic
RSPRVNA

SEQ ID NO: 467 - protein, 7 aa, Artificial Sequence
  Synthetic
IRNPRMA

SEQ ID NO: 468 - protein, 7 aa, Artificial Sequence
  Synthetic
STRSQSL

SEQ ID NO: 469 - protein, 7 aa, Artificial Sequence
  Synthetic
RMVQGTQ

SEQ ID NO: 470 - protein, 7 aa, Artificial Sequence
  Synthetic
INDRGRG

SEQ ID NO: 471 - protein, 7 aa, Artificial Sequence
  Synthetic
LLGKRGD

SEQ ID NO: 472 - protein, 7 aa, Artificial Sequence
  Synthetic
SNGMDRR

SEQ ID NO: 473 - protein, 7 aa, Artificial Sequence
  Synthetic
LSRSWAG

SEQ ID NO: 474 - protein, 7 aa, Artificial Sequence
  Synthetic
QSSRSLT

SEQ ID NO: 475 - protein, 7 aa, Artificial Sequence
  Synthetic
DSRIRNL

SEQ ID NO: 476 - protein, 7 aa, Artificial Sequence
  Synthetic
SRKMDNF

SEQ ID NO: 477 - protein, 7 aa, Artificial Sequence
  Synthetic
LVNGAPL

SEQ ID NO: 478 - protein, 7 aa, Artificial Sequence
  Synthetic
TVRREDR

SEQ ID NO: 479 - protein, 7 aa, Artificial Sequence
  Synthetic
RNTRTEA

SEQ ID NO: 480 - protein, 7 aa, Artificial Sequence
  Synthetic
ARRPNSE

SEQ ID NO: 481 - protein, 7 aa, Artificial Sequence
  Synthetic
QSRERTN

SEQ ID NO: 482 - protein, 7 aa, Artificial Sequence
  Synthetic
IEKPTYR

SEQ ID NO: 483 - protein, 7 aa, Artificial Sequence
  Synthetic
TGRTQTM

SEQ ID NO: 484 - protein, 7 aa, Artificial Sequence
  Synthetic
IKMLNKP

SEQ ID NO: 485 - protein, 7 aa, Artificial Sequence
  Synthetic
HNDFSKP

SEQ ID NO: 486 - protein, 7 aa, Artificial Sequence
  Synthetic
AKIKALL

SEQ ID NO: 487 - protein, 7 aa, Artificial Sequence
  Synthetic
RETWHKN

SEQ ID NO: 488 - protein, 7 aa, Artificial Sequence
  Synthetic
MTRLAKE

SEQ ID NO: 489 - protein, 7 aa, Artificial Sequence
  Synthetic
VGNARVY

SEQ ID NO: 490 - protein, 7 aa, Artificial Sequence
  Synthetic
FQRKGEN

SEQ ID NO: 491 - protein, 7 aa, Artificial Sequence
  Synthetic
YRSSQLT

SEQ ID NO: 492 - protein, 7 aa, Artificial Sequence
  Synthetic
AGRLVLQ

SEQ ID NO: 493 - protein, 7 aa, Artificial Sequence
  Synthetic
RSISSNP

SEQ ID NO: 494 - protein, 7 aa, Artificial Sequence
  Synthetic
GTVKTNK

SEQ ID NO: 495 - protein, 7 aa, Artificial Sequence
  Synthetic
KDQNYTR

SEQ ID NO: 496 - protein, 7 aa, Artificial Sequence
  Synthetic
YTMLRPS

SEQ ID NO: 497 - protein, 7 aa, Artificial Sequence
  Synthetic
DRTQTVR

SEQ ID NO: 498 - protein, 7 aa, Artificial Sequence
  Synthetic
ITRFDIN

SEQ ID NO: 499 - protein, 7 aa, Artificial Sequence
  Synthetic
SVRRIDF

SEQ ID NO: 500 - protein, 7 aa, Artificial Sequence
  Synthetic
FPNNRAN

SEQ ID NO: 501 - protein, 7 aa, Artificial Sequence
  Synthetic
MRRTNDT

SEQ ID NO: 502 - protein, 7 aa, Artificial Sequence
  Synthetic
YDIRRGL

SEQ ID NO: 503 - protein, 7 aa, Artificial Sequence
  Synthetic
FVKSGMN

SEQ ID NO: 504 - protein, 7 aa, Artificial Sequence
  Synthetic
HVHVRTH

SEQ ID NO: 505 - protein, 7 aa, Artificial Sequence
  Synthetic
RGKMELY

SEQ ID NO: 506 - protein, 7 aa, Artificial Sequence
  Synthetic
REVLQRI

SEQ ID NO: 507 - protein, 7 aa, Artificial Sequence
  Synthetic
GERSPRL

SEQ ID NO: 508 - protein, 7 aa, Artificial Sequence
  Synthetic
TPTNPRW

SEQ ID NO: 509 - protein, 7 aa, Artificial Sequence
  Synthetic
YLREYGN

SEQ ID NO: 510 - protein, 7 aa, Artificial Sequence
  Synthetic
TERGRET

SEQ ID NO: 511 - protein, 7 aa, Artificial Sequence
  Synthetic
SKDNHRM

SEQ ID NO: 512 - protein, 7 aa, Artificial Sequence
  Synthetic
DIHGANL

SEQ ID NO: 513 - protein, 7 aa, Artificial Sequence
  Synthetic
LPNYHQI

SEQ ID NO: 514 - protein, 7 aa, Artificial Sequence
  Synthetic
HSVGYLD

SEQ ID NO: 515 - protein, 7 aa, Artificial Sequence
  Synthetic
ASLADRP

SEQ ID NO: 516 - protein, 7 aa, Artificial Sequence
  Synthetic
SADRKHI

SEQ ID NO: 517 - protein, 7 aa, Artificial Sequence
  Synthetic
SKNDHEY

SEQ ID NO: 518 - protein, 7 aa, Artificial Sequence
  Synthetic
KQARSNE

SEQ ID NO: 519 - protein, 7 aa, Artificial Sequence
  Synthetic
RTNHPTW

SEQ ID NO: 520 - protein, 7 aa, Artificial Sequence
  Synthetic
DRNIRSS

SEQ ID NO: 521 - protein, 7 aa, Artificial Sequence
  Synthetic
HKAHALA

SEQ ID NO: 522 - protein, 7 aa, Artificial Sequence
  Synthetic
NLGAINK

SEQ ID NO: 523 - DNA, 21 bp, Artificial Sequence
  Synthetic
aggtcgatgaagccgaataat

SEQ ID NO: 524 - DNA, 21 bp, Artificial Sequence
  Synthetic
aggaagcctagggtgcatgat

SEQ ID NO: 525 - DNA, 21 bp, Artificial Sequence
  Synthetic
gttaggaagatgccggattat

SEQ ID NO: 526 - DNA, 21 bp, Artificial Sequence
  Synthetic
cagaagcctattcgtattgtt

SEQ ID NO: 527 - DNA, 21 bp, Artificial Sequence
  Synthetic
ccgaagatgacgcttaagatt

SEQ ID NO: 528 - DNA, 21 bp, Artificial Sequence
  Synthetic
tatgcggatactaatcgtagg

SEQ ID NO: 529 - DNA, 21 bp, Artificial Sequence
  Synthetic
cgtaagcagatgaatacgacg

SEQ ID NO: 530 - DNA, 21 bp, Artificial Sequence
  Synthetic
gagctgtataagcttccgacg

SEQ ID NO: 531 - DNA, 21 bp, Artificial Sequence
  Synthetic
gggggtcagctgaggaagcct

SEQ ID NO: 532 - DNA, 21 bp, Artificial Sequence
  Synthetic
cttggtaagaagactaatagt

SEQ ID NO: 533 - DNA, 21 bp, Artificial Sequence
  Synthetic
aatcggcagactgtgaagggt

SEQ ID NO: 534 - DNA, 21 bp, Artificial Sequence
  Synthetic
acgaagtctgtgagggttgtt

SEQ ID NO: 535 - DNA, 21 bp, Artificial Sequence
  Synthetic
ggtattaatgtgcgtcctcgt

SEQ ID NO: 536 - DNA, 21 bp, Artificial Sequence
  Synthetic
aagaagggttctattggtagt

SEQ ID NO: 537 - DNA, 21 bp, Artificial Sequence
  Synthetic
cttaggaagaatcctaatccg

SEQ ID NO: 538 - DNA, 21 bp, Artificial Sequence
  Synthetic
aatagtaagactgttgtgagg

SEQ ID NO: 539 - DNA, 21 bp, Artificial Sequence
  Synthetic
gttaggcgtactcagttggat

SEQ ID NO: 540 - DNA, 21 bp, Artificial Sequence
  Synthetic
aagaagtctactattttggcg

SEQ ID NO: 541 - DNA, 21 bp, Artificial Sequence
  Synthetic
aggtctaagctgggtagtggg

SEQ ID NO: 542 - DNA, 21 bp, Artificial Sequence
  Synthetic
gataggaggggtcatgatcgg

SEQ ID NO: 543 - DNA, 21 bp, Artificial Sequence
  Synthetic
actaagtctagtatgaggccg

SEQ ID NO: 544 - DNA, 21 bp, Artificial Sequence
  Synthetic
aataggattactcctaatagg

SEQ ID NO: 545 - DNA, 21 bp, Artificial Sequence
  Synthetic
aagattcagaataataagcag

SEQ ID NO: 546 - DNA, 21 bp, Artificial Sequence
  Synthetic
aagagtcggttgacgcagccg

SEQ ID NO: 547 - DNA, 21 bp, Artificial Sequence
  Synthetic
agtcagaaggctggggggcgt

SEQ ID NO: 548 - DNA, 21 bp, Artificial Sequence
  Synthetic
gctaggaagacgccggattat

SEQ ID NO: 549 - DNA, 21 bp, Artificial Sequence
  Synthetic
actaggaagccggtggtgatt

SEQ ID NO: 550 - DNA, 21 bp, Artificial Sequence
  Synthetic
aatcttaaggataagaggact

SEQ ID NO: 551 - DNA, 21 bp, Artificial Sequence
  Synthetic
aagagggatgcgaggatgaat

SEQ ID NO: 552 - DNA, 21 bp, Artificial Sequence
  Synthetic
aaggggtctatgaggcaggcg

SEQ ID NO: 553 - DNA, 21 bp, Artificial Sequence
  Synthetic
aggcggcatttggcggagacg

SEQ ID NO: 554 - DNA, 21 bp, Artificial Sequence
  Synthetic
gtgaagactcataggcctgtt

SEQ ID NO: 555 - DNA, 21 bp, Artificial Sequence
  Synthetic
aagaggaataatgttgcggct

SEQ ID NO: 556 - DNA, 21 bp, Artificial Sequence
  Synthetic
ggtaagattaagaatggtttg

SEQ ID NO: 557 - DNA, 21 bp, Artificial Sequence
  Synthetic
agtaatcataggaggatggag

SEQ ID NO: 558 - DNA, 21 bp, Artificial Sequence
  Synthetic
aagaagattcagtatgataag

SEQ ID NO: 559 - DNA, 21 bp, Artificial Sequence
  Synthetic
cgtaagcgtgatgatcctgct

SEQ ID NO: 560 - DNA, 21 bp, Artificial Sequence
  Synthetic
gcgaagcagggggcgaataag

SEQ ID NO: 561 - DNA, 21 bp, Artificial Sequence
  Synthetic
aggaggcctcctagtatgggt

SEQ ID NO: 562 - DNA, 21 bp, Artificial Sequence
  Synthetic
gtgaagcagacgaaggcgatt

SEQ ID NO: 563 - DNA, 21 bp, Artificial Sequence
  Synthetic
acgcggaagctgcagcttggt

SEQ ID NO: 564 - DNA, 21 bp, Artificial Sequence
  Synthetic
attgttaatatgcgtccgaag

SEQ ID NO: 565 - DNA, 21 bp, Artificial Sequence
  Synthetic
aggagtggtatgaagatggct

SEQ ID NO: 566 - DNA, 21 bp, Artificial Sequence
  Synthetic
tctaggaggagtctttcggat

SEQ ID NO: 567 - DNA, 21 bp, Artificial Sequence
  Synthetic
ggtagggctagggctaatgat

SEQ ID NO: 568 - DNA, 21 bp, Artificial Sequence
  Synthetic
aggccgaaggctggtccgtcg

SEQ ID NO: 569 - DNA, 21 bp, Artificial Sequence
  Synthetic
aagaagggtgttacgagtacg

SEQ ID NO: 570 - DNA, 21 bp, Artificial Sequence
  Synthetic
gctaagaaggtgtctgtgtct

SEQ ID NO: 571 - DNA, 21 bp, Artificial Sequence
  Synthetic
aagaagagtctgatgacgagt

SEQ ID NO: 572 - DNA, 21 bp, Artificial Sequence
  Synthetic
ttgatggttaagaagatgact

SEQ ID NO: 573 - DNA, 21 bp, Artificial Sequence
  Synthetic
gagagtggtcgtaagaattct

SEQ ID NO: 574 - DNA, 21 bp, Artificial Sequence
  Synthetic
cagcggattcaggggcagaag

SEQ ID NO: 575 - DNA, 21 bp, Artificial Sequence
  Synthetic
cgtggggttactaaggagtgg

SEQ ID NO: 576 - DNA, 21 bp, Artificial Sequence
  Synthetic
aggggtacgaggacggagaat

SEQ ID NO: 577 - DNA, 21 bp, Artificial Sequence
  Synthetic
ctgaatgatcggcggagtatg

SEQ ID NO: 578 - DNA, 21 bp, Artificial Sequence
  Synthetic
atgaagacgaatagtgggagg

SEQ ID NO: 579 - DNA, 21 bp, Artificial Sequence
  Synthetic
gcgaatgctaagtctgttaag

SEQ ID NO: 580 - DNA, 21 bp, Artificial Sequence
  Synthetic
catcttaatactagtatttat

SEQ ID NO: 581 - DNA, 21 bp, Artificial Sequence
  Synthetic
aaggctaagagtccggggcag

SEQ ID NO: 582 - DNA, 21 bp, Artificial Sequence
  Synthetic
aagcgtaatgggtctctgact

SEQ ID NO: 583 - DNA, 21 bp, Artificial Sequence
  Synthetic
aagagggcgagtacgtctatt

SEQ ID NO: 584 - DNA, 21 bp, Artificial Sequence
  Synthetic
ccgaggcttgggaataagact

SEQ ID NO: 585 - DNA, 21 bp, Artificial Sequence
  Synthetic
tttaagccgattcttaagtct

SEQ ID NO: 586 - DNA, 21 bp, Artificial Sequence
  Synthetic
acgagtgggaggcgggatgct

SEQ ID NO: 587 - DNA, 21 bp, Artificial Sequence
  Synthetic
aaggtgaagattgcttttact

SEQ ID NO: 588 - DNA, 21 bp, Artificial Sequence
  Synthetic
agggggaggcctaatactggt

SEQ ID NO: 589 - DNA, 21 bp, Artificial Sequence
  Synthetic
aaggatcgtaaggtgcctaat

SEQ ID NO: 590 - DNA, 21 bp, Artificial Sequence
  Synthetic
aaggggggtgataagaagctg

SEQ ID NO: 591 - DNA, 21 bp, Artificial Sequence
  Synthetic
aagcctcgtaatatgactggt

SEQ ID NO: 592 - DNA, 21 bp, Artificial Sequence
  Synthetic
aagaataatggtcagaagaat

SEQ ID NO: 593 - DNA, 21 bp, Artificial Sequence
  Synthetic
aagcaggcgaagaatcaggct

SEQ ID NO: 594 - DNA, 21 bp, Artificial Sequence
  Synthetic
aagactacgatgaataggccg

SEQ ID NO: 595 - DNA, 21 bp, Artificial Sequence
  Synthetic
aggttgcgtccgcagacttct

SEQ ID NO: 596 - DNA, 21 bp, Artificial Sequence
  Synthetic
aagaagggggagtctcgtact

SEQ ID NO: 597 - DNA, 21 bp, Artificial Sequence
  Synthetic
gcgaagattactccgacgaag

SEQ ID NO: 598 - DNA, 21 bp, Artificial Sequence
  Synthetic
atgctgaagcttaaggcgcag

SEQ ID NO: 599 - DNA, 21 bp, Artificial Sequence
  Synthetic
attgttactaggaattctgtt

SEQ ID NO: 600 - DNA, 21 bp, Artificial Sequence
  Synthetic
aagactcgggtgagtgagaat

SEQ ID NO: 601 - DNA, 21 bp, Artificial Sequence
  Synthetic
attaagccgatgatggcgaag

SEQ ID NO: 602 - DNA, 21 bp, Artificial Sequence
  Synthetic
aatgctaagactgttatgcgt

SEQ ID NO: 603 - DNA, 21 bp, Artificial Sequence
  Synthetic
ttgcctaagtataagagttcg

SEQ ID NO: 604 - DNA, 21 bp, Artificial Sequence
  Synthetic
aagttggataagcggatgggg

SEQ ID NO: 605 - DNA, 21 bp, Artificial Sequence
  Synthetic
cgtggtacgaggagtaatgat

SEQ ID NO: 606 - DNA, 21 bp, Artificial Sequence
  Synthetic
aagtttgatactgataggcgt

SEQ ID NO: 607 - DNA, 21 bp, Artificial Sequence
  Synthetic
aagggggggattgttaagctt

SEQ ID NO: 608 - DNA, 21 bp, Artificial Sequence
  Synthetic
aatggttctcgtaggactgat

SEQ ID NO: 609 - DNA, 21 bp, Artificial Sequence
  Synthetic
catcatactgattcgaggtat

SEQ ID NO: 610 - DNA, 21 bp, Artificial Sequence
  Synthetic
acgaggcgtgatagtttgttt

SEQ ID NO: 611 - DNA, 21 bp, Artificial Sequence
  Synthetic
actgctaaggttgcgaagcat

SEQ ID NO: 612 - DNA, 21 bp, Artificial Sequence
  Synthetic
gttaagaggcagccggatagt

SEQ ID NO: 613 - DNA, 21 bp, Artificial Sequence
  Synthetic
ctggcgactcgtagggattat

SEQ ID NO: 614 - DNA, 21 bp, Artificial Sequence
  Synthetic
gttttgagtaggtggaatggg

SEQ ID NO: 615 - DNA, 21 bp, Artificial Sequence
  Synthetic
gtgaggagtacggggaagaat

SEQ ID NO: 616 - DNA, 21 bp, Artificial Sequence
  Synthetic
cggagggcgcagcttactcct

SEQ ID NO: 617 - DNA, 21 bp, Artificial Sequence
  Synthetic
attactcgggctcgtgagatt

SEQ ID NO: 618 - DNA, 21 bp, Artificial Sequence
  Synthetic
ggtggtacgcgtagtagtatt

SEQ ID NO: 619 - DNA, 21 bp, Artificial Sequence
  Synthetic
gatacgacgaataagaggtat

SEQ ID NO: 620 - DNA, 21 bp, Artificial Sequence
  Synthetic
gataggagtaagttgatgaag

SEQ ID NO: 621 - DNA, 21 bp, Artificial Sequence
  Synthetic
gtgtttgatttgcgggtgaag

SEQ ID NO: 622 - DNA, 21 bp, Artificial Sequence
  Synthetic
tcgaaggcggatccgaggaag

SEQ ID NO: 623 - DNA, 21 bp, Artificial Sequence
  Synthetic
actgaggtgcggcggagtact

SEQ ID NO: 624 - DNA, 21 bp, Artificial Sequence
  Synthetic
cgtaagcattcgaattctgat

SEQ ID NO: 625 - DNA, 21 bp, Artificial Sequence
  Synthetic
tctaaggctaaggttactatt

SEQ ID NO: 626 - DNA, 21 bp, Artificial Sequence
  Synthetic
gttgatcggaagattagtcat

SEQ ID NO: 627 - DNA, 21 bp, Artificial Sequence
  Synthetic
agtactaagacggtgaagctg

SEQ ID NO: 628 - DNA, 21 bp, Artificial Sequence
  Synthetic
aagacgattcctcctagggtg

SEQ ID NO: 629 - DNA, 21 bp, Artificial Sequence
  Synthetic
tcgcgtgctcctaatcgtacg

SEQ ID NO: 630 - DNA, 21 bp, Artificial Sequence
  Synthetic
acgagggtgaagcatcctgct

SEQ ID NO: 631 - DNA, 21 bp, Artificial Sequence
  Synthetic
aaggctaaggttgcgagtatg

SEQ ID NO: 632 - DNA, 21 bp, Artificial Sequence
  Synthetic
gttaagaggaatatgatggat

SEQ ID NO: 633 - DNA, 21 bp, Artificial Sequence
  Synthetic
cctgatcagcggagggtttat

SEQ ID NO: 634 - DNA, 21 bp, Artificial Sequence
  Synthetic
actaagcagaggaatcctggg

SEQ ID NO: 635 - DNA, 21 bp, Artificial Sequence
  Synthetic
aggatggagaattcgaagggt

SEQ ID NO: 636 - DNA, 21 bp, Artificial Sequence
  Synthetic
aagcctcagattgggtattct

SEQ ID NO: 637 - DNA, 21 bp, Artificial Sequence
  Synthetic
agtcgggcgtctcgtgagaat

SEQ ID NO: 638 - DNA, 21 bp, Artificial Sequence
  Synthetic
ggtcgtcgtagtcttactgat

SEQ ID NO: 639 - DNA, 21 bp, Artificial Sequence
  Synthetic
cagcgtagtcctgctaagagg

SEQ ID NO: 640 - DNA, 21 bp, Artificial Sequence
  Synthetic
cttagttctgagcttcggaag

SEQ ID NO: 641 - DNA, 21 bp, Artificial Sequence
  Synthetic
aagcctaataaggcggtgaat

SEQ ID NO: 642 - DNA, 21 bp, Artificial Sequence
  Synthetic
gagatgaagcttcgtaatacg

SEQ ID NO: 643 - DNA, 21 bp, Artificial Sequence
  Synthetic
aggtcgccttatggtaataat

SEQ ID NO: 644 - DNA, 21 bp, Artificial Sequence
  Synthetic
gatgataagcgtaggatgact

SEQ ID NO: 645 - DNA, 21 bp, Artificial Sequence
  Synthetic
cctgataggaggagtattgtg

SEQ ID NO: 646 - DNA, 21 bp, Artificial Sequence
  Synthetic
aaggttactaataggcatgag

SEQ ID NO: 647 - DNA, 21 bp, Artificial Sequence
  Synthetic
agtaggcctcctccgaagtgt

SEQ ID NO: 648 - DNA, 21 bp, Artificial Sequence
  Synthetic
tttaatagggagcgtaataat

SEQ ID NO: 649 - DNA, 21 bp, Artificial Sequence
  Synthetic
aaggtgaataaggttattaat

SEQ ID NO: 650 - DNA, 21 bp, Artificial Sequence
  Synthetic
gataggaggactcggtctgag

SEQ ID NO: 651 - DNA, 21 bp, Artificial Sequence
  Synthetic
aggcctacgtcgaagccgaat

SEQ ID NO: 652 - DNA, 21 bp, Artificial Sequence
  Synthetic
atggcgggtagtccgaagaag

SEQ ID NO: 653 - DNA, 21 bp, Artificial Sequence
  Synthetic
tataaggcggttggtaggcag

SEQ ID NO: 654 - DNA, 21 bp, Artificial Sequence
  Synthetic
aggattagtgcggcgactacg

SEQ ID NO: 655 - DNA, 21 bp, Artificial Sequence
  Synthetic
agtaattctagtccgaggtgg

SEQ ID NO: 656 - DNA, 21 bp, Artificial Sequence
  Synthetic
ttgaagaatgggaggggtgtg

SEQ ID NO: 657 - DNA, 21 bp, Artificial Sequence
  Synthetic
cctcaggctaagaagccgctg

SEQ ID NO: 658 - DNA, 21 bp, Artificial Sequence
  Synthetic
aggacgatgcctacgaagatt

SEQ ID NO: 659 - DNA, 21 bp, Artificial Sequence
  Synthetic
aagagtgttgataagaagagt

SEQ ID NO: 660 - DNA, 21 bp, Artificial Sequence
  Synthetic
gatatggatcttggtatgggg

SEQ ID NO: 661 - DNA, 21 bp, Artificial Sequence
  Synthetic
ttgaataataagcaggttcgg

SEQ ID NO: 662 - DNA, 21 bp, Artificial Sequence
  Synthetic
actagggggaaggctcaggag

SEQ ID NO: 663 - DNA, 21 bp, Artificial Sequence
  Synthetic
acgaatgggcattataagggg

SEQ ID NO: 664 - DNA, 21 bp, Artificial Sequence
  Synthetic
gagactggtaagaagtggttt

SEQ ID NO: 665 - DNA, 21 bp, Artificial Sequence
  Synthetic
tctacggatcctcgtaagaag

SEQ ID NO: 666 - DNA, 21 bp, Artificial Sequence
  Synthetic
aagaaggcggggactggtact

SEQ ID NO: 667 - DNA, 21 bp, Artificial Sequence
  Synthetic
gattctaggcggtcgattgtt

SEQ ID NO: 668 - DNA, 21 bp, Artificial Sequence
  Synthetic
tcgtttggtcagcagtttgag

SEQ ID NO: 669 - DNA, 21 bp, Artificial Sequence
  Synthetic
agtacggagcgtaagtcgtat

SEQ ID NO: 670 - DNA, 21 bp, Artificial Sequence
  Synthetic
gtgagtagtaggcattcgaat

SEQ ID NO: 671 - DNA, 21 bp, Artificial Sequence
  Synthetic
agggttagtgcggcgaatacg

SEQ ID NO: 672 - DNA, 21 bp, Artificial Sequence
  Synthetic
ggtagggggaatagtgttctt

SEQ ID NO: 673 - DNA, 21 bp, Artificial Sequence
  Synthetic
cgtagtccgcgtgtgaatgct

SEQ ID NO: 674 - DNA, 21 bp, Artificial Sequence
  Synthetic
attcggaatcctaggatggct

SEQ ID NO: 675 - DNA, 21 bp, Artificial Sequence
  Synthetic
tcgactaggagtcagtctttg

SEQ ID NO: 676 - DNA, 21 bp, Artificial Sequence
  Synthetic
aggatggttcaggggactcag

SEQ ID NO: 677 - DNA, 21 bp, Artificial Sequence
  Synthetic
attaatgatcgggggaggggg

SEQ ID NO: 678 - DNA, 21 bp, Artificial Sequence
  Synthetic
ctgcttggtaagcggggggat

SEQ ID NO: 679 - DNA, 21 bp, Artificial Sequence
  Synthetic
tctaatgggatggataggagg

SEQ ID NO: 680 - DNA, 21 bp, Artificial Sequence
  Synthetic
ttgtcgcggtcttgggctggt

SEQ ID NO: 681 - DNA, 21 bp, Artificial Sequence
  Synthetic
cagagttctaggtctttgacg

SEQ ID NO: 682 - DNA, 21 bp, Artificial Sequence
  Synthetic
gattctcgtattaggaatttg

SEQ ID NO: 683 - DNA, 21 bp, Artificial Sequence
  Synthetic
agtaggaagatggataatttt

SEQ ID NO: 684 - DNA, 21 bp, Artificial Sequence
  Synthetic
cttgtgaatggtgctccgctg

SEQ ID NO: 685 - DNA, 21 bp, Artificial Sequence
  Synthetic
acggtgaggcgggaggatagg

SEQ ID NO: 686 - DNA, 21 bp, Artificial Sequence
  Synthetic
aggaatactaggactgaggcg

SEQ ID NO: 687 - DNA, 21 bp, Artificial Sequence
  Synthetic
gcgcggaggccgaattctgag

SEQ ID NO: 688 - DNA, 21 bp, Artificial Sequence
  Synthetic
cagagtagggagaggactaat

SEQ ID NO: 689 - DNA, 21 bp, Artificial Sequence
  Synthetic
attgagaagccgacttatcgt

SEQ ID NO: 690 - DNA, 21 bp, Artificial Sequence
  Synthetic
actgggaggactcagacgatg

SEQ ID NO: 691 - DNA, 21 bp, Artificial Sequence
  Synthetic
attaagatgctgaataagccg

SEQ ID NO: 692 - DNA, 21 bp, Artificial Sequence
  Synthetic
cataatgattttagtaagccg

SEQ ID NO: 693 - DNA, 21 bp, Artificial Sequence
  Synthetic
gctaagattaaggcgctgctg

SEQ ID NO: 694 - DNA, 21 bp, Artificial Sequence
  Synthetic
agggagacttggcataagaat

SEQ ID NO: 695 - DNA, 21 bp, Artificial Sequence
  Synthetic
atgactcgtcttgctaaggag

SEQ ID NO: 696 - DNA, 21 bp, Artificial Sequence
  Synthetic
gtggggaatgcgagggtgtat

SEQ ID NO: 697 - DNA, 21 bp, Artificial Sequence
  Synthetic
tttcagaggaagggggagaat

SEQ ID NO: 698 - DNA, 21 bp, Artificial Sequence
  Synthetic
tatcggagtagtcagttgacg

SEQ ID NO: 699 - DNA, 21 bp, Artificial Sequence
  Synthetic
gcggggaggctggttctgcag

SEQ ID NO: 700 - DNA, 21 bp, Artificial Sequence
  Synthetic
cgtagtatttcgtcgaatcct

SEQ ID NO: 701 - DNA, 21 bp, Artificial Sequence
  Synthetic
ggtacggtgaagactaataag

SEQ ID NO: 702 - DNA, 21 bp, Artificial Sequence
  Synthetic
aaggatcagaattatacgagg

SEQ ID NO: 703 - DNA, 21 bp, Artificial Sequence
  Synthetic
tatacgatgcttaggccttct

SEQ ID NO: 704 - DNA, 21 bp, Artificial Sequence
  Synthetic
gatcggacgcagactgttcgg

SEQ ID NO: 705 - DNA, 21 bp, Artificial Sequence
  Synthetic
attacgaggtttgatattaat

SEQ ID NO: 706 - DNA, 21 bp, Artificial Sequence
  Synthetic
agtgttcgtcgtattgatttt

SEQ ID NO: 707 - DNA, 21 bp, Artificial Sequence
  Synthetic
tttccgaataatcgggctaat

SEQ ID NO: 708 - DNA, 21 bp, Artificial Sequence
  Synthetic
atgcggcggactaatgatacg

SEQ ID NO: 709 - DNA, 21 bp, Artificial Sequence
  Synthetic
tatgatattaggcggggtttg

SEQ ID NO: 710 - DNA, 21 bp, Artificial Sequence
  Synthetic
tttgtgaagtctggtatgaat

SEQ ID NO: 711 - DNA, 21 bp, Artificial Sequence
  Synthetic
catgtgcatgttcgtactcat

SEQ ID NO: 712 - DNA, 21 bp, Artificial Sequence
  Synthetic
agggggaagatggagttgtat

SEQ ID NO: 713 - DNA, 21 bp, Artificial Sequence
  Synthetic
cgggaggtgcttcagcgtatt

SEQ ID NO: 714 - DNA, 21 bp, Artificial Sequence
  Synthetic
ggggagaggagtcctaggttg

SEQ ID NO: 715 - DNA, 21 bp, Artificial Sequence
  Synthetic
actcctactaatcctcgttgg

SEQ ID NO: 716 - DNA, 21 bp, Artificial Sequence
  Synthetic
tatcttcgggagtatggtaat

SEQ ID NO: 717 - DNA, 21 bp, Artificial Sequence
  Synthetic
actgagaggggtagggagacg

SEQ ID NO: 718 - DNA, 21 bp, Artificial Sequence
  Synthetic
tctaaggataatcatcggatg

SEQ ID NO: 719 - DNA, 21 bp, Artificial Sequence
  Synthetic
gatattcatggtgcgaatctt

SEQ ID NO: 720 - DNA, 21 bp, Artificial Sequence
  Synthetic
ctgccgaattatcatcagatt

SEQ ID NO: 721 - DNA, 21 bp, Artificial Sequence
  Synthetic
catagtgttggttatcttgat

SEQ ID NO: 722 - DNA, 21 bp, Artificial Sequence
  Synthetic
gctagtcttgctgataggccg

SEQ ID NO: 723 - DNA, 21 bp, Artificial Sequence
  Synthetic
tctgctgatcgtaagcatatt

SEQ ID NO: 724 - DNA, 21 bp, Artificial Sequence
  Synthetic
agtaagaatgatcatgagtat

SEQ ID NO: 725 - DNA, 21 bp, Artificial Sequence
  Synthetic
aagcaggctaggtctaatgag

SEQ ID NO: 726 - DNA, 21 bp, Artificial Sequence
  Synthetic
aggacgaatcatcctacttgg

SEQ ID NO: 727 - DNA, 21 bp, Artificial Sequence
  Synthetic
gatcgtaatattcgttcttcg

SEQ ID NO: 728 - DNA, 21 bp, Artificial Sequence
  Synthetic
cataaggcgcatgcgttggcg

SEQ ID NO: 729 - DNA, 21 bp, Artificial Sequence
  Synthetic
aatctgggggcgattaataag

SEQ ID NO: 730 - protein, 736 aa, Artificial Sequence
  Synthetic
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 731 - protein, 736 aa, Artificial Sequence
  Synthetic
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 732 - protein, 7 aa, Artificial Sequence
  Synthetic
SNLRPFI

SEQ ID NO: 733 - protein, 7 aa, Artificial Sequence
  Synthetic
TVRFNNV

SEQ ID NO: 734 - protein, 7 aa, Artificial Sequence
  Synthetic
RPSNVSW

SEQ ID NO: 735 - protein, 7 aa, Artificial Sequence
  Synthetic
SFDRPFI

SEQ ID NO: 736 - protein, 7 aa, Artificial Sequence
  Synthetic
FTLVTPK

SEQ ID NO: 737 - protein, 7 aa, Artificial Sequence
  Synthetic
SSKFINI

SEQ ID NO: 738 - protein, 7 aa, Artificial Sequence
  Synthetic
SVSKIFL

SEQ ID NO: 739 - protein, 7 aa, Artificial Sequence
  Synthetic
PPLFREL

SEQ ID NO: 740 - protein, 7 aa, Artificial Sequence
  Synthetic
SNMRPFI

SEQ ID NO: 741 - protein, 7 aa, Artificial Sequence
  Synthetic
DPHTISW

SEQ ID NO: 742 - protein, 7 aa, Artificial Sequence
  Synthetic
RLSFKDV

SEQ ID NO: 743 - protein, 7 aa, Artificial Sequence
  Synthetic
FTLTVPK

SEQ ID NO: 744 - protein, 7 aa, Artificial Sequence
  Synthetic
TSQIPFR

SEQ ID NO: 745 - protein, 7 aa, Artificial Sequence
  Synthetic
SVSMPFL

SEQ ID NO: 746 - protein, 7 aa, Artificial Sequence
  Synthetic
TFFATPP

SEQ ID NO: 747 - protein, 7 aa, Artificial Sequence
  Synthetic
QSVFASV

SEQ ID NO: 748 - protein, 7 aa, Artificial Sequence
  Synthetic
FTLTIPK

SEQ ID NO: 749 - protein, 7 aa, Artificial Sequence
  Synthetic
PDIARVF

SEQ ID NO: 750 - protein, 7 aa, Artificial Sequence
  Synthetic
MMAKPFL

SEQ ID NO: 751 - protein, 7 aa, Artificial Sequence
  Synthetic
YEKHFFK

SEQ ID NO: 752 - protein, 7 aa, Artificial Sequence
  Synthetic
SITNLYK

SEQ ID NO: 753 - protein, 7 aa, Artificial Sequence
  Synthetic
GVTHVFK

SEQ ID NO: 754 - protein, 7 aa, Artificial Sequence
  Synthetic
GVDRPFK

SEQ ID NO: 755 - protein, 7 aa, Artificial Sequence
  Synthetic
QVSKPFL

SEQ ID NO: 756 - protein, 7 aa, Artificial Sequence
  Synthetic
SQSKPFL

SEQ ID NO: 757 - protein, 7 aa, Artificial Sequence
  Synthetic
FTLTAPK

SEQ ID NO: 758 - protein, 7 aa, Artificial Sequence
  Synthetic
SIKQPWT

SEQ ID NO: 759 - protein, 7 aa, Artificial Sequence
  Synthetic
FTLTTPM

SEQ ID NO: 760 - protein, 7 aa, Artificial Sequence
  Synthetic
YEKHFFK

SEQ ID NO: 761 - protein, 7 aa, Artificial Sequence
  Synthetic
YVDRLFK

SEQ ID NO: 762 - protein, 7 aa, Artificial Sequence
  Synthetic
SITNLYK

SEQ ID NO: 763 - protein, 7 aa, Artificial Sequence
  Synthetic
SVSKPFY

SEQ ID NO: 764 - protein, 7 aa, Artificial Sequence
  Synthetic
SLSKPFS

SEQ ID NO: 765 - protein, 7 aa, Artificial Sequence
  Synthetic
SISKPFL

SEQ ID NO: 766 - protein, 7 aa, Artificial Sequence
  Synthetic
FTLTHPK

SEQ ID NO: 767 - protein, 7 aa, Artificial Sequence
  Synthetic
SQISMYK

SEQ ID NO: 768 - protein, 7 aa, Artificial Sequence
  Synthetic
PQIARVY

SEQ ID NO: 769 - protein, 7 aa, Artificial Sequence
  Synthetic
NERRPFL

SEQ ID NO: 770 - protein, 7 aa, Artificial Sequence
  Synthetic
GMFNPPS

SEQ ID NO: 771 - protein, 7 aa, Artificial Sequence
  Synthetic
TTMKPFN

SEQ ID NO: 772 - protein, 7 aa, Artificial Sequence
  Synthetic
TLSSPWT

SEQ ID NO: 773 - protein, 7 aa, Artificial Sequence
  Synthetic
SIARPFV

SEQ ID NO: 774 - protein, 7 aa, Artificial Sequence
  Synthetic
TIIFKDV

SEQ ID NO: 775 - protein, 7 aa, Artificial Sequence
  Synthetic
TVSKPFL

SEQ ID NO: 776 - protein, 7 aa, Artificial Sequence
  Synthetic
SVIKPFL

SEQ ID NO: 777 - protein, 7 aa, Artificial Sequence
  Synthetic
PLIARVY

SEQ ID NO: 778 - protein, 7 aa, Artificial Sequence
  Synthetic
KFTFGDV

SEQ ID NO: 779 - protein, 7 aa, Artificial Sequence
  Synthetic
SVMKPFL

SEQ ID NO: 780 - protein, 7 aa, Artificial Sequence
  Synthetic
SKDRPFI

SEQ ID NO: 781 - protein, 7 aa, Artificial Sequence
  Synthetic
IVSKPFL

SEQ ID NO: 782 - protein, 7 aa, Artificial Sequence
  Synthetic
TMDKPFH

SEQ ID NO: 783 - protein, 7 aa, Artificial Sequence
  Synthetic
TSMKPFL

SEQ ID NO: 784 - protein, 7 aa, Artificial Sequence
  Synthetic
SNMRPFI

SEQ ID NO: 785 - protein, 7 aa, Artificial Sequence
  Synthetic
SVSKIFL

SEQ ID NO: 786 - protein, 7 aa, Artificial Sequence
  Synthetic
SVAKPFL

SEQ ID NO: 787 - protein, 7 aa, Artificial Sequence
  Synthetic
TLPFPNR

SEQ ID NO: 788 - protein, 7 aa, Artificial Sequence
  Synthetic
FTITTPK

SEQ ID NO: 789 - protein, 7 aa, Artificial Sequence
  Synthetic
GLDNIFK

SEQ ID NO: 790 - protein, 7 aa, Artificial Sequence
  Synthetic
VGIALGR

SEQ ID NO: 791 - protein, 7 aa, Artificial Sequence
  Synthetic
QLKFTNV

SEQ ID NO: 792 - protein, 7 aa, Artificial Sequence
  Synthetic
KTSFHAI

SEQ ID NO: 793 - protein, 7 aa, Artificial Sequence
  Synthetic
SFSKPFL

SEQ ID NO: 794 - protein, 7 aa, Artificial Sequence
  Synthetic
RITFKDV

SEQ ID NO: 795 - protein, 7 aa, Artificial Sequence
  Synthetic
NVSKPFL

SEQ ID NO: 796 - protein, 7 aa, Artificial Sequence
  Synthetic
SLWGDHK

SEQ ID NO: 797 - protein, 7 aa, Artificial Sequence
  Synthetic
VPWNKQT

SEQ ID NO: 798 - protein, 7 aa, Artificial Sequence
  Synthetic
SLSKPFL

SEQ ID NO: 799 - protein, 7 aa, Artificial Sequence
  Synthetic
PDIARLY

SEQ ID NO: 800 - protein, 7 aa, Artificial Sequence
  Synthetic
MVSKPFL

SEQ ID NO: 801 - protein, 7 aa, Artificial Sequence
  Synthetic
PTIARVY

SEQ ID NO: 802 - protein, 7 aa, Artificial Sequence
  Synthetic
LDWPATK

SEQ ID NO: 803 - protein, 7 aa, Artificial Sequence
  Synthetic
DIERLFK

SEQ ID NO: 804 - protein, 7 aa, Artificial Sequence
  Synthetic
NQTSIYK

SEQ ID NO: 805 - protein, 7 aa, Artificial Sequence
  Synthetic
VVSKPFL

SEQ ID NO: 806 - protein, 7 aa, Artificial Sequence
  Synthetic
SAWGDHL

SEQ ID NO: 807 - protein, 7 aa, Artificial Sequence
  Synthetic
NERRPFL

SEQ ID NO: 808 - protein, 7 aa, Artificial Sequence
  Synthetic
TSQIPFR

SEQ ID NO: 809 - protein, 7 aa, Artificial Sequence
  Synthetic
SVMKPFL

SEQ ID NO: 810 - protein, 7 aa, Artificial Sequence
  Synthetic
TLGNVFK

SEQ ID NO: 811 - protein, 7 aa, Artificial Sequence
  Synthetic
ATKFALV

SEQ ID NO: 812 - protein, 7 aa, Artificial Sequence
  Synthetic
GVDRPFK

SEQ ID NO: 813 - protein, 7 aa, Artificial Sequence
  Synthetic
SHSKPFL

SEQ ID NO: 814 - protein, 7 aa, Artificial Sequence
  Synthetic
STSKPFL

SEQ ID NO: 815 - protein, 7 aa, Artificial Sequence
  Synthetic
TLTSPFR

SEQ ID NO: 816 - protein, 7 aa, Artificial Sequence
  Synthetic
SINKPFV

SEQ ID NO: 817 - protein, 7 aa, Artificial Sequence
  Synthetic
PTIARVY

SEQ ID NO: 818 - protein, 7 aa, Artificial Sequence
  Synthetic
YRDNIFK

SEQ ID NO: 819 - protein, 7 aa, Artificial Sequence
  Synthetic
FTMTTPK

SEQ ID NO: 820 - protein, 7 aa, Artificial Sequence
  Synthetic
SNSKPFL

SEQ ID NO: 821 - protein, 7 aa, Artificial Sequence
  Synthetic
NIIRPFA

SEQ ID NO: 822 - protein, 7 aa, Artificial Sequence
  Synthetic
TRTFKDV

SEQ ID NO: 823 - protein, 7 aa, Artificial Sequence
  Synthetic
FTLTHPK

SEQ ID NO: 824 - protein, 7 aa, Artificial Sequence
  Synthetic
GKWAPPA

SEQ ID NO: 825 - protein, 7 aa, Artificial Sequence
  Synthetic
SVSKPFF

SEQ ID NO: 826 - protein, 7 aa, Artificial Sequence
  Synthetic
SFARIGQ

SEQ ID NO: 827 - protein, 7 aa, Artificial Sequence
  Synthetic
SYSKPFL

SEQ ID NO: 828 - protein, 7 aa, Artificial Sequence
  Synthetic
FTLTTAK

SEQ ID NO: 829 - protein, 7 aa, Artificial Sequence
  Synthetic
NTLQVSK

SEQ ID NO: 830 - protein, 7 aa, Artificial Sequence
  Synthetic
FTLTSPK

SEQ ID NO: 831 - protein, 7 aa, Artificial Sequence
  Synthetic
SSSKPFL

SEQ ID NO: 832 - protein, 7 aa, Artificial Sequence
  Synthetic
FVEKFNR

SEQ ID NO: 833 - protein, 7 aa, Artificial Sequence
  Synthetic
PDIARFY

SEQ ID NO: 834 - protein, 7 aa, Artificial Sequence
  Synthetic
TLGNVFK

SEQ ID NO: 835 - protein, 7 aa, Artificial Sequence
  Synthetic
QTLFKNI

SEQ ID NO: 836 - protein, 7 aa, Artificial Sequence
  Synthetic
SVSKPFW

SEQ ID NO: 837 - protein, 7 aa, Artificial Sequence
  Synthetic
NIWSTNG

SEQ ID NO: 838 - protein, 7 aa, Artificial Sequence
  Synthetic
PMIARVY

SEQ ID NO: 839 - protein, 7 aa, Artificial Sequence
  Synthetic
SAWGDIK

SEQ ID NO: 840 - protein, 7 aa, Artificial Sequence
  Synthetic
FTLTMPK

SEQ ID NO: 841 - protein, 7 aa, Artificial Sequence
  Synthetic
SISKPFL

SEQ ID NO: 842 - protein, 7 aa, Artificial Sequence
  Synthetic
RIDNPFK

SEQ ID NO: 843 - protein, 7 aa, Artificial Sequence
  Synthetic
SGSKPFL

SEQ ID NO: 844 - protein, 7 aa, Artificial Sequence
  Synthetic
FTLSTPK

SEQ ID NO: 845 - protein, 7 aa, Artificial Sequence
  Synthetic
SVVKPFL

SEQ ID NO: 846 - protein, 7 aa, Artificial Sequence
  Synthetic
KSFAPPM

SEQ ID NO: 847 - protein, 7 aa, Artificial Sequence
  Synthetic
QTLFKNI

SEQ ID NO: 848 - protein, 7 aa, Artificial Sequence
  Synthetic
SASKPFL

SEQ ID NO: 849 - protein, 7 aa, Artificial Sequence
  Synthetic
FTLATPK

SEQ ID NO: 850 - protein, 7 aa, Artificial Sequence
  Synthetic
TVKFSVI

SEQ ID NO: 851 - protein, 7 aa, Artificial Sequence
  Synthetic
SAWGEHK

SEQ ID NO: 852 - protein, 7 aa, Artificial Sequence
  Synthetic
QLKFSHQ

SEQ ID NO: 853 - protein, 7 aa, Artificial Sequence
  Synthetic
GVLVPPR

SEQ ID NO: 854 - protein, 7 aa, Artificial Sequence
  Synthetic
YVSKPFL

SEQ ID NO: 855 - protein, 7 aa, Artificial Sequence
  Synthetic
FVSKPFL

SEQ ID NO: 856 - protein, 7 aa, Artificial Sequence
  Synthetic
QSHFASV

SEQ ID NO: 857 - protein, 7 aa, Artificial Sequence
  Synthetic
NTLQVSK

SEQ ID NO: 858 - protein, 7 aa, Artificial Sequence
  Synthetic
FTLLTPK

SEQ ID NO: 859 - protein, 7 aa, Artificial Sequence
  Synthetic
HGAQPFR

SEQ ID NO: 860 - protein, 7 aa, Artificial Sequence
  Synthetic
GSFVPPR

SEQ ID NO: 861 - protein, 7 aa, Artificial Sequence
  Synthetic
SLWGDHK

SEQ ID NO: 862 - protein, 7 aa, Artificial Sequence
  Synthetic
FTAQYPK

SEQ ID NO: 863 - protein, 7 aa, Artificial Sequence
  Synthetic
SPSKPFL

SEQ ID NO: 864 - protein, 7 aa, Artificial Sequence
  Synthetic
SVSKPFK

SEQ ID NO: 865 - protein, 7 aa, Artificial Sequence
  Synthetic
FTLSTPK

SEQ ID NO: 866 - protein, 7 aa, Artificial Sequence
  Synthetic
TIFFKDV

SEQ ID NO: 867 - protein, 7 aa, Artificial Sequence
  Synthetic
SVSKPFV

SEQ ID NO: 868 - protein, 7 aa, Artificial Sequence
  Synthetic
KTNFVHI

SEQ ID NO: 869 - protein, 7 aa, Artificial Sequence
  Synthetic
AGKFRDI

SEQ ID NO: 870 - protein, 7 aa, Artificial Sequence
  Synthetic
SVRFIDV

SEQ ID NO: 871 - protein, 7 aa, Artificial Sequence
  Synthetic
FTLTIPK

SEQ ID NO: 872 - protein, 7 aa, Artificial Sequence
  Synthetic
NLDKMFR

SEQ ID NO: 873 - protein, 7 aa, Artificial Sequence
  Synthetic
NTWFPNG

SEQ ID NO: 874 - protein, 7 aa, Artificial Sequence
  Synthetic
SVIKPFL

SEQ ID NO: 875 - protein, 7 aa, Artificial Sequence
  Synthetic
SHSKPFL

SEQ ID NO: 876 - protein, 7 aa, Artificial Sequence
  Synthetic
TLKFAYV

SEQ ID NO: 877 - protein, 7 aa, Artificial Sequence
  Synthetic
FTLTTSK

SEQ ID NO: 878 - protein, 7 aa, Artificial Sequence
  Synthetic
YVGNPFK

SEQ ID NO: 879 - protein, 7 aa, Artificial Sequence
  Synthetic
SVNKPFL

SEQ ID NO: 880 - protein, 7 aa, Artificial Sequence
  Synthetic
FTLTQPK

SEQ ID NO: 881 - protein, 7 aa, Artificial Sequence
  Synthetic
SNLRPFI

SEQ ID NO: 882 - protein, 7 aa, Artificial Sequence
  Synthetic
NHEWTKY

SEQ ID NO: 883 - protein, 7 aa, Artificial Sequence
  Synthetic
TISRPLL

SEQ ID NO: 884 - protein, 7 aa, Artificial Sequence
  Synthetic
LVSKPFL

SEQ ID NO: 885 - protein, 7 aa, Artificial Sequence
  Synthetic
NDLKYTR

SEQ ID NO: 886 - protein, 7 aa, Artificial Sequence
  Synthetic
KTNFVHI

SEQ ID NO: 887 - protein, 7 aa, Artificial Sequence
  Synthetic
SVNKPFL

SEQ ID NO: 888 - protein, 7 aa, Artificial Sequence
  Synthetic
LVPPANI

SEQ ID NO: 889 - protein, 7 aa, Artificial Sequence
  Synthetic
SNPRPFI

SEQ ID NO: 890 - protein, 7 aa, Artificial Sequence
  Synthetic
QLANPFQ

SEQ ID NO: 891 - protein, 7 aa, Artificial Sequence
  Synthetic
QLKFTNV

SEQ ID NO: 892 - protein, 7 aa, Artificial Sequence
  Synthetic
FTIQTSK

SEQ ID NO: 893 - protein, 7 aa, Artificial Sequence
  Synthetic
SPSKPFL

SEQ ID NO: 894 - protein, 7 aa, Artificial Sequence
  Synthetic
SVSKPFI

SEQ ID NO: 895 - protein, 7 aa, Artificial Sequence
  Synthetic
SVSKPFV

SEQ ID NO: 896 - protein, 7 aa, Artificial Sequence
  Synthetic
SVSKPFS

SEQ ID NO: 897 - protein, 7 aa, Artificial Sequence
  Synthetic
DLFSDKR

SEQ ID NO: 898 - protein, 7 aa, Artificial Sequence
  Synthetic
SVAKPFL

SEQ ID NO: 899 - protein, 7 aa, Artificial Sequence
  Synthetic
TLKFAYV

SEQ ID NO: 900 - protein, 7 aa, Artificial Sequence
  Synthetic
TKQFQNV

SEQ ID NO: 901 - protein, 7 aa, Artificial Sequence
  Synthetic
LVPPNNE

SEQ ID NO: 902 - protein, 7 aa, Artificial Sequence
  Synthetic
SVLKPFL

SEQ ID NO: 903 - protein, 7 aa, Artificial Sequence
  Synthetic
SNVRPFI

SEQ ID NO: 904 - protein, 7 aa, Artificial Sequence
  Synthetic
TITFKHV

SEQ ID NO: 905 - protein, 7 aa, Artificial Sequence
  Synthetic
TIGSLFK

SEQ ID NO: 906 - protein, 7 aa, Artificial Sequence
  Synthetic
SMSKPFL

SEQ ID NO: 907 - protein, 7 aa, Artificial Sequence
  Synthetic
SVEKPFL

SEQ ID NO: 908 - protein, 7 aa, Artificial Sequence
  Synthetic
PQSNMSW

SEQ ID NO: 909 - protein, 7 aa, Artificial Sequence
  Synthetic
SVSLPFL

SEQ ID NO: 910 - protein, 7 aa, Artificial Sequence
  Synthetic
TISRPLL

SEQ ID NO: 911 - protein, 7 aa, Artificial Sequence
  Synthetic
SVTKPFL

SEQ ID NO: 912 - protein, 7 aa, Artificial Sequence
  Synthetic
SVSKPFT

SEQ ID NO: 913 - protein, 7 aa, Artificial Sequence
  Synthetic
SRDRPFI

SEQ ID NO: 914 - protein, 7 aa, Artificial Sequence
  Synthetic
SNSRPFI

SEQ ID NO: 915 - protein, 7 aa, Artificial Sequence
  Synthetic
SSDRPWI

SEQ ID NO: 916 - protein, 7 aa, Artificial Sequence
  Synthetic
TVMAPFK

SEQ ID NO: 917 - protein, 7 aa, Artificial Sequence
  Synthetic
PEIARVY

SEQ ID NO: 918 - protein, 7 aa, Artificial Sequence
  Synthetic
FSLTTPK

SEQ ID NO: 919 - protein, 7 aa, Artificial Sequence
  Synthetic
PSIARVY

SEQ ID NO: 920 - protein, 7 aa, Artificial Sequence
  Synthetic
SVGKPFL

SEQ ID NO: 921 - protein, 7 aa, Artificial Sequence
  Synthetic
SNSRPFI

SEQ ID NO: 922 - protein, 7 aa, Artificial Sequence
  Synthetic
SVWALNG

SEQ ID NO: 923 - protein, 7 aa, Artificial Sequence
  Synthetic
YVSKPFL

SEQ ID NO: 924 - protein, 7 aa, Artificial Sequence
  Synthetic
RPSNVSW

SEQ ID NO: 925 - protein, 7 aa, Artificial Sequence
  Synthetic
SVHKPFL

SEQ ID NO: 926 - protein, 7 aa, Artificial Sequence
  Synthetic
TIRFKDV

SEQ ID NO: 927 - protein, 7 aa, Artificial Sequence
  Synthetic
SIDRPFI

SEQ ID NO: 928 - protein, 7 aa, Artificial Sequence
  Synthetic
KSFAPPM

SEQ ID NO: 929 - protein, 7 aa, Artificial Sequence
  Synthetic
TGTSPFK

SEQ ID NO: 930 - protein, 7 aa, Artificial Sequence
  Synthetic
QSNFGKF

SEQ ID NO: 931 - protein, 7 aa, Artificial Sequence
  Synthetic
FTLTTSK

SEQ ID NO: 932 - protein, 7 aa, Artificial Sequence
  Synthetic
SNTRPFI

SEQ ID NO: 933 - protein, 7 aa, Artificial Sequence
  Synthetic
ATKFALV

SEQ ID NO: 934 - protein, 7 aa, Artificial Sequence
  Synthetic
SVDKPFL

SEQ ID NO: 935 - protein, 7 aa, Artificial Sequence
  Synthetic
FTLHTPK

SEQ ID NO: 936 - protein, 7 aa, Artificial Sequence
  Synthetic
FTLTTPY

SEQ ID NO: 937 - protein, 7 aa, Artificial Sequence
  Synthetic
SVSKPFM

SEQ ID NO: 938 - protein, 7 aa, Artificial Sequence
  Synthetic
QVSKPFL

SEQ ID NO: 939 - protein, 7 aa, Artificial Sequence
  Synthetic
TRDLPFK

SEQ ID NO: 940 - protein, 7 aa, Artificial Sequence
  Synthetic
DKKGWVA

SEQ ID NO: 941 - protein, 7 aa, Artificial Sequence
  Synthetic
DPRGWTP

SEQ ID NO: 942 - protein, 7 aa, Artificial Sequence
  Synthetic
SVGKPFL

SEQ ID NO: 943 - protein, 7 aa, Artificial Sequence
  Synthetic
NAFSPKL

SEQ ID NO: 944 - protein, 7 aa, Artificial Sequence
  Synthetic
SAWGDNK

SEQ ID NO: 945 - protein, 7 aa, Artificial Sequence
  Synthetic
SLSKPFS

SEQ ID NO: 946 - protein, 7 aa, Artificial Sequence
  Synthetic
EGRLLGK

SEQ ID NO: 947 - protein, 7 aa, Artificial Sequence
  Synthetic
SKTGWMA

SEQ ID NO: 948 - protein, 7 aa, Artificial Sequence
  Synthetic
SVSKPFM

SEQ ID NO: 949 - protein, 7 aa, Artificial Sequence
  Synthetic
NNFTPPK

SEQ ID NO: 950 - protein, 7 aa, Artificial Sequence
  Synthetic
NMFSANL

SEQ ID NO: 951 - protein, 7 aa, Artificial Sequence
  Synthetic
GVSKPFL

SEQ ID NO: 952 - protein, 7 aa, Artificial Sequence
  Synthetic
FTIQTSK

SEQ ID NO: 953 - protein, 7 aa, Artificial Sequence
  Synthetic
SASKPFL

SEQ ID NO: 954 - protein, 7 aa, Artificial Sequence
  Synthetic
HDLKLFK

SEQ ID NO: 955 - protein, 7 aa, Artificial Sequence
  Synthetic
SVVKPFL

SEQ ID NO: 956 - protein, 7 aa, Artificial Sequence
  Synthetic
SPWGDHK

SEQ ID NO: 957 - protein, 7 aa, Artificial Sequence
  Synthetic
DMERPFK

SEQ ID NO: 958 - protein, 7 aa, Artificial Sequence
  Synthetic
SAWGDHK

SEQ ID NO: 959 - protein, 7 aa, Artificial Sequence
  Synthetic
MTMATSR

SEQ ID NO: 960 - protein, 7 aa, Artificial Sequence
  Synthetic
PDIARYY

SEQ ID NO: 961 - protein, 7 aa, Artificial Sequence
  Synthetic
SAWGDMK

SEQ ID NO: 962 - protein, 7 aa, Artificial Sequence
  Synthetic
FTLTTPR

SEQ ID NO: 963 - protein, 7 aa, Artificial Sequence
  Synthetic
TITFKNV

SEQ ID NO: 964 - protein, 7 aa, Artificial Sequence
  Synthetic
TIRFKDV

SEQ ID NO: 965 - protein, 7 aa, Artificial Sequence
  Synthetic
GYTMPFS

SEQ ID NO: 966 - protein, 7 aa, Artificial Sequence
  Synthetic
SLTTPFK

SEQ ID NO: 967 - protein, 7 aa, Artificial Sequence
  Synthetic
SVSKVFL

SEQ ID NO: 968 - protein, 7 aa, Artificial Sequence
  Synthetic
FTAQYPK

SEQ ID NO: 969 - protein, 7 aa, Artificial Sequence
  Synthetic
KQNMAHI

SEQ ID NO: 970 - protein, 7 aa, Artificial Sequence
  Synthetic
EGRLLGK

SEQ ID NO: 971 - protein, 7 aa, Artificial Sequence
  Synthetic
FTLTYPK

SEQ ID NO: 972 - protein, 7 aa, Artificial Sequence
  Synthetic
LVSKPFL

SEQ ID NO: 973 - protein, 7 aa, Artificial Sequence
  Synthetic
PNIARVY

SEQ ID NO: 974 - protein, 7 aa, Artificial Sequence
  Synthetic
RIDNPFK

SEQ ID NO: 975 - protein, 7 aa, Artificial Sequence
  Synthetic
MVSKPFL

SEQ ID NO: 976 - protein, 7 aa, Artificial Sequence
  Synthetic
KITFKDV

SEQ ID NO: 977 - protein, 7 aa, Artificial Sequence
  Synthetic
SAWGDLK

SEQ ID NO: 978 - protein, 7 aa, Artificial Sequence
  Synthetic
GVSKPFL

SEQ ID NO: 979 - protein, 7 aa, Artificial Sequence
  Synthetic
WSLNSAK

SEQ ID NO: 980 - protein, 7 aa, Artificial Sequence
  Synthetic
SNARPFI

SEQ ID NO: 981 - protein, 7 aa, Artificial Sequence
  Synthetic
SADRPFI

SEQ ID NO: 982 - protein, 7 aa, Artificial Sequence
  Synthetic
SVHKPFL

SEQ ID NO: 983 - protein, 7 aa, Artificial Sequence
  Synthetic
SVLKPFL

SEQ ID NO: 984 - protein, 7 aa, Artificial Sequence
  Synthetic
TKTFKDV

SEQ ID NO: 985 - protein, 7 aa, Artificial Sequence
  Synthetic
SNTRPFI

SEQ ID NO: 986 - protein, 7 aa, Artificial Sequence
  Synthetic
NTTSTSK

SEQ ID NO: 987 - protein, 7 aa, Artificial Sequence
  Synthetic
WDLKGPK

SEQ ID NO: 988 - protein, 7 aa, Artificial Sequence
  Synthetic
MMAKPFL

SEQ ID NO: 989 - protein, 7 aa, Artificial Sequence
  Synthetic
SVSKPFI

SEQ ID NO: 990 - protein, 7 aa, Artificial Sequence
  Synthetic
SNPRPFI

SEQ ID NO: 991 - protein, 7 aa, Artificial Sequence
  Synthetic
SVPKPFL

SEQ ID NO: 992 - protein, 7 aa, Artificial Sequence
  Synthetic
TIKFKDV

SEQ ID NO: 993 - protein, 7 aa, Artificial Sequence
  Synthetic
PAIARVY

SEQ ID NO: 994 - protein, 7 aa, Artificial Sequence
  Synthetic
QTKFNSV

SEQ ID NO: 995 - protein, 7 aa, Artificial Sequence
  Synthetic
PMIATQF

SEQ ID NO: 996 - protein, 7 aa, Artificial Sequence
  Synthetic
WITFKDV

SEQ ID NO: 997 - protein, 7 aa, Artificial Sequence
  Synthetic
VGIALGR

SEQ ID NO: 998 - protein, 7 aa, Artificial Sequence
  Synthetic
PAIARVY

SEQ ID NO: 999 - protein, 7 aa, Artificial Sequence
  Synthetic
NNFTPPK

SEQ ID NO: 1000 - protein, 7 aa, Artificial Sequence
  Synthetic
SRDRPFI

SEQ ID NO: 1001 - protein, 7 aa, Artificial Sequence
  Synthetic
FTLQTPK

SEQ ID NO: 1002 - protein, 7 aa, Artificial Sequence
  Synthetic
SQDRPFI

SEQ ID NO: 1003 - protein, 7 aa, Artificial Sequence
  Synthetic
SVSKPFN

SEQ ID NO: 1004 - protein, 7 aa, Artificial Sequence
  Synthetic
SNQRPFI

SEQ ID NO: 1005 - protein, 7 aa, Artificial Sequence
  Synthetic
SVSRPFL

SEQ ID NO: 1006 - protein, 7 aa, Artificial Sequence
  Synthetic
MSLRTSI

SEQ ID NO: 1007 - protein, 7 aa, Artificial Sequence
  Synthetic
QITFKDV

SEQ ID NO: 1008 - protein, 7 aa, Artificial Sequence
  Synthetic
PDIARVY

SEQ ID NO: 1009 - protein, 7 aa, Artificial Sequence
  Synthetic
PDIARAY

SEQ ID NO: 1010 - protein, 7 aa, Artificial Sequence
  Synthetic
MVEFHKV

SEQ ID NO: 1011 - protein, 7 aa, Artificial Sequence
  Synthetic
SNIRPFI

SEQ ID NO: 1012 - protein, 7 aa, Artificial Sequence
  Synthetic
SMDRPFI

SEQ ID NO: 1013 - protein, 7 aa, Artificial Sequence
  Synthetic
EGRAFGT

SEQ ID NO: 1014 - protein, 7 aa, Artificial Sequence
  Synthetic
TSLSTSR

SEQ ID NO: 1015 - protein, 7 aa, Artificial Sequence
  Synthetic
NNTQIFR

SEQ ID NO: 1016 - protein, 7 aa, Artificial Sequence
  Synthetic
SNQRPFI

SEQ ID NO: 1017 - protein, 7 aa, Artificial Sequence
  Synthetic
KQNMAHI

SEQ ID NO: 1018 - protein, 7 aa, Artificial Sequence
  Synthetic
PDIARMY

SEQ ID NO: 1019 - protein, 7 aa, Artificial Sequence
  Synthetic
TIKFKDV

SEQ ID NO: 1020 - protein, 7 aa, Artificial Sequence
  Synthetic
SNHRPFI

SEQ ID NO: 1021 - protein, 7 aa, Artificial Sequence
  Synthetic
FTITTPK

SEQ ID NO: 1022 - protein, 7 aa, Artificial Sequence
  Synthetic
PIIARVY

SEQ ID NO: 1023 - protein, 7 aa, Artificial Sequence
  Synthetic
STSKPFL

SEQ ID NO: 1024 - protein, 7 aa, Artificial Sequence
  Synthetic
HGAQPFR

SEQ ID NO: 1025 - protein, 7 aa, Artificial Sequence
  Synthetic
FTFTTPK

SEQ ID NO: 1026 - protein, 7 aa, Artificial Sequence
  Synthetic
SETHLFR

SEQ ID NO: 1027 - protein, 7 aa, Artificial Sequence
  Synthetic
FTLITPK

SEQ ID NO: 1028 - protein, 7 aa, Artificial Sequence
  Synthetic
PDIARLY

SEQ ID NO: 1029 - protein, 7 aa, Artificial Sequence
  Synthetic
SKDRPFI

SEQ ID NO: 1030 - protein, 7 aa, Artificial Sequence
  Synthetic
IQGRFNV

SEQ ID NO: 1031 - protein, 7 aa, Artificial Sequence
  Synthetic
STTFKDI

SEQ ID NO: 1032 - protein, 7 aa, Artificial Sequence
  Synthetic
SLDFKNI

SEQ ID NO: 1033 - protein, 7 aa, Artificial Sequence
  Synthetic
LRNMPFH

SEQ ID NO: 1034 - protein, 7 aa, Artificial Sequence
  Synthetic
HITFKDV

SEQ ID NO: 1035 - protein, 7 aa, Artificial Sequence
  Synthetic
TILFKDV

SEQ ID NO: 1036 - protein, 7 aa, Artificial Sequence
  Synthetic
ITMETSR

SEQ ID NO: 1037 - protein, 7 aa, Artificial Sequence
  Synthetic
SVYKPFL

SEQ ID NO: 1038 - protein, 7 aa, Artificial Sequence
  Synthetic
SPDRPFI

SEQ ID NO: 1039 - protein, 7 aa, Artificial Sequence
  Synthetic
SVPKPFL

SEQ ID NO: 1040 - protein, 7 aa, Artificial Sequence
  Synthetic
TMKFADI

SEQ ID NO: 1041 - protein, 7 aa, Artificial Sequence
  Synthetic
KDKFKDI

SEQ ID NO: 1042 - protein, 7 aa, Artificial Sequence
  Synthetic
YETQYFK

SEQ ID NO: 1043 - protein, 7 aa, Artificial Sequence
  Synthetic
HITFKDV

SEQ ID NO: 1044 - protein, 7 aa, Artificial Sequence
  Synthetic
FTQTTPK

SEQ ID NO: 1045 - protein, 7 aa, Artificial Sequence
  Synthetic
SASSIFK

SEQ ID NO: 1046 - protein, 7 aa, Artificial Sequence
  Synthetic
PMIATQF

SEQ ID NO: 1047 - protein, 7 aa, Artificial Sequence
  Synthetic
RITFKDV

SEQ ID NO: 1048 - protein, 7 aa, Artificial Sequence
  Synthetic
PDIARHY

SEQ ID NO: 1049 - protein, 7 aa, Artificial Sequence
  Synthetic
TVFGTRT

SEQ ID NO: 1050 - protein, 7 aa, Artificial Sequence
  Synthetic
HVSKPFL

SEQ ID NO: 1051 - protein, 7 aa, Artificial Sequence
  Synthetic
TSLSTSR

SEQ ID NO: 1052 - protein, 7 aa, Artificial Sequence
  Synthetic
SNERPFI

SEQ ID NO: 1053 - protein, 7 aa, Artificial Sequence
  Synthetic
NAFSPKL

SEQ ID NO: 1054 - protein, 7 aa, Artificial Sequence
  Synthetic
SVSKPFQ

SEQ ID NO: 1055 - protein, 7 aa, Artificial Sequence
  Synthetic
SVWGDHK

SEQ ID NO: 1056 - protein, 7 aa, Artificial Sequence
  Synthetic
SIARPFV

SEQ ID NO: 1057 - protein, 7 aa, Artificial Sequence
  Synthetic
TSMKPFL

SEQ ID NO: 1058 - protein, 7 aa, Artificial Sequence
  Synthetic
TVANPFH

SEQ ID NO: 1059 - protein, 7 aa, Artificial Sequence
  Synthetic
SNVRPFI

SEQ ID NO: 1060 - protein, 7 aa, Artificial Sequence
  Synthetic
SSSKPFL

SEQ ID NO: 1061 - protein, 7 aa, Artificial Sequence
  Synthetic
FVSKPFL

SEQ ID NO: 1062 - protein, 7 aa, Artificial Sequence
  Synthetic
SVSKPFT

SEQ ID NO: 1063 - protein, 7 aa, Artificial Sequence
  Synthetic
KAAFDHI

SEQ ID NO: 1064 - protein, 7 aa, Artificial Sequence
  Synthetic
SMDRPFI

SEQ ID NO: 1065 - protein, 7 aa, Artificial Sequence
  Synthetic
PQIARVY

SEQ ID NO: 1066 - protein, 7 aa, Artificial Sequence
  Synthetic
MSLRTSI

SEQ ID NO: 1067 - protein, 7 aa, Artificial Sequence
  Synthetic
FTLATPK

SEQ ID NO: 1068 - protein, 7 aa, Artificial Sequence
  Synthetic
PSIARVY

SEQ ID NO: 1069 - protein, 7 aa, Artificial Sequence
  Synthetic
NTVSTSR

SEQ ID NO: 1070 - protein, 7 aa, Artificial Sequence
  Synthetic
HDLKLFK

SEQ ID NO: 1071 - protein, 7 aa, Artificial Sequence
  Synthetic
TITFKSV

SEQ ID NO: 1072 - protein, 7 aa, Artificial Sequence
  Synthetic
IVSKPFL

SEQ ID NO: 1073 - protein, 7 aa, Artificial Sequence
  Synthetic
NTTSTSK

SEQ ID NO: 1074 - protein, 7 aa, Artificial Sequence
  Synthetic
SVSKPFY

SEQ ID NO: 1075 - protein, 7 aa, Artificial Sequence
  Synthetic
FTLKTPK

SEQ ID NO: 1076 - protein, 7 aa, Artificial Sequence
  Synthetic
NFTTVFH

SEQ ID NO: 1077 - protein, 7 aa, Artificial Sequence
  Synthetic
FTVTTPK

SEQ ID NO: 1078 - protein, 7 aa, Artificial Sequence
  Synthetic
SNDRPFK

SEQ ID NO: 1079 - protein, 7 aa, Artificial Sequence
  Synthetic
VGVALGM

SEQ ID NO: 1080 - protein, 7 aa, Artificial Sequence
  Synthetic
FTLTSPK

SEQ ID NO: 1081 - protein, 7 aa, Artificial Sequence
  Synthetic
MTMATSR

SEQ ID NO: 1082 - protein, 7 aa, Artificial Sequence
  Synthetic
SGSKPFL

SEQ ID NO: 1083 - protein, 7 aa, Artificial Sequence
  Synthetic
NTVSTSR

SEQ ID NO: 1084 - protein, 7 aa, Artificial Sequence
  Synthetic
TMKFADI

SEQ ID NO: 1085 - protein, 7 aa, Artificial Sequence
  Synthetic
YVGNPFK

SEQ ID NO: 1086 - protein, 7 aa, Artificial Sequence
  Synthetic
SNARPFI

SEQ ID NO: 1087 - protein, 7 aa, Artificial Sequence
  Synthetic
SNNRPFI

SEQ ID NO: 1088 - protein, 7 aa, Artificial Sequence
  Synthetic
IGVRLGT

SEQ ID NO: 1089 - protein, 7 aa, Artificial Sequence
  Synthetic
NSLHASK

SEQ ID NO: 1090 - protein, 7 aa, Artificial Sequence
  Synthetic
GVTHVFK

SEQ ID NO: 1091 - protein, 7 aa, Artificial Sequence
  Synthetic
TRTFKDV

SEQ ID NO: 1092 - protein, 7 aa, Artificial Sequence
  Synthetic
SVSKPFQ

SEQ ID NO: 1093 - protein, 7 aa, Artificial Sequence
  Synthetic
TDMKYLY

SEQ ID NO: 1094 - protein, 7 aa, Artificial Sequence
  Synthetic
VVSKPFL

SEQ ID NO: 1095 - protein, 7 aa, Artificial Sequence
  Synthetic
TKQFQNV

SEQ ID NO: 1096 - protein, 7 aa, Artificial Sequence
  Synthetic
SLSKPFL

SEQ ID NO: 1097 - protein, 7 aa, Artificial Sequence
  Synthetic
TITFKYV

SEQ ID NO: 1098 - protein, 7 aa, Artificial Sequence
  Synthetic
SVDRPFI

SEQ ID NO: 1099 - protein, 7 aa, Artificial Sequence
  Synthetic
FTLMTPK

SEQ ID NO: 1100 - protein, 7 aa, Artificial Sequence
  Synthetic
VGVQFGK

SEQ ID NO: 1101 - protein, 7 aa, Artificial Sequence
  Synthetic
FTTTTPK

SEQ ID NO: 1102 - protein, 7 aa, Artificial Sequence
  Synthetic
KTQFKDV

SEQ ID NO: 1103 - protein, 7 aa, Artificial Sequence
  Synthetic
WITFKDV

SEQ ID NO: 1104 - protein, 7 aa, Artificial Sequence
  Synthetic
MGLSPPR

SEQ ID NO: 1105 - protein, 7 aa, Artificial Sequence
  Synthetic
SNIRPFI

SEQ ID NO: 1106 - protein, 7 aa, Artificial Sequence
  Synthetic
SNSKPFL

SEQ ID NO: 1107 - protein, 7 aa, Artificial Sequence
  Synthetic
PEIARVY

SEQ ID NO: 1108 - protein, 7 aa, Artificial Sequence
  Synthetic
TVSKPFL

SEQ ID NO: 1109 - protein, 7 aa, Artificial Sequence
  Synthetic
NNMHTSR

SEQ ID NO: 1110 - protein, 7 aa, Artificial Sequence
  Synthetic
LGRALGN

SEQ ID NO: 1111 - protein, 7 aa, Artificial Sequence
  Synthetic
SLDRPFI

SEQ ID NO: 1112 - protein, 7 aa, Artificial Sequence
  Synthetic
GMRSFTV

SEQ ID NO: 1113 - protein, 7 aa, Artificial Sequence
  Synthetic
SETHLFR

SEQ ID NO: 1114 - protein, 7 aa, Artificial Sequence
  Synthetic
SVSKPFH

SEQ ID NO: 1115 - protein, 7 aa, Artificial Sequence
  Synthetic
QTRLASV

SEQ ID NO: 1116 - protein, 7 aa, Artificial Sequence
  Synthetic
RIFTEPP

SEQ ID NO: 1117 - protein, 7 aa, Artificial Sequence
  Synthetic
SVTKPFL

SEQ ID NO: 1118 - protein, 7 aa, Artificial Sequence
  Synthetic
SINKPFV

SEQ ID NO: 1119 - protein, 7 aa, Artificial Sequence
  Synthetic
RPMNASH

SEQ ID NO: 1120 - protein, 7 aa, Artificial Sequence
  Synthetic
SADRPFI

SEQ ID NO: 1121 - protein, 7 aa, Artificial Sequence
  Synthetic
VEFTPPK

SEQ ID NO: 1122 - protein, 7 aa, Artificial Sequence
  Synthetic
FTLTTGK

SEQ ID NO: 1123 - protein, 7 aa, Artificial Sequence
  Synthetic
PQSNMSW

SEQ ID NO: 1124 - protein, 7 aa, Artificial Sequence
  Synthetic
LTLTSSK

SEQ ID NO: 1125 - protein, 7 aa, Artificial Sequence
  Synthetic
VGVALGM

SEQ ID NO: 1126 - protein, 7 aa, Artificial Sequence
  Synthetic
TKTFKDV

SEQ ID NO: 1127 - protein, 7 aa, Artificial Sequence
  Synthetic
SVSKPFF

SEQ ID NO: 1128 - protein, 7 aa, Artificial Sequence
  Synthetic
SNKFENV

SEQ ID NO: 1129 - protein, 7 aa, Artificial Sequence
  Synthetic
SFSKPFL

SEQ ID NO: 1130 - protein, 7 aa, Artificial Sequence
  Synthetic
TDLGYAR

SEQ ID NO: 1131 - protein, 7 aa, Artificial Sequence
  Synthetic
TFTFKDV

SEQ ID NO: 1132 - protein, 7 aa, Artificial Sequence
  Synthetic
TSMSVSR

SEQ ID NO: 1133 - protein, 7 aa, Artificial Sequence
  Synthetic
FTLDTPK

SEQ ID NO: 1134 - protein, 7 aa, Artificial Sequence
  Synthetic
QLKFSHQ

SEQ ID NO: 1135 - protein, 7 aa, Artificial Sequence
  Synthetic
FTLTTAK

SEQ ID NO: 1136 - protein, 7 aa, Artificial Sequence
  Synthetic
TIQSPWK

SEQ ID NO: 1137 - protein, 7 aa, Artificial Sequence
  Synthetic
PDIARIY

SEQ ID NO: 1138 - protein, 7 aa, Artificial Sequence
  Synthetic
TDTRPFI

SEQ ID NO: 1139 - protein, 7 aa, Artificial Sequence
  Synthetic
SANKPFT

SEQ ID NO: 1140 - protein, 7 aa, Artificial Sequence
  Synthetic
NNTQIFR

SEQ ID NO: 1141 - protein, 7 aa, Artificial Sequence
  Synthetic
SVSMPFL

SEQ ID NO: 1142 - protein, 7 aa, Artificial Sequence
  Synthetic
ITMSTSI

SEQ ID NO: 1143 - protein, 7 aa, Artificial Sequence
  Synthetic
SAQYPIR

SEQ ID NO: 1144 - protein, 7 aa, Artificial Sequence
  Synthetic
TNDRPFI

SEQ ID NO: 1145 - protein, 7 aa, Artificial Sequence
  Synthetic
GSWIPPE

SEQ ID NO: 1146 - protein, 7 aa, Artificial Sequence
  Synthetic
GSFVPPR

SEQ ID NO: 1147 - protein, 7 aa, Artificial Sequence
  Synthetic
PRIADSY

SEQ ID NO: 1148 - protein, 7 aa, Artificial Sequence
  Synthetic
SVSKPFW

SEQ ID NO: 1149 - protein, 7 aa, Artificial Sequence
  Synthetic
GLDNIFK

SEQ ID NO: 1150 - protein, 7 aa, Artificial Sequence
  Synthetic
SAWGDFK

SEQ ID NO: 1151 - protein, 7 aa, Artificial Sequence
  Synthetic
SVSKPFN

SEQ ID NO: 1152 - protein, 7 aa, Artificial Sequence
  Synthetic
FTLTEPK

SEQ ID NO: 1153 - protein, 7 aa, Artificial Sequence
  Synthetic
TDTRPFI

SEQ ID NO: 1154 - protein, 7 aa, Artificial Sequence
  Synthetic
VGVQFGK

SEQ ID NO: 1155 - protein, 7 aa, Artificial Sequence
  Synthetic
HVSKPFL

SEQ ID NO: 1156 - protein, 7 aa, Artificial Sequence
  Synthetic
NIIRPFA

SEQ ID NO: 1157 - protein, 7 aa, Artificial Sequence
  Synthetic
STDRPFI

SEQ ID NO: 1158 - protein, 7 aa, Artificial Sequence
  Synthetic
TVKFSVI

SEQ ID NO: 1159 - protein, 7 aa, Artificial Sequence
  Synthetic
TIVFKDV

SEQ ID NO: 1160 - protein, 7 aa, Artificial Sequence
  Synthetic
VEFTPPK

SEQ ID NO: 1161 - protein, 7 aa, Artificial Sequence
  Synthetic
DNKNLFR

SEQ ID NO: 1162 - protein, 7 aa, Artificial Sequence
  Synthetic
SHDRPFI

SEQ ID NO: 1163 - protein, 7 aa, Artificial Sequence
  Synthetic
VAVFKNV

SEQ ID NO: 1164 - protein, 7 aa, Artificial Sequence
  Synthetic
SLKSVFS

SEQ ID NO: 1165 - protein, 7 aa, Artificial Sequence
  Synthetic
QKQFMNQ

SEQ ID NO: 1166 - protein, 7 aa, Artificial Sequence
  Synthetic
TPWHPHG

SEQ ID NO: 1167 - protein, 7 aa, Artificial Sequence
  Synthetic
SVFKPFL

SEQ ID NO: 1168 - protein, 7 aa, Artificial Sequence
  Synthetic
SESKPFL

SEQ ID NO: 1169 - protein, 7 aa, Artificial Sequence
  Synthetic
SMSKPFL

SEQ ID NO: 1170 - protein, 7 aa, Artificial Sequence
  Synthetic
GSTGWIA

SEQ ID NO: 1171 - protein, 7 aa, Artificial Sequence
  Synthetic
SLTTPFK

SEQ ID NO: 1172 - protein, 7 aa, Artificial Sequence
  Synthetic
DMERPFK

SEQ ID NO: 1173 - protein, 7 aa, Artificial Sequence
  Synthetic
STKFHEV

SEQ ID NO: 1174 - protein, 7 aa, Artificial Sequence
  Synthetic
PNFSPPK

SEQ ID NO: 1175 - protein, 7 aa, Artificial Sequence
  Synthetic
WTLTTPK

SEQ ID NO: 1176 - protein, 7 aa, Artificial Sequence
  Synthetic
SSDRPFI

SEQ ID NO: 1177 - protein, 7 aa, Artificial Sequence
  Synthetic
SITFKDV

SEQ ID NO: 1178 - protein, 7 aa, Artificial Sequence
  Synthetic
SNNRPFI

SEQ ID NO: 1179 - protein, 7 aa, Artificial Sequence
  Synthetic
SAWGDHM

SEQ ID NO: 1180 - protein, 7 aa, Artificial Sequence
  Synthetic
MMKSMYP

SEQ ID NO: 1181 - protein, 7 aa, Artificial Sequence
  Synthetic
TYTFKDV

SEQ ID NO: 1182 - protein, 7 aa, Artificial Sequence
  Synthetic
SQDRPFI

SEQ ID NO: 1183 - protein, 7 aa, Artificial Sequence
  Synthetic
GSWIPPE

SEQ ID NO: 1184 - protein, 7 aa, Artificial Sequence
  Synthetic
STQSMFK

SEQ ID NO: 1185 - protein, 7 aa, Artificial Sequence
  Synthetic
TITFKNV

SEQ ID NO: 1186 - protein, 7 aa, Artificial Sequence
  Synthetic
STKFHEV

SEQ ID NO: 1187 - protein, 7 aa, Artificial Sequence
  Synthetic
FVEKFNR

SEQ ID NO: 1188 - protein, 7 aa, Artificial Sequence
  Synthetic
STQSMFK

SEQ ID NO: 1189 - protein, 7 aa, Artificial Sequence
  Synthetic
DNKNLFR

SEQ ID NO: 1190 - protein, 7 aa, Artificial Sequence
  Synthetic
AITFKDV

SEQ ID NO: 1191 - protein, 7 aa, Artificial Sequence
  Synthetic
FTLLTPK

SEQ ID NO: 1192 - protein, 7 aa, Artificial Sequence
  Synthetic
SAWGNHK

SEQ ID NO: 1193 - protein, 7 aa, Artificial Sequence
  Synthetic
SPWGDHK

SEQ ID NO: 1194 - protein, 7 aa, Artificial Sequence
  Synthetic
SVQKPFL

SEQ ID NO: 1195 - protein, 7 aa, Artificial Sequence
  Synthetic
FTLHTPK

SEQ ID NO: 1196 - protein, 7 aa, Artificial Sequence
  Synthetic
KTTFEHI

SEQ ID NO: 1197 - protein, 7 aa, Artificial Sequence
  Synthetic
TITFKMV

SEQ ID NO: 1198 - protein, 7 aa, Artificial Sequence
  Synthetic
IQGRFNV

SEQ ID NO: 1199 - protein, 7 aa, Artificial Sequence
  Synthetic
FTLTLPK

SEQ ID NO: 1200 - protein, 7 aa, Artificial Sequence
  Synthetic
QTKFNSV

SEQ ID NO: 1201 - protein, 7 aa, Artificial Sequence
  Synthetic
TKTFSQV

SEQ ID NO: 1202 - protein, 7 aa, Artificial Sequence
  Synthetic
MVEFHKV

SEQ ID NO: 1203 - protein, 7 aa, Artificial Sequence
  Synthetic
WSLNSAK

SEQ ID NO: 1204 - protein, 7 aa, Artificial Sequence
  Synthetic
SYDRPFI

SEQ ID NO: 1205 - protein, 7 aa, Artificial Sequence
  Synthetic
DVVWKRE

SEQ ID NO: 1206 - protein, 7 aa, Artificial Sequence
  Synthetic
SQSKPFL

SEQ ID NO: 1207 - protein, 7 aa, Artificial Sequence
  Synthetic
SNERPFI

SEQ ID NO: 1208 - protein, 7 aa, Artificial Sequence
  Synthetic
TNDRPFI

SEQ ID NO: 1209 - protein, 7 aa, Artificial Sequence
  Synthetic
TAINPWV

SEQ ID NO: 1210 - protein, 7 aa, Artificial Sequence
  Synthetic
TIQFKDV

SEQ ID NO: 1211 - protein, 7 aa, Artificial Sequence
  Synthetic
SLEFSRV

SEQ ID NO: 1212 - protein, 7 aa, Artificial Sequence
  Synthetic
FTLETPK

SEQ ID NO: 1213 - protein, 7 aa, Artificial Sequence
  Synthetic
FTLQTPK

SEQ ID NO: 1214 - protein, 7 aa, Artificial Sequence
  Synthetic
YENRPFV

SEQ ID NO: 1215 - protein, 7 aa, Artificial Sequence
  Synthetic
NAWGDHK

SEQ ID NO: 1216 - protein, 7 aa, Artificial Sequence
  Synthetic
KTDFTHI

SEQ ID NO: 1217 - protein, 7 aa, Artificial Sequence
  Synthetic
QKQFMNQ

SEQ ID NO: 1218 - protein, 7 aa, Artificial Sequence
  Synthetic
DKKGWVA

SEQ ID NO: 1219 - protein, 7 aa, Artificial Sequence
  Synthetic
GSERPFL

SEQ ID NO: 1220 - protein, 7 aa, Artificial Sequence
  Synthetic
DAFRVSG

SEQ ID NO: 1221 - protein, 7 aa, Artificial Sequence
  Synthetic
SHDRPFI

SEQ ID NO: 1222 - protein, 7 aa, Artificial Sequence
  Synthetic
SVDKPFL

SEQ ID NO: 1223 - protein, 7 aa, Artificial Sequence
  Synthetic
ALHVPFK

SEQ ID NO: 1224 - protein, 7 aa, Artificial Sequence
  Synthetic
THSFEKI

SEQ ID NO: 1225 - protein, 7 aa, Artificial Sequence
  Synthetic
KDKFKDI

SEQ ID NO: 1226 - protein, 7 aa, Artificial Sequence
  Synthetic
SYEFSKV

SEQ ID NO: 1227 - protein, 7 aa, Artificial Sequence
  Synthetic
PFAHGSG

SEQ ID NO: 1228 - protein, 7 aa, Artificial Sequence
  Synthetic
GAFSPPA

SEQ ID NO: 1229 - protein, 7 aa, Artificial Sequence
  Synthetic
PPSFKNV

SEQ ID NO: 1230 - protein, 7 aa, Artificial Sequence
  Synthetic
TIGSLFK

SEQ ID NO: 1231 - protein, 7 aa, Artificial Sequence
  Synthetic
TVWNDRG

SEQ ID NO: 1232 - protein, 7 aa, Artificial Sequence
  Synthetic
ASKFSSI

SEQ ID NO: 1233 - protein, 7 aa, Artificial Sequence
  Synthetic
SAWGAHK

SEQ ID NO: 1234 - protein, 7 aa, Artificial Sequence
  Synthetic
SQKTPFL

SEQ ID NO: 1235 - protein, 7 aa, Artificial Sequence
  Synthetic
SVSKLFL

SEQ ID NO: 1236 - protein, 7 aa, Artificial Sequence
  Synthetic
SYEFSKV

SEQ ID NO: 1237 - protein, 7 aa, Artificial Sequence
  Synthetic
AGKFRDI

SEQ ID NO: 1238 - protein, 7 aa, Artificial Sequence
  Synthetic
AADRPFL

SEQ ID NO: 1239 - protein, 7 aa, Artificial Sequence
  Synthetic
DSQRPFI

SEQ ID NO: 1240 - protein, 7 aa, Artificial Sequence
  Synthetic
SNHRPFI

SEQ ID NO: 1241 - protein, 7 aa, Artificial Sequence
  Synthetic
TKALPFH

SEQ ID NO: 1242 - protein, 7 aa, Artificial Sequence
  Synthetic
SHTKPFA

SEQ ID NO: 1243 - protein, 7 aa, Artificial Sequence
  Synthetic
KAAFDHI

SEQ ID NO: 1244 - protein, 7 aa, Artificial Sequence
  Synthetic
SKTGWMA

SEQ ID NO: 1245 - protein, 7 aa, Artificial Sequence
  Synthetic
QITFKDV

SEQ ID NO: 1246 - protein, 7 aa, Artificial Sequence
  Synthetic
PNFSPPK

SEQ ID NO: 1247 - protein, 7 aa, Artificial Sequence
  Synthetic
SVSKPFA

SEQ ID NO: 1248 - protein, 7 aa, Artificial Sequence
  Synthetic
AVSKPFL

SEQ ID NO: 1249 - protein, 7 aa, Artificial Sequence
  Synthetic
SVDRPFI

SEQ ID NO: 1250 - protein, 7 aa, Artificial Sequence
  Synthetic
KTEFASI

SEQ ID NO: 1251 - protein, 7 aa, Artificial Sequence
  Synthetic
SAWGDKK

SEQ ID NO: 1252 - protein, 7 aa, Artificial Sequence
  Synthetic
SIDRPFI

SEQ ID NO: 1253 - protein, 7 aa, Artificial Sequence
  Synthetic
DIERLFK

SEQ ID NO: 1254 - protein, 7 aa, Artificial Sequence
  Synthetic
SVSHPFL

SEQ ID NO: 1255 - protein, 7 aa, Artificial Sequence
  Synthetic
SNDRPFK

SEQ ID NO: 1256 - protein, 7 aa, Artificial Sequence
  Synthetic
SAWGEHK

SEQ ID NO: 1257 - protein, 7 aa, Artificial Sequence
  Synthetic
SNDRPFL

SEQ ID NO: 1258 - protein, 7 aa, Artificial Sequence
  Synthetic
SNDRPFL

SEQ ID NO: 1259 - protein, 7 aa, Artificial Sequence
  Synthetic
QSVFASV

SEQ ID NO: 1260 - protein, 7 aa, Artificial Sequence
  Synthetic
FTLNTPK

SEQ ID NO: 1261 - protein, 7 aa, Artificial Sequence
  Synthetic
TKALPFH

SEQ ID NO: 1262 - protein, 7 aa, Artificial Sequence
  Synthetic
FTLTTTK

SEQ ID NO: 1263 - protein, 7 aa, Artificial Sequence
  Synthetic
STDRPFI

SEQ ID NO: 1264 - protein, 7 aa, Artificial Sequence
  Synthetic
KTQFKDV

SEQ ID NO: 1265 - protein, 7 aa, Artificial Sequence
  Synthetic
SPVNIFV

SEQ ID NO: 1266 - protein, 7 aa, Artificial Sequence
  Synthetic
SAWGDHL

SEQ ID NO: 1267 - protein, 7 aa, Artificial Sequence
  Synthetic
LVPPANI

SEQ ID NO: 1268 - protein, 7 aa, Artificial Sequence
  Synthetic
NPSSTSW

SEQ ID NO: 1269 - protein, 7 aa, Artificial Sequence
  Synthetic
GSERPFL

SEQ ID NO: 1270 - protein, 7 aa, Artificial Sequence
  Synthetic
NTLMASK

SEQ ID NO: 1271 - protein, 7 aa, Artificial Sequence
  Synthetic
FTLTVPK

SEQ ID NO: 1272 - protein, 7 aa, Artificial Sequence
  Synthetic
EHFGKTY

SEQ ID NO: 1273 - protein, 7 aa, Artificial Sequence
  Synthetic
TLPFPNR

SEQ ID NO: 1274 - protein, 7 aa, Artificial Sequence
  Synthetic
SSDRPFI

SEQ ID NO: 1275 - protein, 7 aa, Artificial Sequence
  Synthetic
LSTHPFR

SEQ ID NO: 1276 - protein, 7 aa, Artificial Sequence
  Synthetic
DAIFRQA

SEQ ID NO: 1277 - protein, 7 aa, Artificial Sequence
  Synthetic
SNRFEHV

SEQ ID NO: 1278 - protein, 7 aa, Artificial Sequence
  Synthetic
SYSKPFL

SEQ ID NO: 1279 - protein, 7 aa, Artificial Sequence
  Synthetic
NTLKTAI

SEQ ID NO: 1280 - protein, 7 aa, Artificial Sequence
  Synthetic
SAWGDIK

SEQ ID NO: 1281 - protein, 7 aa, Artificial Sequence
  Synthetic
TKTFSQV

SEQ ID NO: 1282 - protein, 7 aa, Artificial Sequence
  Synthetic
TDLGYAR

SEQ ID NO: 1283 - protein, 7 aa, Artificial Sequence
  Synthetic
NVWSERG

SEQ ID NO: 1284 - protein, 7 aa, Artificial Sequence
  Synthetic
QLANPFQ

SEQ ID NO: 1285 - protein, 7 aa, Artificial Sequence
  Synthetic
TRDLPFK

SEQ ID NO: 1286 - protein, 7 aa, Artificial Sequence
  Synthetic
TVFGTRT

SEQ ID NO: 1287 - protein, 7 aa, Artificial Sequence
  Synthetic
SAWGDVK

SEQ ID NO: 1288 - protein, 7 aa, Artificial Sequence
  Synthetic
SVQKPFL

SEQ ID NO: 1289 - protein, 7 aa, Artificial Sequence
  Synthetic
AGVRLGY

SEQ ID NO: 1290 - protein, 7 aa, Artificial Sequence
  Synthetic
DAFRVSG

SEQ ID NO: 1291 - protein, 7 aa, Artificial Sequence
  Synthetic
VYHNSAT

SEQ ID NO: 1292 - protein, 7 aa, Artificial Sequence
  Synthetic
PEWHAKT

SEQ ID NO: 1293 - protein, 7 aa, Artificial Sequence
  Synthetic
NVSKPFL

SEQ ID NO: 1294 - protein, 7 aa, Artificial Sequence
  Synthetic
SYDRPFI

SEQ ID NO: 1295 - protein, 7 aa, Artificial Sequence
  Synthetic
PDIARVF

SEQ ID NO: 1296 - protein, 7 aa, Artificial Sequence
  Synthetic
SITFKDV

SEQ ID NO: 1297 - protein, 7 aa, Artificial Sequence
  Synthetic
PPIARVY

SEQ ID NO: 1298 - protein, 7 aa, Artificial Sequence
  Synthetic
TIDTPFR

SEQ ID NO: 1299 - protein, 7 aa, Artificial Sequence
  Synthetic
FTLMTPK

SEQ ID NO: 1300 - protein, 7 aa, Artificial Sequence
  Synthetic
SSKFINI

SEQ ID NO: 1301 - protein, 7 aa, Artificial Sequence
  Synthetic
AADRPFL

SEQ ID NO: 1302 - protein, 7 aa, Artificial Sequence
  Synthetic
FTLTEPK

SEQ ID NO: 1303 - protein, 7 aa, Artificial Sequence
  Synthetic
AGGWGAP

SEQ ID NO: 1304 - protein, 7 aa, Artificial Sequence
  Synthetic
TTMKPFN

SEQ ID NO: 1305 - protein, 7 aa, Artificial Sequence
  Synthetic
DVVWKRE

SEQ ID NO: 1306 - protein, 7 aa, Artificial Sequence
  Synthetic
TIDTPFR

SEQ ID NO: 1307 - protein, 7 aa, Artificial Sequence
  Synthetic
FTLDTPK

SEQ ID NO: 1308 - protein, 7 aa, Artificial Sequence
  Synthetic
SAWGDQK

SEQ ID NO: 1309 - protein, 7 aa, Artificial Sequence
  Synthetic
QTRLASV

SEQ ID NO: 1310 - protein, 7 aa, Artificial Sequence
  Synthetic
FTLNTPK

SEQ ID NO: 1311 - protein, 7 aa, Artificial Sequence
  Synthetic
FTQTTPK

SEQ ID NO: 1312 - protein, 7 aa, Artificial Sequence
  Synthetic
DSQRPFI

SEQ ID NO: 1313 - protein, 7 aa, Artificial Sequence
  Synthetic
SSQFHVV

SEQ ID NO: 1314 - protein, 7 aa, Artificial Sequence
  Synthetic
SLDRPFI

SEQ ID NO: 1315 - protein, 7 aa, Artificial Sequence
  Synthetic
QTKFSGI

SEQ ID NO: 1316 - protein, 7 aa, Artificial Sequence
  Synthetic
SAWGDVK

SEQ ID NO: 1317 - protein, 7 aa, Artificial Sequence
  Synthetic
LSTHPFR

SEQ ID NO: 1318 - protein, 7 aa, Artificial Sequence
  Synthetic
MITFKDV

SEQ ID NO: 1319 - protein, 7 aa, Artificial Sequence
  Synthetic
SVSKPFH

SEQ ID NO: 1320 - protein, 7 aa, Artificial Sequence
  Synthetic
TKEHLFR

SEQ ID NO: 1321 - protein, 7 aa, Artificial Sequence
  Synthetic
TRLGWVA

SEQ ID NO: 1322 - protein, 7 aa, Artificial Sequence
  Synthetic
GAFSPPA

SEQ ID NO: 1323 - protein, 7 aa, Artificial Sequence
  Synthetic
NTLKTAI

SEQ ID NO: 1324 - protein, 7 aa, Artificial Sequence
  Synthetic
TLTSPFR

SEQ ID NO: 1325 - protein, 7 aa, Artificial Sequence
  Synthetic
TDTSYFK

SEQ ID NO: 1326 - protein, 7 aa, Artificial Sequence
  Synthetic
TKEHLFR

SEQ ID NO: 1327 - protein, 7 aa, Artificial Sequence
  Synthetic
TYTFKDV

SEQ ID NO: 1328 - protein, 7 aa, Artificial Sequence
  Synthetic
YRDNIFK

SEQ ID NO: 1329 - protein, 7 aa, Artificial Sequence
  Synthetic
PDIARQY

SEQ ID NO: 1330 - protein, 7 aa, Artificial Sequence
  Synthetic
SHTKPFA

SEQ ID NO: 1331 - protein, 7 aa, Artificial Sequence
  Synthetic
APMTQSW

SEQ ID NO: 1332 - protein, 7 aa, Artificial Sequence
  Synthetic
PFAHGSG

SEQ ID NO: 1333 - protein, 7 aa, Artificial Sequence
  Synthetic
KTSFHAI

SEQ ID NO: 1334 - protein, 7 aa, Artificial Sequence
  Synthetic
SERYPIP

SEQ ID NO: 1335 - protein, 7 aa, Artificial Sequence
  Synthetic
TISFKDV

SEQ ID NO: 1336 - protein, 7 aa, Artificial Sequence
  Synthetic
NDTQFFR

SEQ ID NO: 1337 - protein, 7 aa, Artificial Sequence
  Synthetic
SVSKLFL

SEQ ID NO: 1338 - protein, 7 aa, Artificial Sequence
  Synthetic
APMTQSW

SEQ ID NO: 1339 - protein, 7 aa, Artificial Sequence
  Synthetic
FTVTTPK

SEQ ID NO: 1340 - protein, 7 aa, Artificial Sequence
  Synthetic
FTHTTPK

SEQ ID NO: 1341 - protein, 7 aa, Artificial Sequence
  Synthetic
QSNFGKF

SEQ ID NO: 1342 - protein, 7 aa, Artificial Sequence
  Synthetic
TIVFKDV

SEQ ID NO: 1343 - protein, 7 aa, Artificial Sequence
  Synthetic
FTLTYPK

SEQ ID NO: 1344 - protein, 7 aa, Artificial Sequence
  Synthetic
THSFEKI

SEQ ID NO: 1345 - protein, 7 aa, Artificial Sequence
  Synthetic
NVEKPWI

SEQ ID NO: 1346 - protein, 7 aa, Artificial Sequence
  Synthetic
SANKPFT

SEQ ID NO: 1347 - protein, 7 aa, Artificial Sequence
  Synthetic
GKWAPPA

SEQ ID NO: 1348 - protein, 7 aa, Artificial Sequence
  Synthetic
AVSKPFL

SEQ ID NO: 1349 - protein, 7 aa, Artificial Sequence
  Synthetic
QSSFRAV

SEQ ID NO: 1350 - protein, 7 aa, Artificial Sequence
  Synthetic
YENRPFV

SEQ ID NO: 1351 - protein, 7 aa, Artificial Sequence
  Synthetic
EGRAFGT

SEQ ID NO: 1352 - protein, 7 aa, Artificial Sequence
  Synthetic
SNDRPWI

SEQ ID NO: 1353 - protein, 7 aa, Artificial Sequence
  Synthetic
SAWGVHK

SEQ ID NO: 1354 - protein, 7 aa, Artificial Sequence
  Synthetic
SNRFEHV

SEQ ID NO: 1355 - protein, 7 aa, Artificial Sequence
  Synthetic
YSDRPFP

SEQ ID NO: 1356 - protein, 7 aa, Artificial Sequence
  Synthetic
TPDFKPR

SEQ ID NO: 1357 - protein, 7 aa, Artificial Sequence
  Synthetic
QNPGWLP

SEQ ID NO: 1358 - protein, 7 aa, Artificial Sequence
  Synthetic
NTLMASK

SEQ ID NO: 1359 - protein, 7 aa, Artificial Sequence
  Synthetic
NNMHTSR

SEQ ID NO: 1360 - protein, 7 aa, Artificial Sequence
  Synthetic
TVMAPFK

SEQ ID NO: 1361 - protein, 7 aa, Artificial Sequence
  Synthetic
SVSKPFP

SEQ ID NO: 1362 - protein, 7 aa, Artificial Sequence
  Synthetic
SPDRPFI

SEQ ID NO: 1363 - protein, 7 aa, Artificial Sequence
  Synthetic
SAWGDHK

SEQ ID NO: 1364 - protein, 7 aa, Artificial Sequence
  Synthetic
SAWGDHR

SEQ ID NO: 1365 - protein, 7 aa, Artificial Sequence
  Synthetic
GILSPPR

SEQ ID NO: 1366 - protein, 7 aa, Artificial Sequence
  Synthetic
FTLTAPK

SEQ ID NO: 1367 - protein, 7 aa, Artificial Sequence
  Synthetic
SRTGWMA

SEQ ID NO: 1368 - protein, 7 aa, Artificial Sequence
  Synthetic
KITFKDV

SEQ ID NO: 1369 - protein, 7 aa, Artificial Sequence
  Synthetic
FTLTTPM

SEQ ID NO: 1370 - protein, 7 aa, Artificial Sequence
  Synthetic
VTQFHNI

SEQ ID NO: 1371 - protein, 7 aa, Artificial Sequence
  Synthetic
GMFNPPS

SEQ ID NO: 1372 - protein, 7 aa, Artificial Sequence
  Synthetic
GESRPFI

SEQ ID NO: 1373 - protein, 7 aa, Artificial Sequence
  Synthetic
SVEKPFL

SEQ ID NO: 1374 - protein, 7 aa, Artificial Sequence
  Synthetic
NSLHASK

SEQ ID NO: 1375 - protein, 7 aa, Artificial Sequence
  Synthetic
NAWGDHK

SEQ ID NO: 1376 - protein, 7 aa, Artificial Sequence
  Synthetic
MSDNFYP

SEQ ID NO: 1377 - protein, 7 aa, Artificial Sequence
  Synthetic
SVSKPFS

SEQ ID NO: 1378 - protein, 7 aa, Artificial Sequence
  Synthetic
SSQFHVV

SEQ ID NO: 1379 - protein, 7 aa, Artificial Sequence
  Synthetic
NLDKMFR

SEQ ID NO: 1380 - protein, 7 aa, Artificial Sequence
  Synthetic
TIHFKDV

SEQ ID NO: 1381 - protein, 7 aa, Artificial Sequence
  Synthetic
KTTFEHI

SEQ ID NO: 1382 - protein, 7 aa, Artificial Sequence
  Synthetic
FTSTTPK

SEQ ID NO: 1383 - protein, 7 aa, Artificial Sequence
  Synthetic
SAWGDHM

SEQ ID NO: 1384 - protein, 7 aa, Artificial Sequence
  Synthetic
SRTGWMA

SEQ ID NO: 1385 - protein, 7 aa, Artificial Sequence
  Synthetic
TMDKPFH

SEQ ID NO: 1386 - protein, 7 aa, Artificial Sequence
  Synthetic
LNTPFLP

SEQ ID NO: 1387 - protein, 7 aa, Artificial Sequence
  Synthetic
TINFKDV

SEQ ID NO: 1388 - protein, 7 aa, Artificial Sequence
  Synthetic
SNKFENV

SEQ ID NO: 1389 - protein, 7 aa, Artificial Sequence
  Synthetic
PDIARVY

SEQ ID NO: 1390 - protein, 7 aa, Artificial Sequence
  Synthetic
TINFKDV

SEQ ID NO: 1391 - protein, 7 aa, Artificial Sequence
  Synthetic
TLAYPFK

SEQ ID NO: 1392 - protein, 7 aa, Artificial Sequence
  Synthetic
SVSQPFL

SEQ ID NO: 1393 - protein, 7 aa, Artificial Sequence
  Synthetic
FTATTPK

SEQ ID NO: 1394 - protein, 7 aa, Artificial Sequence
  Synthetic
YETQYFK

SEQ ID NO: 1395 - protein, 7 aa, Artificial Sequence
  Synthetic
NPWGEKN

SEQ ID NO: 1396 - protein, 7 aa, Artificial Sequence
  Synthetic
PDIARHY

SEQ ID NO: 1397 - protein, 7 aa, Artificial Sequence
  Synthetic
FTLKTPK

SEQ ID NO: 1398 - protein, 7 aa, Artificial Sequence
  Synthetic
FTLTTGK

SEQ ID NO: 1399 - protein, 7 aa, Artificial Sequence
  Synthetic
TLWAKDG

SEQ ID NO: 1400 - protein, 7 aa, Artificial Sequence
  Synthetic
DPTWKRE

SEQ ID NO: 1401 - protein, 7 aa, Artificial Sequence
  Synthetic
TAINPWV

SEQ ID NO: 1402 - protein, 7 aa, Artificial Sequence
  Synthetic
DPHTISW

SEQ ID NO: 1403 - protein, 7 aa, Artificial Sequence
  Synthetic
FTLVTPK

SEQ ID NO: 1404 - protein, 7 aa, Artificial Sequence
  Synthetic
NVEKPWI

SEQ ID NO: 1405 - protein, 7 aa, Artificial Sequence
  Synthetic
SAWGDMK

SEQ ID NO: 1406 - protein, 7 aa, Artificial Sequence
  Synthetic
GGLPMIP

SEQ ID NO: 1407 - protein, 7 aa, Artificial Sequence
  Synthetic
SNNFSNV

SEQ ID NO: 1408 - protein, 7 aa, Artificial Sequence
  Synthetic
SVSVPFL

SEQ ID NO: 1409 - protein, 7 aa, Artificial Sequence
  Synthetic
GILSPPR

SEQ ID NO: 1410 - protein, 7 aa, Artificial Sequence
  Synthetic
NPSSTSW

SEQ ID NO: 1411 - protein, 7 aa, Artificial Sequence
  Synthetic
SVSKPFA

SEQ ID NO: 1412 - protein, 7 aa, Artificial Sequence
  Synthetic
KTEFASI

SEQ ID NO: 1413 - protein, 7 aa, Artificial Sequence
  Synthetic
SVSHPFL

SEQ ID NO: 1414 - protein, 7 aa, Artificial Sequence
  Synthetic
ESSIWVA

SEQ ID NO: 1415 - protein, 7 aa, Artificial Sequence
  Synthetic
SASSIFK

SEQ ID NO: 1416 - protein, 7 aa, Artificial Sequence
  Synthetic
PVIARVY

SEQ ID NO: 1417 - protein, 7 aa, Artificial Sequence
  Synthetic
SNFLIAP

SEQ ID NO: 1418 - protein, 7 aa, Artificial Sequence
  Synthetic
FTLTLPK

SEQ ID NO: 1419 - protein, 7 aa, Artificial Sequence
  Synthetic
SVFKPFL

SEQ ID NO: 1420 - protein, 7 aa, Artificial Sequence
  Synthetic
TRAMPFN

SEQ ID NO: 1421 - protein, 7 aa, Artificial Sequence
  Synthetic
SVWGDHK

SEQ ID NO: 1422 - protein, 7 aa, Artificial Sequence
  Synthetic
ISGWFSE

SEQ ID NO: 1423 - protein, 7 aa, Artificial Sequence
  Synthetic
TITFKDI

SEQ ID NO: 1424 - protein, 7 aa, Artificial Sequence
  Synthetic
NVERLYS

SEQ ID NO: 1425 - protein, 7 aa, Artificial Sequence
  Synthetic
SIWGDHK

SEQ ID NO: 1426 - protein, 7 aa, Artificial Sequence
  Synthetic
TPWHPHG

SEQ ID NO: 1427 - protein, 7 aa, Artificial Sequence
  Synthetic
FTLTMPK

SEQ ID NO: 1428 - protein, 7 aa, Artificial Sequence
  Synthetic
SAWGDTK

SEQ ID NO: 1429 - protein, 7 aa, Artificial Sequence
  Synthetic
QSHFASV

SEQ ID NO: 1430 - protein, 7 aa, Artificial Sequence
  Synthetic
LLNNPFA

SEQ ID NO: 1431 - protein, 7 aa, Artificial Sequence
  Synthetic
YVDRLFK

SEQ ID NO: 1432 - protein, 7 aa, Artificial Sequence
  Synthetic
TAWREDG

SEQ ID NO: 1433 - protein, 7 aa, Artificial Sequence
  Synthetic
NLFSSQL

SEQ ID NO: 1434 - protein, 7 aa, Artificial Sequence
  Synthetic
SAWGDSK

SEQ ID NO: 1435 - protein, 7 aa, Artificial Sequence
  Synthetic
PDIVRVY

SEQ ID NO: 1436 - protein, 7 aa, Artificial Sequence
  Synthetic
YSTAMFK

SEQ ID NO: 1437 - protein, 7 aa, Artificial Sequence
  Synthetic
TIGHIFS

SEQ ID NO: 1438 - protein, 7 aa, Artificial Sequence
  Synthetic
QSSFRAV

SEQ ID NO: 1439 - protein, 7 aa, Artificial Sequence
  Synthetic
LTLTSSK

SEQ ID NO: 1440 - protein, 7 aa, Artificial Sequence
  Synthetic
FTMTTPK

SEQ ID NO: 1441 - protein, 7 aa, Artificial Sequence
  Synthetic
AITFKDV

SEQ ID NO: 1442 - protein, 7 aa, Artificial Sequence
  Synthetic
TILFKDV

SEQ ID NO: 1443 - protein, 7 aa, Artificial Sequence
  Synthetic
TIAFKDV

SEQ ID NO: 1444 - protein, 7 aa, Artificial Sequence
  Synthetic
SVSLPFL

SEQ ID NO: 1445 - protein, 7 aa, Artificial Sequence
  Synthetic
PEWHAKT

SEQ ID NO: 1446 - protein, 7 aa, Artificial Sequence
  Synthetic
GGATPFR

SEQ ID NO: 1447 - protein, 7 aa, Artificial Sequence
  Synthetic
QTKFSGI

SEQ ID NO: 1448 - protein, 7 aa, Artificial Sequence
  Synthetic
PIIASTY

SEQ ID NO: 1449 - protein, 7 aa, Artificial Sequence
  Synthetic
KTDFTHI

SEQ ID NO: 1450 - protein, 7 aa, Artificial Sequence
  Synthetic
SSEKPFQ

SEQ ID NO: 1451 - protein, 7 aa, Artificial Sequence
  Synthetic
GMRSFTV

SEQ ID NO: 1452 - protein, 7 aa, Artificial Sequence
  Synthetic
ASKFSSI

SEQ ID NO: 1453 - protein, 7 aa, Artificial Sequence
  Synthetic
NVQMPFI

SEQ ID NO: 1454 - protein, 7 aa, Artificial Sequence
  Synthetic
SMWGDHK

SEQ ID NO: 1455 - protein, 7 aa, Artificial Sequence
  Synthetic
TIHFKDV

SEQ ID NO: 1456 - protein, 7 aa, Artificial Sequence
  Synthetic
NTWFPNG

SEQ ID NO: 1457 - protein, 7 aa, Artificial Sequence
  Synthetic
FTTTTPK

SEQ ID NO: 1458 - protein, 7 aa, Artificial Sequence
  Synthetic
GSFSRPQ

SEQ ID NO: 1459 - protein, 7 aa, Artificial Sequence
  Synthetic
YGELPFQ

SEQ ID NO: 1460 - protein, 7 aa, Artificial Sequence
  Synthetic
VDPRRGV

SEQ ID NO: 1461 - protein, 7 aa, Artificial Sequence
  Synthetic
TITFKDI

SEQ ID NO: 1462 - protein, 7 aa, Artificial Sequence
  Synthetic
TLENVFK

SEQ ID NO: 1463 - protein, 7 aa, Artificial Sequence
  Synthetic
MITFKDV

SEQ ID NO: 1464 - protein, 7 aa, Artificial Sequence
  Synthetic
PDIARIY

SEQ ID NO: 1465 - protein, 7 aa, Artificial Sequence
  Synthetic
DKIGFTP

SEQ ID NO: 1466 - protein, 7 aa, Artificial Sequence
  Synthetic
YTLTTPK

SEQ ID NO: 1467 - protein, 7 aa, Artificial Sequence
  Synthetic
TIQFKDV

SEQ ID NO: 1468 - protein, 7 aa, Artificial Sequence
  Synthetic
VPWNKQT

SEQ ID NO: 1469 - protein, 7 aa, Artificial Sequence
  Synthetic
PDIARAY

SEQ ID NO: 1470 - protein, 7 aa, Artificial Sequence
  Synthetic
NVERLYS

SEQ ID NO: 1471 - protein, 7 aa, Artificial Sequence
  Synthetic
SESHYFK

SEQ ID NO: 1472 - protein, 7 aa, Artificial Sequence
  Synthetic
FTLTFPK

SEQ ID NO: 1473 - protein, 7 aa, Artificial Sequence
  Synthetic
TITFKHV

SEQ ID NO: 1474 - protein, 7 aa, Artificial Sequence
  Synthetic
RLGWIDP

SEQ ID NO: 1475 - protein, 7 aa, Artificial Sequence
  Synthetic
NPRWDNP

SEQ ID NO: 1476 - protein, 7 aa, Artificial Sequence
  Synthetic
SESKPFL

SEQ ID NO: 1477 - protein, 7 aa, Artificial Sequence
  Synthetic
SNNFSNV

SEQ ID NO: 1478 - protein, 7 aa, Artificial Sequence
  Synthetic
SESHYFK

SEQ ID NO: 1479 - protein, 7 aa, Artificial Sequence
  Synthetic
DPTWKRE

SEQ ID NO: 1480 - protein, 7 aa, Artificial Sequence
  Synthetic
SAWGDQK

SEQ ID NO: 1481 - protein, 7 aa, Artificial Sequence
  Synthetic
SERYPIP

SEQ ID NO: 1482 - protein, 7 aa, Artificial Sequence
  Synthetic
GAVGWAA

SEQ ID NO: 1483 - protein, 7 aa, Artificial Sequence
  Synthetic
THTFKDV

SEQ ID NO: 1484 - protein, 7 aa, Artificial Sequence
  Synthetic
SAWGDAK

SEQ ID NO: 1485 - protein, 7 aa, Artificial Sequence
  Synthetic
MKETFHP

SEQ ID NO: 1486 - protein, 7 aa, Artificial Sequence
  Synthetic
SAWGDFK

SEQ ID NO: 1487 - protein, 7 aa, Artificial Sequence
  Synthetic
STTFKDI

SEQ ID NO: 1488 - protein, 7 aa, Artificial Sequence
  Synthetic
NFTTVFH

SEQ ID NO: 1489 - protein, 7 aa, Artificial Sequence
  Synthetic
NTSSTSR

SEQ ID NO: 1490 - protein, 7 aa, Artificial Sequence
  Synthetic
SVSAPFL

SEQ ID NO: 1491 - protein, 7 aa, Artificial Sequence
  Synthetic
GQWAGGG

SEQ ID NO: 1492 - protein, 7 aa, Artificial Sequence
  Synthetic
NPFGHAM

SEQ ID NO: 1493 - protein, 7 aa, Artificial Sequence
  Synthetic
NPWGEKN

SEQ ID NO: 1494 - protein, 7 aa, Artificial Sequence
  Synthetic
PPLFREL

SEQ ID NO: 1495 - protein, 7 aa, Artificial Sequence
  Synthetic
PNIARVY

SEQ ID NO: 1496 - protein, 7 aa, Artificial Sequence
  Synthetic
SFDRPFI

SEQ ID NO: 1497 - protein, 7 aa, Artificial Sequence
  Synthetic
QTNFNVM

SEQ ID NO: 1498 - protein, 7 aa, Artificial Sequence
  Synthetic
ISGWFSE

SEQ ID NO: 1499 - protein, 7 aa, Artificial Sequence
  Synthetic
SNDRPFI

SEQ ID NO: 1500 - protein, 7 aa, Artificial Sequence
  Synthetic
SAWASMG

SEQ ID NO: 1501 - protein, 7 aa, Artificial Sequence
  Synthetic
LVPPNNE

SEQ ID NO: 1502 - protein, 7 aa, Artificial Sequence
  Synthetic
TPDFKPR

SEQ ID NO: 1503 - protein, 7 aa, Artificial Sequence
  Synthetic
PPIARVY

SEQ ID NO: 1504 - protein, 7 aa, Artificial Sequence
  Synthetic
RPMNASH

SEQ ID NO: 1505 - protein, 7 aa, Artificial Sequence
  Synthetic
SVRFIDV

SEQ ID NO: 1506 - protein, 7 aa, Artificial Sequence
  Synthetic
FTLTTPL

SEQ ID NO: 1507 - protein, 7 aa, Artificial Sequence
  Synthetic
NLFSSQL

SEQ ID NO: 1508 - protein, 7 aa, Artificial Sequence
  Synthetic
FTLTFPK

SEQ ID NO: 1509 - protein, 7 aa, Artificial Sequence
  Synthetic
PQEFKHV

SEQ ID NO: 1510 - protein, 7 aa, Artificial Sequence
  Synthetic
NLFTEKL

SEQ ID NO: 1511 - protein, 7 aa, Artificial Sequence
  Synthetic
SAINLRY

SEQ ID NO: 1512 - protein, 7 aa, Artificial Sequence
  Synthetic
SVSQPFL

SEQ ID NO: 1513 - protein, 7 aa, Artificial Sequence
  Synthetic
RPVNEWV

SEQ ID NO: 1514 - protein, 7 aa, Artificial Sequence
  Synthetic
QLDRPFS

SEQ ID NO: 1515 - protein, 7 aa, Artificial Sequence
  Synthetic
ITMETSR

SEQ ID NO: 1516 - protein, 7 aa, Artificial Sequence
  Synthetic
LLNNPFA

SEQ ID NO: 1517 - protein, 7 aa, Artificial Sequence
  Synthetic
YSTAMFK

SEQ ID NO: 1518 - protein, 7 aa, Artificial Sequence
  Synthetic
NAWSLAG

SEQ ID NO: 1519 - protein, 7 aa, Artificial Sequence
  Synthetic
AHEFHLI

SEQ ID NO: 1520 - protein, 7 aa, Artificial Sequence
  Synthetic
IGVRLGT

SEQ ID NO: 1521 - protein, 7 aa, Artificial Sequence
  Synthetic
TIMFKDV

SEQ ID NO: 1522 - protein, 7 aa, Artificial Sequence
  Synthetic
SNDRPFI

SEQ ID NO: 1523 - protein, 7 aa, Artificial Sequence
  Synthetic
NLFTEKL

SEQ ID NO: 1524 - protein, 7 aa, Artificial Sequence
  Synthetic
MMKSMYP

SEQ ID NO: 1525 - protein, 7 aa, Artificial Sequence
  Synthetic
TIIFKDV

SEQ ID NO: 1526 - protein, 7 aa, Artificial Sequence
  Synthetic
SDWTGKM

SEQ ID NO: 1527 - protein, 7 aa, Artificial Sequence
  Synthetic
TIYFKDV

SEQ ID NO: 1528 - protein, 7 aa, Artificial Sequence
  Synthetic
NDTQFFR

SEQ ID NO: 1529 - protein, 7 aa, Artificial Sequence
  Synthetic
DVFRPTG

SEQ ID NO: 1530 - protein, 7 aa, Artificial Sequence
  Synthetic
SNDRPFM

SEQ ID NO: 1531 - protein, 7 aa, Artificial Sequence
  Synthetic
TIFFKDV

SEQ ID NO: 1532 - protein, 7 aa, Artificial Sequence
  Synthetic
FTATTPK

SEQ ID NO: 1533 - protein, 7 aa, Artificial Sequence
  Synthetic
WDLKGPK

SEQ ID NO: 1534 - protein, 7 aa, Artificial Sequence
  Synthetic
TGTSPFK

SEQ ID NO: 1535 - protein, 7 aa, Artificial Sequence
  Synthetic
TIGHIFS

SEQ ID NO: 1536 - protein, 7 aa, Artificial Sequence
  Synthetic
SAWGDHV

SEQ ID NO: 1537 - protein, 7 aa, Artificial Sequence
  Synthetic
TSNFAQI

SEQ ID NO: 1538 - protein, 7 aa, Artificial Sequence
  Synthetic
SSEKPFQ

SEQ ID NO: 1539 - protein, 7 aa, Artificial Sequence
  Synthetic
PDIARMY

SEQ ID NO: 1540 - protein, 7 aa, Artificial Sequence
  Synthetic
PDIARVW

SEQ ID NO: 1541 - protein, 7 aa, Artificial Sequence
  Synthetic
FTVKTSI

SEQ ID NO: 1542 - protein, 7 aa, Artificial Sequence
  Synthetic
VAVFKNV

SEQ ID NO: 1543 - protein, 7 aa, Artificial Sequence
  Synthetic
SLEFSRV

SEQ ID NO: 1544 - protein, 7 aa, Artificial Sequence
  Synthetic
AHEFHLI

SEQ ID NO: 1545 - protein, 7 aa, Artificial Sequence
  Synthetic
TDTSYFK

SEQ ID NO: 1546 - protein, 7 aa, Artificial Sequence
  Synthetic
SAWGAHK

SEQ ID NO: 1547 - protein, 7 aa, Artificial Sequence
  Synthetic
SATGWSA

SEQ ID NO: 1548 - protein, 7 aa, Artificial Sequence
  Synthetic
TFTFKDV

SEQ ID NO: 1549 - protein, 7 aa, Artificial Sequence
  Synthetic
GDWAGVR

SEQ ID NO: 1550 - protein, 7 aa, Artificial Sequence
  Synthetic
DPRGWTP

SEQ ID NO: 1551 - protein, 7 aa, Artificial Sequence
  Synthetic
FTLETPK

SEQ ID NO: 1552 - protein, 7 aa, Artificial Sequence
  Synthetic
TLAYPFK

SEQ ID NO: 1553 - protein, 7 aa, Artificial Sequence
  Synthetic
DLWRPND

SEQ ID NO: 1554 - protein, 7 aa, Artificial Sequence
  Synthetic
PPSFKNV

SEQ ID NO: 1555 - protein, 7 aa, Artificial Sequence
  Synthetic
ITMSTSI

SEQ ID NO: 1556 - protein, 7 aa, Artificial Sequence
  Synthetic
TIYFKDV

SEQ ID NO: 1557 - protein, 7 aa, Artificial Sequence
  Synthetic
PRIADSY

SEQ ID NO: 1558 - protein, 7 aa, Artificial Sequence
  Synthetic
SMVFASP

SEQ ID NO: 1559 - protein, 7 aa, Artificial Sequence
  Synthetic
FTLTTPF

SEQ ID NO: 1560 - protein, 7 aa, Artificial Sequence
  Synthetic
FTVKTSI

SEQ ID NO: 1561 - protein, 7 aa, Artificial Sequence
  Synthetic
TITFRDV

SEQ ID NO: 1562 - protein, 7 aa, Artificial Sequence
  Synthetic
SIWGDHK

SEQ ID NO: 1563 - protein, 7 aa, Artificial Sequence
  Synthetic
QRDVPFR

SEQ ID NO: 1564 - protein, 7 aa, Artificial Sequence
  Synthetic
MKETFHP

SEQ ID NO: 1565 - protein, 7 aa, Artificial Sequence
  Synthetic
KFTFGDV

SEQ ID NO: 1566 - protein, 7 aa, Artificial Sequence
  Synthetic
EHFGKTY

SEQ ID NO: 1567 - protein, 7 aa, Artificial Sequence
  Synthetic
SGDKYFK

SEQ ID NO: 1568 - protein, 7 aa, Artificial Sequence
  Synthetic
SVSKVFL

SEQ ID NO: 1569 - protein, 7 aa, Artificial Sequence
  Synthetic
SNDRPFY

SEQ ID NO: 1570 - protein, 7 aa, Artificial Sequence
  Synthetic
GVLVPPR

SEQ ID NO: 1571 - protein, 7 aa, Artificial Sequence
  Synthetic
GSTGWIA

SEQ ID NO: 1572 - protein, 7 aa, Artificial Sequence
  Synthetic
MSMKTSV

SEQ ID NO: 1573 - protein, 7 aa, Artificial Sequence
  Synthetic
QRDVPFR

SEQ ID NO: 1574 - protein, 7 aa, Artificial Sequence
  Synthetic
DGNWSAL

SEQ ID NO: 1575 - protein, 7 aa, Artificial Sequence
  Synthetic
GESRPFI

SEQ ID NO: 1576 - protein, 7 aa, Artificial Sequence
  Synthetic
YSDRPFP

SEQ ID NO: 1577 - protein, 7 aa, Artificial Sequence
  Synthetic
LGRALGN

SEQ ID NO: 1578 - protein, 7 aa, Artificial Sequence
  Synthetic
YGELPFQ

SEQ ID NO: 1579 - protein, 7 aa, Artificial Sequence
  Synthetic
QDLKYVR

SEQ ID NO: 1580 - protein, 7 aa, Artificial Sequence
  Synthetic
SISHPYI

SEQ ID NO: 1581 - protein, 7 aa, Artificial Sequence
  Synthetic
LDWPATK

SEQ ID NO: 1582 - protein, 7 aa, Artificial Sequence
  Synthetic
SKSGWMA

SEQ ID NO: 1583 - protein, 7 aa, Artificial Sequence
  Synthetic
TVNIPFQ

SEQ ID NO: 1584 - protein, 7 aa, Artificial Sequence
  Synthetic
TDLKQSR

SEQ ID NO: 1585 - protein, 7 aa, Artificial Sequence
  Synthetic
QTSFREI

SEQ ID NO: 1586 - protein, 7 aa, Artificial Sequence
  Synthetic
WERLGDV

SEQ ID NO: 1587 - protein, 7 aa, Artificial Sequence
  Synthetic
TISFKDV

SEQ ID NO: 1588 - protein, 7 aa, Artificial Sequence
  Synthetic
SAWGQHK

SEQ ID NO: 1589 - protein, 7 aa, Artificial Sequence
  Synthetic
TITFRDV

SEQ ID NO: 1590 - protein, 7 aa, Artificial Sequence
  Synthetic
TLSSPWT

SEQ ID NO: 1591 - protein, 7 aa, Artificial Sequence
  Synthetic
SQLGFHP

SEQ ID NO: 1592 - protein, 7 aa, Artificial Sequence
  Synthetic
TLWAKDG

SEQ ID NO: 1593 - protein, 7 aa, Artificial Sequence
  Synthetic
EHWTNSK

SEQ ID NO: 1594 - protein, 7 aa, Artificial Sequence
  Synthetic
PDIIRVY

SEQ ID NO: 1595 - protein, 7 aa, Artificial Sequence
  Synthetic
MSMKTSV

SEQ ID NO: 1596 - protein, 7 aa, Artificial Sequence
  Synthetic
FTHTTPK

SEQ ID NO: 1597 - protein, 7 aa, Artificial Sequence
  Synthetic
SAWGDAK

SEQ ID NO: 1598 - protein, 7 aa, Artificial Sequence
  Synthetic
TVANPFH

SEQ ID NO: 1599 - protein, 7 aa, Artificial Sequence
  Synthetic
TKSGWMA

SEQ ID NO: 1600 - protein, 7 aa, Artificial Sequence
  Synthetic
FTLTTPL

SEQ ID NO: 1601 - protein, 7 aa, Artificial Sequence
  Synthetic
GSFSRPQ

SEQ ID NO: 1602 - protein, 7 aa, Artificial Sequence
  Synthetic
SAWGPHK

SEQ ID NO: 1603 - protein, 7 aa, Artificial Sequence
  Synthetic
SAWGDSK

SEQ ID NO: 1604 - protein, 7 aa, Artificial Sequence
  Synthetic
TIAFKDV

SEQ ID NO: 1605 - protein, 7 aa, Artificial Sequence
  Synthetic
PDIARFY

SEQ ID NO: 1606 - protein, 7 aa, Artificial Sequence
  Synthetic
YNDRPFI

SEQ ID NO: 1607 - protein, 7 aa, Artificial Sequence
  Synthetic
TITFKQV

SEQ ID NO: 1608 - protein, 7 aa, Artificial Sequence
  Synthetic
TITFKSV

SEQ ID NO: 1609 - protein, 7 aa, Artificial Sequence
  Synthetic
TTMRTSQ

SEQ ID NO: 1610 - protein, 7 aa, Artificial Sequence
  Synthetic
SVSRPFL

SEQ ID NO: 1611 - protein, 7 aa, Artificial Sequence
  Synthetic
TIMFKDV

SEQ ID NO: 1612 - protein, 7 aa, Artificial Sequence
  Synthetic
SATGWSA

SEQ ID NO: 1613 - protein, 7 aa, Artificial Sequence
  Synthetic
FTYTTPK

SEQ ID NO: 1614 - protein, 7 aa, Artificial Sequence
  Synthetic
TITFKDV

SEQ ID NO: 1615 - protein, 7 aa, Artificial Sequence
  Synthetic
SLDFKNI

SEQ ID NO: 1616 - protein, 7 aa, Artificial Sequence
  Synthetic
FTLTDPK

SEQ ID NO: 1617 - protein, 7 aa, Artificial Sequence
  Synthetic
PKWNETN

SEQ ID NO: 1618 - protein, 7 aa, Artificial Sequence
  Synthetic
MGLSPPR

SEQ ID NO: 1619 - protein, 7 aa, Artificial Sequence
  Synthetic
QINFSVQ

SEQ ID NO: 1620 - protein, 7 aa, Artificial Sequence
  Synthetic
YLNVFVG

SEQ ID NO: 1621 - protein, 7 aa, Artificial Sequence
  Synthetic
VVGWHRE

SEQ ID NO: 1622 - protein, 7 aa, Artificial Sequence
  Synthetic
SAWGDLK

SEQ ID NO: 1623 - protein, 7 aa, Artificial Sequence
  Synthetic
NDLKYTR

SEQ ID NO: 1624 - protein, 7 aa, Artificial Sequence
  Synthetic
TITFKDV

SEQ ID NO: 1625 - protein, 7 aa, Artificial Sequence
  Synthetic
FTLTNPK

SEQ ID NO: 1626 - protein, 7 aa, Artificial Sequence
  Synthetic
SVYKPFL

SEQ ID NO: 1627 - protein, 7 aa, Artificial Sequence
  Synthetic
NVWSERG

SEQ ID NO: 1628 - protein, 7 aa, Artificial Sequence
  Synthetic
SKSGWMA

SEQ ID NO: 1629 - protein, 7 aa, Artificial Sequence
  Synthetic
PDIARQY

SEQ ID NO: 1630 - protein, 7 aa, Artificial Sequence
  Synthetic
SAWGDHR

SEQ ID NO: 1631 - protein, 7 aa, Artificial Sequence
  Synthetic
GDFSVPR

SEQ ID NO: 1632 - protein, 7 aa, Artificial Sequence
  Synthetic
THTFKDV

SEQ ID NO: 1633 - protein, 7 aa, Artificial Sequence
  Synthetic
WDINGPK

SEQ ID NO: 1634 - protein, 7 aa, Artificial Sequence
  Synthetic
QTKFSDV

SEQ ID NO: 1635 - protein, 7 aa, Artificial Sequence
  Synthetic
TYSGWPA

SEQ ID NO: 1636 - protein, 7 aa, Artificial Sequence
  Synthetic
TSMSVSR

SEQ ID NO: 1637 - protein, 7 aa, Artificial Sequence
  Synthetic
SNDRPFY

SEQ ID NO: 1638 - protein, 7 aa, Artificial Sequence
  Synthetic
SAWGDYK

SEQ ID NO: 1639 - protein, 7 aa, Artificial Sequence
  Synthetic
NTSSTSR

SEQ ID NO: 1640 - protein, 7 aa, Artificial Sequence
  Synthetic
SAWGDHV

SEQ ID NO: 1641 - protein, 7 aa, Artificial Sequence
  Synthetic
YLDQYFT

SEQ ID NO: 1642 - protein, 7 aa, Artificial Sequence
  Synthetic
PDIARVW

SEQ ID NO: 1643 - protein, 7 aa, Artificial Sequence
  Synthetic
PIIASTY

SEQ ID NO: 1644 - protein, 7 aa, Artificial Sequence
  Synthetic
AGHKLGY

SEQ ID NO: 1645 - protein, 7 aa, Artificial Sequence
  Synthetic
TTMRTSQ

SEQ ID NO: 1646 - protein, 7 aa, Artificial Sequence
  Synthetic
QAKFNVI

SEQ ID NO: 1647 - protein, 7 aa, Artificial Sequence
  Synthetic
PDIARTY

SEQ ID NO: 1648 - protein, 7 aa, Artificial Sequence
  Synthetic
GYTMPFS

SEQ ID NO: 1649 - protein, 7 aa, Artificial Sequence
  Synthetic
LYTNMSM

SEQ ID NO: 1650 - protein, 7 aa, Artificial Sequence
  Synthetic
DAIFRQA

SEQ ID NO: 1651 - protein, 7 aa, Artificial Sequence
  Synthetic
SSWGDHK

SEQ ID NO: 1652 - protein, 7 aa, Artificial Sequence
  Synthetic
PIIARVY

SEQ ID NO: 1653 - protein, 7 aa, Artificial Sequence
  Synthetic
SAQYPIR

SEQ ID NO: 1654 - protein, 7 aa, Artificial Sequence
  Synthetic
QLDRPFS

SEQ ID NO: 1655 - protein, 7 aa, Artificial Sequence
  Synthetic
DKIGFTP

SEQ ID NO: 1656 - protein, 7 aa, Artificial Sequence
  Synthetic
VGVRMGV

SEQ ID NO: 1657 - protein, 7 aa, Artificial Sequence
  Synthetic
RLSFKDV

SEQ ID NO: 1658 - protein, 7 aa, Artificial Sequence
  Synthetic
SAWGDHI

SEQ ID NO: 1659 - protein, 7 aa, Artificial Sequence
  Synthetic
QTNFNVM

SEQ ID NO: 1660 - protein, 7 aa, Artificial Sequence
  Synthetic
VYHNSAT

SEQ ID NO: 1661 - protein, 7 aa, Artificial Sequence
  Synthetic
FTSTTPK

SEQ ID NO: 1662 - protein, 7 aa, Artificial Sequence
  Synthetic
TLENVFK

SEQ ID NO: 1663 - protein, 7 aa, Artificial Sequence
  Synthetic
KPSSMSW

SEQ ID NO: 1664 - protein, 7 aa, Artificial Sequence
  Synthetic
PQEFKHV

SEQ ID NO: 1665 - protein, 7 aa, Artificial Sequence
  Synthetic
AIKFEAI

SEQ ID NO: 1666 - protein, 7 aa, Artificial Sequence
  Synthetic
SQKTPFL

SEQ ID NO: 1667 - protein, 7 aa, Artificial Sequence
  Synthetic
SVSTPFL

SEQ ID NO: 1668 - protein, 7 aa, Artificial Sequence
  Synthetic
SQLGFHP

SEQ ID NO: 1669 - protein, 7 aa, Artificial Sequence
  Synthetic
QINFSVQ

SEQ ID NO: 1670 - protein, 7 aa, Artificial Sequence
  Synthetic
TVTFKDV

SEQ ID NO: 1671 - protein, 7 aa, Artificial Sequence
  Synthetic
VDPRRGV

SEQ ID NO: 1672 - protein, 7 aa, Artificial Sequence
  Synthetic
SHQFSVI

SEQ ID NO: 1673 - protein, 7 aa, Artificial Sequence
  Synthetic
NDQRPFL

SEQ ID NO: 1674 - protein, 7 aa, Artificial Sequence
  Synthetic
SMWGDHK

SEQ ID NO: 1675 - protein, 7 aa, Artificial Sequence
  Synthetic
PVIARVY

SEQ ID NO: 1676 - protein, 7 aa, Artificial Sequence
  Synthetic
TGFTPPL

SEQ ID NO: 1677 - protein, 7 aa, Artificial Sequence
  Synthetic
SVSKFFL

SEQ ID NO: 1678 - protein, 7 aa, Artificial Sequence
  Synthetic
SPVNIFV

SEQ ID NO: 1679 - protein, 7 aa, Artificial Sequence
  Synthetic
TITFKQV

SEQ ID NO: 1680 - protein, 7 aa, Artificial Sequence
  Synthetic
SAWGDHH

SEQ ID NO: 1681 - protein, 7 aa, Artificial Sequence
  Synthetic
SAWGDTK

SEQ ID NO: 1682 - protein, 7 aa, Artificial Sequence
  Synthetic
TKSGWMA

SEQ ID NO: 1683 - protein, 7 aa, Artificial Sequence
  Synthetic
TVRFNNV

SEQ ID NO: 1684 - protein, 7 aa, Artificial Sequence
  Synthetic
FTLTTTK

SEQ ID NO: 1685 - protein, 7 aa, Artificial Sequence
  Synthetic
YNDRPFI

SEQ ID NO: 1686 - protein, 7 aa, Artificial Sequence
  Synthetic
YTLTTPK

SEQ ID NO: 1687 - protein, 7 aa, Artificial Sequence
  Synthetic
QRIADMF

SEQ ID NO: 1688 - protein, 7 aa, Artificial Sequence
  Synthetic
SAWGPHK

SEQ ID NO: 1689 - protein, 7 aa, Artificial Sequence
  Synthetic
NTWGDIK

SEQ ID NO: 1690 - protein, 7 aa, Artificial Sequence
  Synthetic
PNIVNTF

SEQ ID NO: 1691 - protein, 7 aa, Artificial Sequence
  Synthetic
PDIVRVY

SEQ ID NO: 1692 - protein, 7 aa, Artificial Sequence
  Synthetic
SVWGVNA

SEQ ID NO: 1693 - protein, 7 aa, Artificial Sequence
  Synthetic
SVSKPFP

SEQ ID NO: 1694 - protein, 7 aa, Artificial Sequence
  Synthetic
SGDRPFI

SEQ ID NO: 1695 - protein, 7 aa, Artificial Sequence
  Synthetic
EVKNPWL

SEQ ID NO: 1696 - protein, 7 aa, Artificial Sequence
  Synthetic
TRAMPFN

SEQ ID NO: 1697 - protein, 7 aa, Artificial Sequence
  Synthetic
FTLTTPY

SEQ ID NO: 1698 - protein, 7 aa, Artificial Sequence
  Synthetic
TVTFKDV

SEQ ID NO: 1699 - protein, 7 aa, Artificial Sequence
  Synthetic
NVQMPFI

SEQ ID NO: 1700 - protein, 7 aa, Artificial Sequence
  Synthetic
ESSIWVA

SEQ ID NO: 1701 - protein, 7 aa, Artificial Sequence
  Synthetic
GQWAGGG

SEQ ID NO: 1702 - protein, 7 aa, Artificial Sequence
  Synthetic
TRTFEHV

SEQ ID NO: 1703 - protein, 7 aa, Artificial Sequence
  Synthetic
SFARIGQ

SEQ ID NO: 1704 - protein, 7 aa, Artificial Sequence
  Synthetic
PDIARSY

SEQ ID NO: 1705 - protein, 7 aa, Artificial Sequence
  Synthetic
DVFRPTG

SEQ ID NO: 1706 - protein, 7 aa, Artificial Sequence
  Synthetic
SNDRPFW

SEQ ID NO: 1707 - protein, 7 aa, Artificial Sequence
  Synthetic
TKSTPFI

SEQ ID NO: 1708 - protein, 7 aa, Artificial Sequence
  Synthetic
SMVFASP

SEQ ID NO: 1709 - protein, 7 aa, Artificial Sequence
  Synthetic
QTALRMV

SEQ ID NO: 1710 - protein, 7 aa, Artificial Sequence
  Synthetic
PLIARVY

SEQ ID NO: 1711 - protein, 7 aa, Artificial Sequence
  Synthetic
GASAWGA

SEQ ID NO: 1712 - protein, 7 aa, Artificial Sequence
  Synthetic
SPWGAAS

SEQ ID NO: 1713 - protein, 7 aa, Artificial Sequence
  Synthetic
TVWNDRG

SEQ ID NO: 1714 - protein, 7 aa, Artificial Sequence
  Synthetic
FTLITPK

SEQ ID NO: 1715 - protein, 7 aa, Artificial Sequence
  Synthetic
LMPNPFG

SEQ ID NO: 1716 - protein, 7 aa, Artificial Sequence
  Synthetic
LQTHVFG

SEQ ID NO: 1717 - protein, 7 aa, Artificial Sequence
  Synthetic
SHQFSVI

SEQ ID NO: 1718 - protein, 7 aa, Artificial Sequence
  Synthetic
TVWQVEG

SEQ ID NO: 1719 - protein, 7 aa, Artificial Sequence
  Synthetic
TITFKAV

SEQ ID NO: 1720 - protein, 7 aa, Artificial Sequence
  Synthetic
NMFSANL

SEQ ID NO: 1721 - protein, 7 aa, Artificial Sequence
  Synthetic
SAWGVHK

SEQ ID NO: 1722 - protein, 7 aa, Artificial Sequence
  Synthetic
AIKFEAI

SEQ ID NO: 1723 - protein, 7 aa, Artificial Sequence
  Synthetic
GGATPFR

SEQ ID NO: 1724 - protein, 7 aa, Artificial Sequence
  Synthetic
QKDYGMW

SEQ ID NO: 1725 - protein, 7 aa, Artificial Sequence
  Synthetic
LMPNPFG

SEQ ID NO: 1726 - protein, 7 aa, Artificial Sequence
  Synthetic
TDMKYLY

SEQ ID NO: 1727 - protein, 7 aa, Artificial Sequence
  Synthetic
SLKSVFS

SEQ ID NO: 1728 - protein, 7 aa, Artificial Sequence
  Synthetic
SNDRPFQ

SEQ ID NO: 1729 - protein, 7 aa, Artificial Sequence
  Synthetic
SGDRPFI

SEQ ID NO: 1730 - protein, 7 aa, Artificial Sequence
  Synthetic
TITFKYV

SEQ ID NO: 1731 - protein, 7 aa, Artificial Sequence
  Synthetic
RNTFSNV

SEQ ID NO: 1732 - protein, 7 aa, Artificial Sequence
  Synthetic
QAKFNVI

SEQ ID NO: 1733 - protein, 7 aa, Artificial Sequence
  Synthetic
MNVSLYP

SEQ ID NO: 1734 - protein, 7 aa, Artificial Sequence
  Synthetic
ALHVPFK

SEQ ID NO: 1735 - protein, 7 aa, Artificial Sequence
  Synthetic
PMIARVY

SEQ ID NO: 1736 - protein, 7 aa, Artificial Sequence
  Synthetic
LPKWTEI

SEQ ID NO: 1737 - protein, 7 aa, Artificial Sequence
  Synthetic
TGFTPPL

SEQ ID NO: 1738 - protein, 7 aa, Artificial Sequence
  Synthetic
LYTNMSM

SEQ ID NO: 1739 - protein, 7 aa, Artificial Sequence
  Synthetic
SRSGWMA

SEQ ID NO: 1740 - protein, 7 aa, Artificial Sequence
  Synthetic
AHWTRDG

SEQ ID NO: 1741 - protein, 7 aa, Artificial Sequence
  Synthetic
TITFKMV

SEQ ID NO: 1742 - protein, 7 aa, Artificial Sequence
  Synthetic
AHWTRDG

SEQ ID NO: 1743 - protein, 7 aa, Artificial Sequence
  Synthetic
SAWASMG

SEQ ID NO: 1744 - protein, 7 aa, Artificial Sequence
  Synthetic
SIKQPWT

SEQ ID NO: 1745 - protein, 7 aa, Artificial Sequence
  Synthetic
TITFCDV

SEQ ID NO: 1746 - protein, 7 aa, Artificial Sequence
  Synthetic
WVAPKMS

SEQ ID NO: 1747 - protein, 7 aa, Artificial Sequence
  Synthetic
SAWGDHI

SEQ ID NO: 1748 - protein, 7 aa, Artificial Sequence
  Synthetic
SNDRPFQ

SEQ ID NO: 1749 - protein, 7 aa, Artificial Sequence
  Synthetic
SVWKNQG

SEQ ID NO: 1750 - protein, 7 aa, Artificial Sequence
  Synthetic
GYTQVYS

SEQ ID NO: 1751 - protein, 7 aa, Artificial Sequence
  Synthetic
DLWRPND

SEQ ID NO: 1752 - protein, 7 aa, Artificial Sequence
  Synthetic
TRLGWVA

SEQ ID NO: 1753 - protein, 7 aa, Artificial Sequence
  Synthetic
SSWGDHK

SEQ ID NO: 1754 - protein, 7 aa, Artificial Sequence
  Synthetic
NDFASPR

SEQ ID NO: 1755 - protein, 7 aa, Artificial Sequence
  Synthetic
FTLTGPK

SEQ ID NO: 1756 - protein, 7 aa, Artificial Sequence
  Synthetic
HRDWPGS

SEQ ID NO: 1757 - protein, 7 aa, Artificial Sequence
  Synthetic
RPVNEWV

SEQ ID NO: 1758 - protein, 7 aa, Artificial Sequence
  Synthetic
MEKVFTV

SEQ ID NO: 1759 - protein, 7 aa, Artificial Sequence
  Synthetic
SAWGDNK

SEQ ID NO: 1760 - protein, 7 aa, Artificial Sequence
  Synthetic
SAWGDHY

SEQ ID NO: 1761 - protein, 7 aa, Artificial Sequence
  Synthetic
FTNTTPK

SEQ ID NO: 1762 - protein, 7 aa, Artificial Sequence
  Synthetic
DKNGWVA

SEQ ID NO: 1763 - protein, 7 aa, Artificial Sequence
  Synthetic
NDQRPFL

SEQ ID NO: 1764 - protein, 7 aa, Artificial Sequence
  Synthetic
NTMRTSN

SEQ ID NO: 1765 - protein, 7 aa, Artificial Sequence
  Synthetic
CRSTNGI

SEQ ID NO: 1766 - protein, 7 aa, Artificial Sequence
  Synthetic
SVSYPFL

SEQ ID NO: 1767 - protein, 7 aa, Artificial Sequence
  Synthetic
SNYRPFI

SEQ ID NO: 1768 - protein, 7 aa, Artificial Sequence
  Synthetic
SLFRIDG

SEQ ID NO: 1769 - protein, 7 aa, Artificial Sequence
  Synthetic
NSLTTSV

SEQ ID NO: 1770 - protein, 7 aa, Artificial Sequence
  Synthetic
MEKVFTV

SEQ ID NO: 1771 - protein, 7 aa, Artificial Sequence
  Synthetic
MYKDFSV

SEQ ID NO: 1772 - protein, 7 aa, Artificial Sequence
  Synthetic
SPWGAAS

SEQ ID NO: 1773 - protein, 7 aa, Artificial Sequence
  Synthetic
NAWGDVL

SEQ ID NO: 1774 - protein, 7 aa, Artificial Sequence
  Synthetic
WDINGPK

SEQ ID NO: 1775 - protein, 7 aa, Artificial Sequence
  Synthetic
PKWNETN

SEQ ID NO: 1776 - protein, 7 aa, Artificial Sequence
  Synthetic
MNVSLYP

SEQ ID NO: 1777 - protein, 7 aa, Artificial Sequence
  Synthetic
TFFATPP

SEQ ID NO: 1778 - protein, 7 aa, Artificial Sequence
  Synthetic
FSLTTPK

SEQ ID NO: 1779 - protein, 7 aa, Artificial Sequence
  Synthetic
TDLKQSR

SEQ ID NO: 1780 - protein, 7 aa, Artificial Sequence
  Synthetic
REEFRNI

SEQ ID NO: 1781 - protein, 7 aa, Artificial Sequence
  Synthetic
GAVGWAA

SEQ ID NO: 1782 - protein, 7 aa, Artificial Sequence
  Synthetic
RMFNPPE

SEQ ID NO: 1783 - protein, 7 aa, Artificial Sequence
  Synthetic
SDWTGKM

SEQ ID NO: 1784 - protein, 7 aa, Artificial Sequence
  Synthetic
QDLKYVR

SEQ ID NO: 1785 - protein, 7 aa, Artificial Sequence
  Synthetic
LSNGWVP

SEQ ID NO: 1786 - protein, 7 aa, Artificial Sequence
  Synthetic
SVSNPFL

SEQ ID NO: 1787 - protein, 7 aa, Artificial Sequence
  Synthetic
KPSSMSW

SEQ ID NO: 1788 - protein, 7 aa, Artificial Sequence
  Synthetic
VGVRMGV

SEQ ID NO: 1789 - protein, 7 aa, Artificial Sequence
  Synthetic
TRTGWMA

SEQ ID NO: 1790 - protein, 7 aa, Artificial Sequence
  Synthetic
HRDWPGS

SEQ ID NO: 1791 - protein, 7 aa, Artificial Sequence
  Synthetic
MSDNFYP

SEQ ID NO: 1792 - protein, 7 aa, Artificial Sequence
  Synthetic
SYFGEQN

SEQ ID NO: 1793 - protein, 7 aa, Artificial Sequence
  Synthetic
SVSNPFL

SEQ ID NO: 1794 - protein, 7 aa, Artificial Sequence
  Synthetic
SAWGDHH

SEQ ID NO: 1795 - protein, 7 aa, Artificial Sequence
  Synthetic
THFLQQP

SEQ ID NO: 1796 - protein, 7 aa, Artificial Sequence
  Synthetic
GNDRPFI

SEQ ID NO: 1797 - protein, 7 aa, Artificial Sequence
  Synthetic
KAAFNNI

SEQ ID NO: 1798 - protein, 7 aa, Artificial Sequence
  Synthetic
TKSTPFI

SEQ ID NO: 1799 - protein, 7 aa, Artificial Sequence
  Synthetic
SAINLRY

SEQ ID NO: 1800 - protein, 7 aa, Artificial Sequence
  Synthetic
SAWGDYK

SEQ ID NO: 1801 - protein, 7 aa, Artificial Sequence
  Synthetic
SVRKPFL

SEQ ID NO: 1802 - protein, 7 aa, Artificial Sequence
  Synthetic
DVFRLGD

SEQ ID NO: 1803 - protein, 7 aa, Artificial Sequence
  Synthetic
GYTQVYS

SEQ ID NO: 1804 - protein, 7 aa, Artificial Sequence
  Synthetic
EHWTNSK

SEQ ID NO: 1805 - protein, 7 aa, Artificial Sequence
  Synthetic
DKNGWVA

SEQ ID NO: 1806 - protein, 7 aa, Artificial Sequence
  Synthetic
DAWGDHK

SEQ ID NO: 1807 - protein, 7 aa, Artificial Sequence
  Synthetic
DGNWSAL

SEQ ID NO: 1808 - protein, 7 aa, Artificial Sequence
  Synthetic
FTLTDPK

SEQ ID NO: 1809 - protein, 7 aa, Artificial Sequence
  Synthetic
SVSSPFL

SEQ ID NO: 1810 - protein, 7 aa, Artificial Sequence
  Synthetic
QTKFSDV

SEQ ID NO: 1811 - protein, 7 aa, Artificial Sequence
  Synthetic
SQNFKAP

SEQ ID NO: 1812 - protein, 7 aa, Artificial Sequence
  Synthetic
TTMTESR

SEQ ID NO: 1813 - protein, 7 aa, Artificial Sequence
  Synthetic
TTMTESR

SEQ ID NO: 1814 - protein, 7 aa, Artificial Sequence
  Synthetic
DKQKPFL

SEQ ID NO: 1815 - protein, 7 aa, Artificial Sequence
  Synthetic
NIWSTNG

SEQ ID NO: 1816 - protein, 7 aa, Artificial Sequence
  Synthetic
KAAFNNI

SEQ ID NO: 1817 - protein, 7 aa, Artificial Sequence
  Synthetic
FTLYTPK

SEQ ID NO: 1818 - protein, 7 aa, Artificial Sequence
  Synthetic
RMFNPPE

SEQ ID NO: 1819 - protein, 7 aa, Artificial Sequence
  Synthetic
TITFKAV

SEQ ID NO: 1820 - protein, 7 aa, Artificial Sequence
  Synthetic
EGRRIGD

SEQ ID NO: 1821 - protein, 7 aa, Artificial Sequence
  Synthetic
SNFRPFI

SEQ ID NO: 1822 - protein, 7 aa, Artificial Sequence
  Synthetic
VVGWHRE

SEQ ID NO: 1823 - protein, 7 aa, Artificial Sequence
  Synthetic
AGGWGAP

SEQ ID NO: 1824 - protein, 7 aa, Artificial Sequence
  Synthetic
MTMSTSV

SEQ ID NO: 1825 - protein, 7 aa, Artificial Sequence
  Synthetic
YLNVFVG

SEQ ID NO: 1826 - protein, 7 aa, Artificial Sequence
  Synthetic
LAKLNKN

SEQ ID NO: 1827 - protein, 7 aa, Artificial Sequence
  Synthetic
SVSTPFL

SEQ ID NO: 1828 - protein, 7 aa, Artificial Sequence
  Synthetic
EVSKPFL

SEQ ID NO: 1829 - protein, 7 aa, Artificial Sequence
  Synthetic
PDIIRVY

SEQ ID NO: 1830 - protein, 7 aa, Artificial Sequence
  Synthetic
TVWQVEG

SEQ ID NO: 1831 - protein, 7 aa, Artificial Sequence
  Synthetic
SAWGSHK

SEQ ID NO: 1832 - protein, 7 aa, Artificial Sequence
  Synthetic
AGSFKDI

SEQ ID NO: 1833 - protein, 7 aa, Artificial Sequence
  Synthetic
SDSKPFL

SEQ ID NO: 1834 - protein, 7 aa, Artificial Sequence
  Synthetic
QNPGWLP

SEQ ID NO: 1835 - protein, 7 aa, Artificial Sequence
  Synthetic
WENFKSV

SEQ ID NO: 1836 - protein, 7 aa, Artificial Sequence
  Synthetic
SLFRIDG

SEQ ID NO: 1837 - protein, 7 aa, Artificial Sequence
  Synthetic
DKQKPFL

SEQ ID NO: 1838 - protein, 7 aa, Artificial Sequence
  Synthetic
MTMSTSV

SEQ ID NO: 1839 - protein, 7 aa, Artificial Sequence
  Synthetic
TLTFKDV

SEQ ID NO: 1840 - protein, 7 aa, Artificial Sequence
  Synthetic
SAWGDDK

SEQ ID NO: 1841 - protein, 7 aa, Artificial Sequence
  Synthetic
SAWGDDK

SEQ ID NO: 1842 - protein, 7 aa, Artificial Sequence
  Synthetic
VTQFHNI

SEQ ID NO: 1843 - protein, 7 aa, Artificial Sequence
  Synthetic
GNDRPFI

SEQ ID NO: 1844 - protein, 7 aa, Artificial Sequence
  Synthetic
NAWSLAG

SEQ ID NO: 1845 - protein, 7 aa, Artificial Sequence
  Synthetic
SWDRPFI

SEQ ID NO: 1846 - protein, 7 aa, Artificial Sequence
  Synthetic
SQISMYK

SEQ ID NO: 1847 - protein, 7 aa, Artificial Sequence
  Synthetic
SVSAPFL

SEQ ID NO: 1848 - protein, 7 aa, Artificial Sequence
  Synthetic
NPRWDNP

SEQ ID NO: 1849 - protein, 7 aa, Artificial Sequence
  Synthetic
TVNIPFQ

SEQ ID NO: 1850 - protein, 7 aa, Artificial Sequence
  Synthetic
SVWSEHG

SEQ ID NO: 1851 - protein, 7 aa, Artificial Sequence
  Synthetic
TRTFEHV

SEQ ID NO: 1852 - protein, 7 aa, Artificial Sequence
  Synthetic
TFPGWPA

SEQ ID NO: 1853 - protein, 7 aa, Artificial Sequence
  Synthetic
LSNGWVP

SEQ ID NO: 1854 - protein, 7 aa, Artificial Sequence
  Synthetic
GDFSVPR

SEQ ID NO: 1855 - protein, 7 aa, Artificial Sequence
  Synthetic
NTMSQSK

SEQ ID NO: 1856 - protein, 7 aa, Artificial Sequence
  Synthetic
WVAPKMS

SEQ ID NO: 1857 - protein, 7 aa, Artificial Sequence
  Synthetic
SVWALNG

SEQ ID NO: 1858 - protein, 7 aa, Artificial Sequence
  Synthetic
REEFRNI

SEQ ID NO: 1859 - protein, 7 aa, Artificial Sequence
  Synthetic
PITFKDV

SEQ ID NO: 1860 - protein, 7 aa, Artificial Sequence
  Synthetic
EKQGWVA

SEQ ID NO: 1861 - protein, 7 aa, Artificial Sequence
  Synthetic
FNLTTPK

SEQ ID NO: 1862 - protein, 7 aa, Artificial Sequence
  Synthetic
LAKCGLN

SEQ ID NO: 1863 - protein, 7 aa, Artificial Sequence
  Synthetic
FGLAASR

SEQ ID NO: 1864 - protein, 7 aa, Artificial Sequence
  Synthetic
NSLTTSV

SEQ ID NO: 1865 - protein, 7 aa, Artificial Sequence
  Synthetic
GGLPMIP

SEQ ID NO: 1866 - protein, 7 aa, Artificial Sequence
  Synthetic
PPTNISR

SEQ ID NO: 1867 - protein, 7 aa, Artificial Sequence
  Synthetic
WERLGDV

SEQ ID NO: 1868 - protein, 7 aa, Artificial Sequence
  Synthetic
NQTSIYK

SEQ ID NO: 1869 - protein, 7 aa, Artificial Sequence
  Synthetic
PTNAVSW

SEQ ID NO: 1870 - protein, 7 aa, Artificial Sequence
  Synthetic
WTLTTPK

SEQ ID NO: 1871 - protein, 7 aa, Artificial Sequence
  Synthetic
FTLTTPW

SEQ ID NO: 1872 - protein, 7 aa, Artificial Sequence
  Synthetic
TKSFAQI

SEQ ID NO: 1873 - protein, 7 aa, Artificial Sequence
  Synthetic
QKDYGMW

SEQ ID NO: 1874 - protein, 7 aa, Artificial Sequence
  Synthetic
SVWKNQG

SEQ ID NO: 1875 - protein, 7 aa, Artificial Sequence
  Synthetic
TMTFKDV

SEQ ID NO: 1876 - protein, 7 aa, Artificial Sequence
  Synthetic
TAWREDG

SEQ ID NO: 1877 - protein, 7 aa, Artificial Sequence
  Synthetic
NTTKTSV

SEQ ID NO: 1878 - protein, 7 aa, Artificial Sequence
  Synthetic
SAWGSHK

SEQ ID NO: 1879 - protein, 7 aa, Artificial Sequence
  Synthetic
AGHKLGY

SEQ ID NO: 1880 - protein, 7 aa, Artificial Sequence
  Synthetic
TSNFAQI

SEQ ID NO: 1881 - protein, 7 aa, Artificial Sequence
  Synthetic
MSVRFTP

SEQ ID NO: 1882 - protein, 7 aa, Artificial Sequence
  Synthetic
EKQGWVA

SEQ ID NO: 1883 - protein, 7 aa, Artificial Sequence
  Synthetic
DQWRPSG

SEQ ID NO: 1884 - protein, 7 aa, Artificial Sequence
  Synthetic
FQDKHWL

SEQ ID NO: 1885 - protein, 7 aa, Artificial Sequence
  Synthetic
SAWGDEK

SEQ ID NO: 1886 - protein, 7 aa, Artificial Sequence
  Synthetic
RIFTEPP

SEQ ID NO: 1887 - protein, 7 aa, Artificial Sequence
  Synthetic
SAWGDHQ

SEQ ID NO: 1888 - protein, 7 aa, Artificial Sequence
  Synthetic
FTNTTPK

SEQ ID NO: 1889 - protein, 7 aa, Artificial Sequence
  Synthetic
MRNDFIP

SEQ ID NO: 1890 - protein, 7 aa, Artificial Sequence
  Synthetic
AEKFEHV

SEQ ID NO: 1891 - protein, 7 aa, Artificial Sequence
  Synthetic
QTSFREI

SEQ ID NO: 1892 - protein, 7 aa, Artificial Sequence
  Synthetic
NTLRESI

SEQ ID NO: 1893 - protein, 7 aa, Artificial Sequence
  Synthetic
DLFSDKR

SEQ ID NO: 1894 - protein, 7 aa, Artificial Sequence
  Synthetic
SAWSEKM

SEQ ID NO: 1895 - protein, 7 aa, Artificial Sequence
  Synthetic
SATNWGA

SEQ ID NO: 1896 - protein, 7 aa, Artificial Sequence
  Synthetic
QRIADMF

SEQ ID NO: 1897 - protein, 7 aa, Artificial Sequence
  Synthetic
AGVRLGY

SEQ ID NO: 1898 - protein, 7 aa, Artificial Sequence
  Synthetic
NMYHLTG

SEQ ID NO: 1899 - protein, 7 aa, Artificial Sequence
  Synthetic
NMWSANG

SEQ ID NO: 1900 - protein, 7 aa, Artificial Sequence
  Synthetic
VWIAQAQ

SEQ ID NO: 1901 - protein, 7 aa, Artificial Sequence
  Synthetic
KTEFARV

SEQ ID NO: 1902 - protein, 7 aa, Artificial Sequence
  Synthetic
MSVRFTP

SEQ ID NO: 1903 - protein, 7 aa, Artificial Sequence
  Synthetic
LNTPFLP

SEQ ID NO: 1904 - protein, 7 aa, Artificial Sequence
  Synthetic
TTDRTSK

SEQ ID NO: 1905 - protein, 7 aa, Artificial Sequence
  Synthetic
LPKWTEI

SEQ ID NO: 1906 - protein, 7 aa, Artificial Sequence
  Synthetic
SVSKPFL

SEQ ID NO: 1907 - protein, 7 aa, Artificial Sequence
  Synthetic
SVSKPFL

SEQ ID NO: 1908 - protein, 7 aa, Artificial Sequence
  Synthetic
FTLTTPK

SEQ ID NO: 1909 - protein, 7 aa, Artificial Sequence
  Synthetic
FTLTTPK

SEQ ID NO: 1910 - DNA, 21 bp, Artificial Sequence
  Synthetic
tccaatttgaggccgttcata

SEQ ID NO: 1911 - DNA, 21 bp, Artificial Sequence
  Synthetic
acggtgaggttcaataatgtg

SEQ ID NO: 1912 - DNA, 21 bp, Artificial Sequence
  Synthetic
cgcccctcaaacgtatcatgg

SEQ ID NO: 1913 - DNA, 21 bp, Artificial Sequence
  Synthetic
tcatttgaccgcccctttatc

SEQ ID NO: 1914 - DNA, 21 bp, Artificial Sequence
  Synthetic
ttcacgttggtgacgccgaaa

SEQ ID NO: 1915 - DNA, 21 bp, Artificial Sequence
  Synthetic
tcctccaaattcataaatata

SEQ ID NO: 1916 - DNA, 21 bp, Artificial Sequence
  Synthetic
tccgtgtccaaaatattcttg

SEQ ID NO: 1917 - DNA, 21 bp, Artificial Sequence
  Synthetic
ccgccgttgttcagggagttg

SEQ ID NO: 1918 - DNA, 21 bp, Artificial Sequence
  Synthetic
tcaaacatgcgcccctttatc

SEQ ID NO: 1919 - DNA, 21 bp, Artificial Sequence
  Synthetic
gacccccataccatctcatgg

SEQ ID NO: 1920 - DNA, 21 bp, Artificial Sequence
  Synthetic
cgcctgtcatttaaggacgta

SEQ ID NO: 1921 - DNA, 21 bp, Artificial Sequence
  Synthetic
ttcacgttgacggtgccgaaa

SEQ ID NO: 1922 - DNA, 21 bp, Artificial Sequence
  Synthetic
acctcacaaatcccctttcgc

SEQ ID NO: 1923 - DNA, 21 bp, Artificial Sequence
  Synthetic
tccgtgtccatgccgttcttg

SEQ ID NO: 1924 - DNA, 21 bp, Artificial Sequence
  Synthetic
acgttcttcgcgacgccgccg

SEQ ID NO: 1925 - DNA, 21 bp, Artificial Sequence
  Synthetic
cagtccgtgttcgcgtccgtg

SEQ ID NO: 1926 - DNA, 21 bp, Artificial Sequence
  Synthetic
tttaccctgaccatccccaag

SEQ ID NO: 1927 - DNA, 21 bp, Artificial Sequence
  Synthetic
cccgacatcgcccgcgtattt

SEQ ID NO: 1928 - DNA, 21 bp, Artificial Sequence
  Synthetic
atgatggcgaaaccgttcttg

SEQ ID NO: 1929 - DNA, 21 bp, Artificial Sequence
  Synthetic
tatgagaaacacttcttcaaa

SEQ ID NO: 1930 - DNA, 21 bp, Artificial Sequence
  Synthetic
tcaatcaccaacctgtacaag

SEQ ID NO: 1931 - DNA, 21 bp, Artificial Sequence
  Synthetic
ggcgtaacccatgtatttaag

SEQ ID NO: 1932 - DNA, 21 bp, Artificial Sequence
  Synthetic
ggcgtagaccgcccctttaag

SEQ ID NO: 1933 - DNA, 21 bp, Artificial Sequence
  Synthetic
caggtgtccaaaccgttcttg

SEQ ID NO: 1934 - DNA, 21 bp, Artificial Sequence
  Synthetic
tcccagtccaaaccgttcttg

SEQ ID NO: 1935 - DNA, 21 bp, Artificial Sequence
  Synthetic
tttaccctgaccgcccccaag

SEQ ID NO: 1936 - DNA, 21 bp, Artificial Sequence
  Synthetic
tcaatcaagcaaccctggacc

SEQ ID NO: 1937 - DNA, 21 bp, Artificial Sequence
  Synthetic
tttaccctgaccacccccatg

SEQ ID NO: 1938 - DNA, 21 bp, Artificial Sequence
  Synthetic
tacgaaaagcatttttttaag

SEQ ID NO: 1939 - DNA, 21 bp, Artificial Sequence
  Synthetic
tatgtggataggttgttcaaa

SEQ ID NO: 1940 - DNA, 21 bp, Artificial Sequence
  Synthetic
tccataacgaatttgtataaa

SEQ ID NO: 1941 - DNA, 21 bp, Artificial Sequence
  Synthetic
tccgtgtccaaaccgttctat

SEQ ID NO: 1942 - DNA, 21 bp, Artificial Sequence
  Synthetic
tccttgtccaaaccgttctcc

SEQ ID NO: 1943 - DNA, 21 bp, Artificial Sequence
  Synthetic
tccatatccaaaccgttcttg

SEQ ID NO: 1944 - DNA, 21 bp, Artificial Sequence
  Synthetic
tttaccctgacccatcccaag

SEQ ID NO: 1945 - DNA, 21 bp, Artificial Sequence
  Synthetic
tcccagatatccatgtataaa

SEQ ID NO: 1946 - DNA, 21 bp, Artificial Sequence
  Synthetic
ccccaaatcgcccgcgtatac

SEQ ID NO: 1947 - DNA, 21 bp, Artificial Sequence
  Synthetic
aatgagaggaggccgttcttg

SEQ ID NO: 1948 - DNA, 21 bp, Artificial Sequence
  Synthetic
gggatgttcaatccgccgtcc

SEQ ID NO: 1949 - DNA, 21 bp, Artificial Sequence
  Synthetic
accaccatgaagccctttaac

SEQ ID NO: 1950 - DNA, 21 bp, Artificial Sequence
  Synthetic
accctgtcatcaccctggacc

SEQ ID NO: 1951 - DNA, 21 bp, Artificial Sequence
  Synthetic
tccatagcgaggccgttcgtg

SEQ ID NO: 1952 - DNA, 21 bp, Artificial Sequence
  Synthetic
acgataatattcaaagatgtg

SEQ ID NO: 1953 - DNA, 21 bp, Artificial Sequence
  Synthetic
acggtgtccaaaccgttcttg

SEQ ID NO: 1954 - DNA, 21 bp, Artificial Sequence
  Synthetic
tcagtaatcaagccctttctg

SEQ ID NO: 1955 - DNA, 21 bp, Artificial Sequence
  Synthetic
ccgttgatagcgagggtgtat

SEQ ID NO: 1956 - DNA, 21 bp, Artificial Sequence
  Synthetic
aagtttacctttggcgacgta

SEQ ID NO: 1957 - DNA, 21 bp, Artificial Sequence
  Synthetic
tccgtgatgaaaccgttcttg

SEQ ID NO: 1958 - DNA, 21 bp, Artificial Sequence
  Synthetic
tcaaaggaccgcccctttatc

SEQ ID NO: 1959 - DNA, 21 bp, Artificial Sequence
  Synthetic
atagtgtccaaaccgttcttg

SEQ ID NO: 1960 - DNA, 21 bp, Artificial Sequence
  Synthetic
acgatggataaaccgttccac

SEQ ID NO: 1961 - DNA, 21 bp, Artificial Sequence
  Synthetic
acgtccatgaaaccgttcttg

SEQ ID NO: 1962 - DNA, 21 bp, Artificial Sequence
  Synthetic
tccaatatgaggccgttcata

SEQ ID NO: 1963 - DNA, 21 bp, Artificial Sequence
  Synthetic
tcagtatcaaagatctttctg

SEQ ID NO: 1964 - DNA, 21 bp, Artificial Sequence
  Synthetic
tcagtagccaagccctttctg

SEQ ID NO: 1965 - DNA, 21 bp, Artificial Sequence
  Synthetic
acgttgccgttcccgaatagg

SEQ ID NO: 1966 - DNA, 21 bp, Artificial Sequence
  Synthetic
tttaccatcaccacccccaag

SEQ ID NO: 1967 - DNA, 21 bp, Artificial Sequence
  Synthetic
gggttggataatatattcaaa

SEQ ID NO: 1968 - DNA, 21 bp, Artificial Sequence
  Synthetic
gtggggatagcgttggggagg

SEQ ID NO: 1969 - DNA, 21 bp, Artificial Sequence
  Synthetic
cagttgaaattcacgaatgtg

SEQ ID NO: 1970 - DNA, 21 bp, Artificial Sequence
  Synthetic
aaaacgtccttccacgcgata

SEQ ID NO: 1971 - DNA, 21 bp, Artificial Sequence
  Synthetic
tccttctccaaaccgttcttg

SEQ ID NO: 1972 - DNA, 21 bp, Artificial Sequence
  Synthetic
aggataacgttcaaagatgtg

SEQ ID NO: 1973 - DNA, 21 bp, Artificial Sequence
  Synthetic
aatgtgtccaaaccgttcttg

SEQ ID NO: 1974 - DNA, 21 bp, Artificial Sequence
  Synthetic
tccttgtggggggatcacaaa

SEQ ID NO: 1975 - DNA, 21 bp, Artificial Sequence
  Synthetic
gtaccctggaacaagcaaacc

SEQ ID NO: 1976 - DNA, 21 bp, Artificial Sequence
  Synthetic
tccttgtccaaaccgttcttg

SEQ ID NO: 1977 - DNA, 21 bp, Artificial Sequence
  Synthetic
cccgacatcgcccgcctgtac

SEQ ID NO: 1978 - DNA, 21 bp, Artificial Sequence
  Synthetic
atggtgtccaaaccgttcttg

SEQ ID NO: 1979 - DNA, 21 bp, Artificial Sequence
  Synthetic
cccaccatcgcccgcgtatac

SEQ ID NO: 1980 - DNA, 21 bp, Artificial Sequence
  Synthetic
ctggactggcccgccaccaag

SEQ ID NO: 1981 - DNA, 21 bp, Artificial Sequence
  Synthetic
gacatcgaacgcctgtttaag

SEQ ID NO: 1982 - DNA, 21 bp, Artificial Sequence
  Synthetic
aatcagacgtccatatataaa

SEQ ID NO: 1983 - DNA, 21 bp, Artificial Sequence
  Synthetic
gtggtgtccaaaccgttcttg

SEQ ID NO: 1984 - DNA, 21 bp, Artificial Sequence
  Synthetic
tccgcgtggggggatcacttg

SEQ ID NO: 1985 - DNA, 21 bp, Artificial Sequence
  Synthetic
aacgaacgccgcccctttctg

SEQ ID NO: 1986 - DNA, 21 bp, Artificial Sequence
  Synthetic
acgtcccagataccgttcagg

SEQ ID NO: 1987 - DNA, 21 bp, Artificial Sequence
  Synthetic
tcagtaatgaagccctttctg

SEQ ID NO: 1988 - DNA, 21 bp, Artificial Sequence
  Synthetic
accctgggcaacgtatttaag

SEQ ID NO: 1989 - DNA, 21 bp, Artificial Sequence
  Synthetic
gccaccaagtttgccctggta

SEQ ID NO: 1990 - DNA, 21 bp, Artificial Sequence
  Synthetic
ggggtggataggccgttcaaa

SEQ ID NO: 1991 - DNA, 21 bp, Artificial Sequence
  Synthetic
tcccactccaaaccgttcttg

SEQ ID NO: 1992 - DNA, 21 bp, Artificial Sequence
  Synthetic
tcaacctcaaagccctttctg

SEQ ID NO: 1993 - DNA, 21 bp, Artificial Sequence
  Synthetic
accctgacctcaccctttcgc

SEQ ID NO: 1994 - DNA, 21 bp, Artificial Sequence
  Synthetic
tccataaataaaccgttcgtg

SEQ ID NO: 1995 - DNA, 21 bp, Artificial Sequence
  Synthetic
ccgacgatagcgagggtgtat

SEQ ID NO: 1996 - DNA, 21 bp, Artificial Sequence
  Synthetic
taccgcgacaacatctttaag

SEQ ID NO: 1997 - DNA, 21 bp, Artificial Sequence
  Synthetic
ttcacgatgacgacgccgaaa

SEQ ID NO: 1998 - DNA, 21 bp, Artificial Sequence
  Synthetic
tccaattccaaaccgttcttg

SEQ ID NO: 1999 - DNA, 21 bp, Artificial Sequence
  Synthetic
aacatcatccgcccctttgcc

SEQ ID NO: 2000 - DNA, 21 bp, Artificial Sequence
  Synthetic
acccgcacctttaaggacgta

SEQ ID NO: 2001 - DNA, 21 bp, Artificial Sequence
  Synthetic
ttcacgttgacgcacccgaaa

SEQ ID NO: 2002 - DNA, 21 bp, Artificial Sequence
  Synthetic
ggcaagtgggccccccccgcc

SEQ ID NO: 2003 - DNA, 21 bp, Artificial Sequence
  Synthetic
tccgtgtccaaaccgttcttc

SEQ ID NO: 2004 - DNA, 21 bp, Artificial Sequence
  Synthetic
tcatttgcccgcatcggccaa

SEQ ID NO: 2005 - DNA, 21 bp, Artificial Sequence
  Synthetic
tcctattccaaaccgttcttg

SEQ ID NO: 2006 - DNA, 21 bp, Artificial Sequence
  Synthetic
tttaccctgaccaccgccaag

SEQ ID NO: 2007 - DNA, 21 bp, Artificial Sequence
  Synthetic
aacaccctgcaagtatcaaag

SEQ ID NO: 2008 - DNA, 21 bp, Artificial Sequence
  Synthetic
tttaccctgacctcacccaag

SEQ ID NO: 2009 - DNA, 21 bp, Artificial Sequence
  Synthetic
tcctcctccaaaccgttcttg

SEQ ID NO: 2010 - DNA, 21 bp, Artificial Sequence
  Synthetic
ttcgtggagaaattcaatagg

SEQ ID NO: 2011 - DNA, 21 bp, Artificial Sequence
  Synthetic
ccggatatagcgaggttctat

SEQ ID NO: 2012 - DNA, 21 bp, Artificial Sequence
  Synthetic
acgttggggaatgtgttcaaa

SEQ ID NO: 2013 - DNA, 21 bp, Artificial Sequence
  Synthetic
cagacgttgttcaaaaatata

SEQ ID NO: 2014 - DNA, 21 bp, Artificial Sequence
  Synthetic
tcagtatcaaagcccttttgg

SEQ ID NO: 2015 - DNA, 21 bp, Artificial Sequence
  Synthetic
aatatatggtccacgaatggg

SEQ ID NO: 2016 - DNA, 21 bp, Artificial Sequence
  Synthetic
ccgatgatagcgagggtgtat

SEQ ID NO: 2017 - DNA, 21 bp, Artificial Sequence
  Synthetic
tccgcgtggggggatataaaa

SEQ ID NO: 2018 - DNA, 21 bp, Artificial Sequence
  Synthetic
tttaccctgaccatgcccaag

SEQ ID NO: 2019 - DNA, 21 bp, Artificial Sequence
  Synthetic
tcaatctcaaagccctttctg

SEQ ID NO: 2020 - DNA, 21 bp, Artificial Sequence
  Synthetic
aggatagataatccgttcaaa

SEQ ID NO: 2021 - DNA, 21 bp, Artificial Sequence
  Synthetic
tccgggtccaaaccgttcttg

SEQ ID NO: 2022 - DNA, 21 bp, Artificial Sequence
  Synthetic
tttaccctgtcaacccccaag

SEQ ID NO: 2023 - DNA, 21 bp, Artificial Sequence
  Synthetic
tcagtagtaaagccctttctg

SEQ ID NO: 2024 - DNA, 21 bp, Artificial Sequence
  Synthetic
aagtcatttgccccccccatg

SEQ ID NO: 2025 - DNA, 21 bp, Artificial Sequence
  Synthetic
caaaccctgtttaagaacatc

SEQ ID NO: 2026 - DNA, 21 bp, Artificial Sequence
  Synthetic
tccgcgtccaaaccgttcttg

SEQ ID NO: 2027 - DNA, 21 bp, Artificial Sequence
  Synthetic
tttaccctggccacccccaag

SEQ ID NO: 2028 - DNA, 21 bp, Artificial Sequence
  Synthetic
acggtgaaattctccgtgata

SEQ ID NO: 2029 - DNA, 21 bp, Artificial Sequence
  Synthetic
tccgcgtggggggagcacaaa

SEQ ID NO: 2030 - DNA, 21 bp, Artificial Sequence
  Synthetic
cagttgaaattctcccaccag

SEQ ID NO: 2031 - DNA, 21 bp, Artificial Sequence
  Synthetic
ggggtgttggtgccgccgagg

SEQ ID NO: 2032 - DNA, 21 bp, Artificial Sequence
  Synthetic
tatgtgtccaaaccgttcttg

SEQ ID NO: 2033 - DNA, 21 bp, Artificial Sequence
  Synthetic
ttcgtgtccaaaccgttcttg

SEQ ID NO: 2034 - DNA, 21 bp, Artificial Sequence
  Synthetic
caatcacattttgcctcagta

SEQ ID NO: 2035 - DNA, 21 bp, Artificial Sequence
  Synthetic
aatacgttgcaggtgtccaaa

SEQ ID NO: 2036 - DNA, 21 bp, Artificial Sequence
  Synthetic
tttaccctgctgacccccaag

SEQ ID NO: 2037 - DNA, 21 bp, Artificial Sequence
  Synthetic
cacggggcgcagccgttcagg

SEQ ID NO: 2038 - DNA, 21 bp, Artificial Sequence
  Synthetic
gggtccttcgtgccgccgagg

SEQ ID NO: 2039 - DNA, 21 bp, Artificial Sequence
  Synthetic
tcactgtggggcgaccataag

SEQ ID NO: 2040 - DNA, 21 bp, Artificial Sequence
  Synthetic
tttaccgcccaataccccaag

SEQ ID NO: 2041 - DNA, 21 bp, Artificial Sequence
  Synthetic
tcaccctcaaagccctttctg

SEQ ID NO: 2042 - DNA, 21 bp, Artificial Sequence
  Synthetic
tccgtgtccaaaccgttcaaa

SEQ ID NO: 2043 - DNA, 21 bp, Artificial Sequence
  Synthetic
ttcacgttgtccacgccgaaa

SEQ ID NO: 2044 - DNA, 21 bp, Artificial Sequence
  Synthetic
accatcttttttaaggacgta

SEQ ID NO: 2045 - DNA, 21 bp, Artificial Sequence
  Synthetic
tccgtgtccaaaccgttcgtg

SEQ ID NO: 2046 - DNA, 21 bp, Artificial Sequence
  Synthetic
aaaacgaatttcgtgcacata

SEQ ID NO: 2047 - DNA, 21 bp, Artificial Sequence
  Synthetic
gcggggaaattcagggatata

SEQ ID NO: 2048 - DNA, 21 bp, Artificial Sequence
  Synthetic
tccgtgaggttcatagatgtg

SEQ ID NO: 2049 - DNA, 21 bp, Artificial Sequence
  Synthetic
ttcacgttgacgataccgaaa

SEQ ID NO: 2050 - DNA, 21 bp, Artificial Sequence
  Synthetic
aacctggacaagatgtttcgc

SEQ ID NO: 2051 - DNA, 21 bp, Artificial Sequence
  Synthetic
aacacctggtttcccaacggc

SEQ ID NO: 2052 - DNA, 21 bp, Artificial Sequence
  Synthetic
tccgtgataaaaccgttcttg

SEQ ID NO: 2053 - DNA, 21 bp, Artificial Sequence
  Synthetic
tcacattcaaagccctttctg

SEQ ID NO: 2054 - DNA, 21 bp, Artificial Sequence
  Synthetic
acgttgaaattcgcgtatgtg

SEQ ID NO: 2055 - DNA, 21 bp, Artificial Sequence
  Synthetic
tttaccctgaccacctcaaag

SEQ ID NO: 2056 - DNA, 21 bp, Artificial Sequence
  Synthetic
tacgtaggcaacccctttaag

SEQ ID NO: 2057 - DNA, 21 bp, Artificial Sequence
  Synthetic
tcagtaaacaagccctttctg

SEQ ID NO: 2058 - DNA, 21 bp, Artificial Sequence
  Synthetic
ttcacgttgacgcagccgaaa

SEQ ID NO: 2059 - DNA, 21 bp, Artificial Sequence
  Synthetic
tcaaacctgcgcccctttatc

SEQ ID NO: 2060 - DNA, 21 bp, Artificial Sequence
  Synthetic
aaccatgaatggaccaagtac

SEQ ID NO: 2061 - DNA, 21 bp, Artificial Sequence
  Synthetic
acgatatccaggccgttgttg

SEQ ID NO: 2062 - DNA, 21 bp, Artificial Sequence
  Synthetic
ttggtgtccaaaccgttcttg

SEQ ID NO: 2063 - DNA, 21 bp, Artificial Sequence
  Synthetic
aatgatttgaaatatacgagg

SEQ ID NO: 2064 - DNA, 21 bp, Artificial Sequence
  Synthetic
aagaccaactttgtacatatc

SEQ ID NO: 2065 - DNA, 21 bp, Artificial Sequence
  Synthetic
tccgtgaataaaccgttcttg

SEQ ID NO: 2066 - DNA, 21 bp, Artificial Sequence
  Synthetic
ctggtaccccccgccaacatc

SEQ ID NO: 2067 - DNA, 21 bp, Artificial Sequence
  Synthetic
tcaaacccccgcccctttatc

SEQ ID NO: 2068 - DNA, 21 bp, Artificial Sequence
  Synthetic
caactggccaacccctttcaa

SEQ ID NO: 2069 - DNA, 21 bp, Artificial Sequence
  Synthetic
caactgaagtttaccaacgta

SEQ ID NO: 2070 - DNA, 21 bp, Artificial Sequence
  Synthetic
tttaccatccaaacctcaaag

SEQ ID NO: 2071 - DNA, 21 bp, Artificial Sequence
  Synthetic
tccccgtccaaaccgttcttg

SEQ ID NO: 2072 - DNA, 21 bp, Artificial Sequence
  Synthetic
tccgtgtccaaaccgttcata

SEQ ID NO: 2073 - DNA, 21 bp, Artificial Sequence
  Synthetic
tcagtatcaaagccctttgta

SEQ ID NO: 2074 - DNA, 21 bp, Artificial Sequence
  Synthetic
tccgtgtccaaaccgttctcc

SEQ ID NO: 2075 - DNA, 21 bp, Artificial Sequence
  Synthetic
gatttgttctccgataaaagg

SEQ ID NO: 2076 - DNA, 21 bp, Artificial Sequence
  Synthetic
tccgtggcgaaaccgttcttg

SEQ ID NO: 2077 - DNA, 21 bp, Artificial Sequence
  Synthetic
accctgaagtttgcctacgta

SEQ ID NO: 2078 - DNA, 21 bp, Artificial Sequence
  Synthetic
acgaaacagttccagaatgtg

SEQ ID NO: 2079 - DNA, 21 bp, Artificial Sequence
  Synthetic
ttggtgccgccgaataatgag

SEQ ID NO: 2080 - DNA, 21 bp, Artificial Sequence
  Synthetic
tcagtactgaagccctttctg

SEQ ID NO: 2081 - DNA, 21 bp, Artificial Sequence
  Synthetic
tccaatgtgaggccgttcata

SEQ ID NO: 2082 - DNA, 21 bp, Artificial Sequence
  Synthetic
accatcacctttaagcatgta

SEQ ID NO: 2083 - DNA, 21 bp, Artificial Sequence
  Synthetic
accatcggctcactgtttaag

SEQ ID NO: 2084 - DNA, 21 bp, Artificial Sequence
  Synthetic
tccatgtccaaaccgttcttg

SEQ ID NO: 2085 - DNA, 21 bp, Artificial Sequence
  Synthetic
tccgtggagaaaccgttcttg

SEQ ID NO: 2086 - DNA, 21 bp, Artificial Sequence
  Synthetic
ccgcagtccaatatgtcctgg

SEQ ID NO: 2087 - DNA, 21 bp, Artificial Sequence
  Synthetic
tcagtatcactgccctttctg

SEQ ID NO: 2088 - DNA, 21 bp, Artificial Sequence
  Synthetic
accatctcacgccccctgctg

SEQ ID NO: 2089 - DNA, 21 bp, Artificial Sequence
  Synthetic
tccgtgacgaaaccgttcttg

SEQ ID NO: 2090 - DNA, 21 bp, Artificial Sequence
  Synthetic
tccgtgtccaaaccgttcacg

SEQ ID NO: 2091 - DNA, 21 bp, Artificial Sequence
  Synthetic
tcacgcgaccgcccctttatc

SEQ ID NO: 2092 - DNA, 21 bp, Artificial Sequence
  Synthetic
tcaaactcacgcccctttatc

SEQ ID NO: 2093 - DNA, 21 bp, Artificial Sequence
  Synthetic
tcatcagaccgcccctggatc

SEQ ID NO: 2094 - DNA, 21 bp, Artificial Sequence
  Synthetic
acggtgatggcgccgttcaaa

SEQ ID NO: 2095 - DNA, 21 bp, Artificial Sequence
  Synthetic
cccgaaatcgcccgcgtatac

SEQ ID NO: 2096 - DNA, 21 bp, Artificial Sequence
  Synthetic
ttttcactgaccacccccaag

SEQ ID NO: 2097 - DNA, 21 bp, Artificial Sequence
  Synthetic
ccctcaatcgcccgcgtatac

SEQ ID NO: 2098 - DNA, 21 bp, Artificial Sequence
  Synthetic
tccgtggggaaaccgttcttg

SEQ ID NO: 2099 - DNA, 21 bp, Artificial Sequence
  Synthetic
tccaattccaggccgttcata

SEQ ID NO: 2100 - DNA, 21 bp, Artificial Sequence
  Synthetic
tccgtgtgggcgttgaatggg

SEQ ID NO: 2101 - DNA, 21 bp, Artificial Sequence
  Synthetic
tacgtatcaaagccctttctg

SEQ ID NO: 2102 - DNA, 21 bp, Artificial Sequence
  Synthetic
aggccgtccaatgtgtcctgg

SEQ ID NO: 2103 - DNA, 21 bp, Artificial Sequence
  Synthetic
tccgtgcacaaaccgttcttg

SEQ ID NO: 2104 - DNA, 21 bp, Artificial Sequence
  Synthetic
acgataaggttcaaagatgtg

SEQ ID NO: 2105 - DNA, 21 bp, Artificial Sequence
  Synthetic
tcaatcgaccgcccctttatc

SEQ ID NO: 2106 - DNA, 21 bp, Artificial Sequence
  Synthetic
aaatccttcgcgccgccgatg

SEQ ID NO: 2107 - DNA, 21 bp, Artificial Sequence
  Synthetic
accggcacctcaccctttaag

SEQ ID NO: 2108 - DNA, 21 bp, Artificial Sequence
  Synthetic
cagtccaatttcgggaaattc

SEQ ID NO: 2109 - DNA, 21 bp, Artificial Sequence
  Synthetic
ttcacgttgacgacgtccaaa

SEQ ID NO: 2110 - DNA, 21 bp, Artificial Sequence
  Synthetic
tcaaacacccgcccctttatc

SEQ ID NO: 2111 - DNA, 21 bp, Artificial Sequence
  Synthetic
gcgacgaaattcgcgttggtg

SEQ ID NO: 2112 - DNA, 21 bp, Artificial Sequence
  Synthetic
tccgtggataaaccgttcttg

SEQ ID NO: 2113 - DNA, 21 bp, Artificial Sequence
  Synthetic
ttcacgttgcacacgccgaaa

SEQ ID NO: 2114 - DNA, 21 bp, Artificial Sequence
  Synthetic
ttcacgttgacgacgccgtat

SEQ ID NO: 2115 - DNA, 21 bp, Artificial Sequence
  Synthetic
tccgtgtccaaaccgttcatg

SEQ ID NO: 2116 - DNA, 21 bp, Artificial Sequence
  Synthetic
caagtatcaaagccctttctg

SEQ ID NO: 2117 - DNA, 21 bp, Artificial Sequence
  Synthetic
acgagggatttgccgttcaaa

SEQ ID NO: 2118 - DNA, 21 bp, Artificial Sequence
  Synthetic
gataaaaaagggtgggtggcg

SEQ ID NO: 2119 - DNA, 21 bp, Artificial Sequence
  Synthetic
gacccccgcggctggaccccc

SEQ ID NO: 2120 - DNA, 21 bp, Artificial Sequence
  Synthetic
tcagtaggcaagccctttctg

SEQ ID NO: 2121 - DNA, 21 bp, Artificial Sequence
  Synthetic
aacgccttttcacccaagctg

SEQ ID NO: 2122 - DNA, 21 bp, Artificial Sequence
  Synthetic
tccgcgtggggggataataaa

SEQ ID NO: 2123 - DNA, 21 bp, Artificial Sequence
  Synthetic
tcactgtcaaagcccttttca

SEQ ID NO: 2124 - DNA, 21 bp, Artificial Sequence
  Synthetic
gaggggaggttgttggggaaa

SEQ ID NO: 2125 - DNA, 21 bp, Artificial Sequence
  Synthetic
tccaaaacggggtggatggcg

SEQ ID NO: 2126 - DNA, 21 bp, Artificial Sequence
  Synthetic
tcagtatcaaagccctttatg

SEQ ID NO: 2127 - DNA, 21 bp, Artificial Sequence
  Synthetic
aacaactttaccccccccaag

SEQ ID NO: 2128 - DNA, 21 bp, Artificial Sequence
  Synthetic
aatatgttctccgcgaatttg

SEQ ID NO: 2129 - DNA, 21 bp, Artificial Sequence
  Synthetic
ggcgtatcaaagccctttctg

SEQ ID NO: 2130 - DNA, 21 bp, Artificial Sequence
  Synthetic
ttcacgatacagacgtccaaa

SEQ ID NO: 2131 - DNA, 21 bp, Artificial Sequence
  Synthetic
tcagcctcaaagccctttctg

SEQ ID NO: 2132 - DNA, 21 bp, Artificial Sequence
  Synthetic
catgacctgaagctgtttaag

SEQ ID NO: 2133 - DNA, 21 bp, Artificial Sequence
  Synthetic
tccgtggtgaaaccgttcttg

SEQ ID NO: 2134 - DNA, 21 bp, Artificial Sequence
  Synthetic
tcaccctggggcgaccataag

SEQ ID NO: 2135 - DNA, 21 bp, Artificial Sequence
  Synthetic
gacatggaacgcccctttaag

SEQ ID NO: 2136 - DNA, 21 bp, Artificial Sequence
  Synthetic
tcagcctggggcgaccataag

SEQ ID NO: 2137 - DNA, 21 bp, Artificial Sequence
  Synthetic
atgacgatggcgacgtccagg

SEQ ID NO: 2138 - DNA, 21 bp, Artificial Sequence
  Synthetic
ccggatatagcgaggtattat

SEQ ID NO: 2139 - DNA, 21 bp, Artificial Sequence
  Synthetic
tccgcgtggggggatatgaaa

SEQ ID NO: 2140 - DNA, 21 bp, Artificial Sequence
  Synthetic
ttcacgttgacgacgccgagg

SEQ ID NO: 2141 - DNA, 21 bp, Artificial Sequence
  Synthetic
acgataacgttcaaaaatgtg

SEQ ID NO: 2142 - DNA, 21 bp, Artificial Sequence
  Synthetic
accatccgctttaaggacgta

SEQ ID NO: 2143 - DNA, 21 bp, Artificial Sequence
  Synthetic
gggtatacgatgccgttctcc

SEQ ID NO: 2144 - DNA, 21 bp, Artificial Sequence
  Synthetic
tccttgacgacgccgttcaaa

SEQ ID NO: 2145 - DNA, 21 bp, Artificial Sequence
  Synthetic
tccgtgtccaaagtgttcttg

SEQ ID NO: 2146 - DNA, 21 bp, Artificial Sequence
  Synthetic
ttcacggcgcagtatccgaaa

SEQ ID NO: 2147 - DNA, 21 bp, Artificial Sequence
  Synthetic
aaacagaatatggcgcacata

SEQ ID NO: 2148 - DNA, 21 bp, Artificial Sequence
  Synthetic
gaaggccgcctgctgggcaag

SEQ ID NO: 2149 - DNA, 21 bp, Artificial Sequence
  Synthetic
ttcacgttgacgtatccgaaa

SEQ ID NO: 2150 - DNA, 21 bp, Artificial Sequence
  Synthetic
ctggtatcaaagccctttctg

SEQ ID NO: 2151 - DNA, 21 bp, Artificial Sequence
  Synthetic
ccgaatatagcgagggtgtat

SEQ ID NO: 2152 - DNA, 21 bp, Artificial Sequence
  Synthetic
cgcatcgacaacccctttaag

SEQ ID NO: 2153 - DNA, 21 bp, Artificial Sequence
  Synthetic
atggtatcaaagccctttctg

SEQ ID NO: 2154 - DNA, 21 bp, Artificial Sequence
  Synthetic
aaaataacgttcaaagatgtg

SEQ ID NO: 2155 - DNA, 21 bp, Artificial Sequence
  Synthetic
tccgcgtggggggatttgaaa

SEQ ID NO: 2156 - DNA, 21 bp, Artificial Sequence
  Synthetic
ggggtgtccaaaccgttcttg

SEQ ID NO: 2157 - DNA, 21 bp, Artificial Sequence
  Synthetic
tggtccttgaattccgcgaaa

SEQ ID NO: 2158 - DNA, 21 bp, Artificial Sequence
  Synthetic
tccaatgcgaggccgttcata

SEQ ID NO: 2159 - DNA, 21 bp, Artificial Sequence
  Synthetic
tcagccgaccgcccctttatc

SEQ ID NO: 2160 - DNA, 21 bp, Artificial Sequence
  Synthetic
tcagtacataagccctttctg

SEQ ID NO: 2161 - DNA, 21 bp, Artificial Sequence
  Synthetic
tccgtgttgaaaccgttcttg

SEQ ID NO: 2162 - DNA, 21 bp, Artificial Sequence
  Synthetic
acgaaaacgttcaaagatgtg

SEQ ID NO: 2163 - DNA, 21 bp, Artificial Sequence
  Synthetic
tccaatacgaggccgttcata

SEQ ID NO: 2164 - DNA, 21 bp, Artificial Sequence
  Synthetic
aatacgacgtccacgtccaaa

SEQ ID NO: 2165 - DNA, 21 bp, Artificial Sequence
  Synthetic
tgggacctgaagggccccaag

SEQ ID NO: 2166 - DNA, 21 bp, Artificial Sequence
  Synthetic
atgatggccaagccctttctg

SEQ ID NO: 2167 - DNA, 21 bp, Artificial Sequence
  Synthetic
tcagtatcaaagccctttatc

SEQ ID NO: 2168 - DNA, 21 bp, Artificial Sequence
  Synthetic
tccaatccgaggccgttcata

SEQ ID NO: 2169 - DNA, 21 bp, Artificial Sequence
  Synthetic
tccgtgccgaaaccgttcttg

SEQ ID NO: 2170 - DNA, 21 bp, Artificial Sequence
  Synthetic
acgataaaattcaaagatgtg

SEQ ID NO: 2171 - DNA, 21 bp, Artificial Sequence
  Synthetic
ccggcgatagcgagggtgtat

SEQ ID NO: 2172 - DNA, 21 bp, Artificial Sequence
  Synthetic
cagacgaaattcaattccgtg

SEQ ID NO: 2173 - DNA, 21 bp, Artificial Sequence
  Synthetic
ccgatgatagcgacgcagttc

SEQ ID NO: 2174 - DNA, 21 bp, Artificial Sequence
  Synthetic
tggataacgttcaaagatgtg

SEQ ID NO: 2175 - DNA, 21 bp, Artificial Sequence
  Synthetic
gtaggcatcgccctgggccgc

SEQ ID NO: 2176 - DNA, 21 bp, Artificial Sequence
  Synthetic
cccgccatcgcccgcgtatac

SEQ ID NO: 2177 - DNA, 21 bp, Artificial Sequence
  Synthetic
aataatttcacgccgccgaaa

SEQ ID NO: 2178 - DNA, 21 bp, Artificial Sequence
  Synthetic
tccagggataggccgttcata

SEQ ID NO: 2179 - DNA, 21 bp, Artificial Sequence
  Synthetic
tttaccctgcaaacccccaag

SEQ ID NO: 2180 - DNA, 21 bp, Artificial Sequence
  Synthetic
tcacaagaccgcccctttatc

SEQ ID NO: 2181 - DNA, 21 bp, Artificial Sequence
  Synthetic
tccgtgtccaaaccgttcaat

SEQ ID NO: 2182 - DNA, 21 bp, Artificial Sequence
  Synthetic
tcaaaccaacgcccctttatc

SEQ ID NO: 2183 - DNA, 21 bp, Artificial Sequence
  Synthetic
tccgtgtccaggccgttcttg

SEQ ID NO: 2184 - DNA, 21 bp, Artificial Sequence
  Synthetic
atgtcactgcgcacctcaatc

SEQ ID NO: 2185 - DNA, 21 bp, Artificial Sequence
  Synthetic
caaatcacctttaaggacgta

SEQ ID NO: 2186 - DNA, 21 bp, Artificial Sequence
  Synthetic
cccgacatcgcccgcgtatac

SEQ ID NO: 2187 - DNA, 21 bp, Artificial Sequence
  Synthetic
cccgacatcgcccgcgcctac

SEQ ID NO: 2188 - DNA, 21 bp, Artificial Sequence
  Synthetic
atggtagaatttcataaggta

SEQ ID NO: 2189 - DNA, 21 bp, Artificial Sequence
  Synthetic
tcaaacatccgcccctttatc

SEQ ID NO: 2190 - DNA, 21 bp, Artificial Sequence
  Synthetic
tcaatggaccgcccctttatc

SEQ ID NO: 2191 - DNA, 21 bp, Artificial Sequence
  Synthetic
gaaggccgcgcctttggcacc

SEQ ID NO: 2192 - DNA, 21 bp, Artificial Sequence
  Synthetic
acgtccttgtccacgtccagg

SEQ ID NO: 2193 - DNA, 21 bp, Artificial Sequence
  Synthetic
aataatacgcagatattcagg

SEQ ID NO: 2194 - DNA, 21 bp, Artificial Sequence
  Synthetic
tccaatcagaggccgttcata

SEQ ID NO: 2195 - DNA, 21 bp, Artificial Sequence
  Synthetic
aagcaaaacatggcccatatc

SEQ ID NO: 2196 - DNA, 21 bp, Artificial Sequence
  Synthetic
cccgacatcgcccgcatgtac

SEQ ID NO: 2197 - DNA, 21 bp, Artificial Sequence
  Synthetic
accatcaagtttaaggacgta

SEQ ID NO: 2198 - DNA, 21 bp, Artificial Sequence
  Synthetic
tcaaaccatcgcccctttatc

SEQ ID NO: 2199 - DNA, 21 bp, Artificial Sequence
  Synthetic
ttcacgataacgacgccgaaa

SEQ ID NO: 2200 - DNA, 21 bp, Artificial Sequence
  Synthetic
ccgataatagcgagggtgtat

SEQ ID NO: 2201 - DNA, 21 bp, Artificial Sequence
  Synthetic
tccacgtccaaaccgttcttg

SEQ ID NO: 2202 - DNA, 21 bp, Artificial Sequence
  Synthetic
catggcgcccaaccctttcgc

SEQ ID NO: 2203 - DNA, 21 bp, Artificial Sequence
  Synthetic
ttcacgttcacgacgccgaaa

SEQ ID NO: 2204 - DNA, 21 bp, Artificial Sequence
  Synthetic
tccgagacgcacttgttcagg

SEQ ID NO: 2205 - DNA, 21 bp, Artificial Sequence
  Synthetic
ttcacgttgataacgccgaaa

SEQ ID NO: 2206 - DNA, 21 bp, Artificial Sequence
  Synthetic
ccggatatagcgaggttgtat

SEQ ID NO: 2207 - DNA, 21 bp, Artificial Sequence
  Synthetic
tccaaagataggccgttcata

SEQ ID NO: 2208 - DNA, 21 bp, Artificial Sequence
  Synthetic
atacaggggaggttcaatgtg

SEQ ID NO: 2209 - DNA, 21 bp, Artificial Sequence
  Synthetic
tccacgacgttcaaagatata

SEQ ID NO: 2210 - DNA, 21 bp, Artificial Sequence
  Synthetic
tccttggatttcaaaaatata

SEQ ID NO: 2211 - DNA, 21 bp, Artificial Sequence
  Synthetic
ctgcgcaacatgccctttcat

SEQ ID NO: 2212 - DNA, 21 bp, Artificial Sequence
  Synthetic
catatcacctttaaggacgta

SEQ ID NO: 2213 - DNA, 21 bp, Artificial Sequence
  Synthetic
acgatattgttcaaagatgtg

SEQ ID NO: 2214 - DNA, 21 bp, Artificial Sequence
  Synthetic
ataacgatggagacgtccagg

SEQ ID NO: 2215 - DNA, 21 bp, Artificial Sequence
  Synthetic
tcagtatacaagccctttctg

SEQ ID NO: 2216 - DNA, 21 bp, Artificial Sequence
  Synthetic
tcacccgaccgcccctttatc

SEQ ID NO: 2217 - DNA, 21 bp, Artificial Sequence
  Synthetic
tcagtacccaagccctttctg

SEQ ID NO: 2218 - DNA, 21 bp, Artificial Sequence
  Synthetic
accatgaagtttgccgacatc

SEQ ID NO: 2219 - DNA, 21 bp, Artificial Sequence
  Synthetic
aaggacaagtttaaggacatc

SEQ ID NO: 2220 - DNA, 21 bp, Artificial Sequence
  Synthetic
tacgaaacccaatactttaag

SEQ ID NO: 2221 - DNA, 21 bp, Artificial Sequence
  Synthetic
cacataacgttcaaagatgtg

SEQ ID NO: 2222 - DNA, 21 bp, Artificial Sequence
  Synthetic
tttacccaaaccacccccaag

SEQ ID NO: 2223 - DNA, 21 bp, Artificial Sequence
  Synthetic
tcagcctcatcaatctttaag

SEQ ID NO: 2224 - DNA, 21 bp, Artificial Sequence
  Synthetic
cccatgatcgccacccaattt

SEQ ID NO: 2225 - DNA, 21 bp, Artificial Sequence
  Synthetic
cgcatcacctttaaggacgta

SEQ ID NO: 2226 - DNA, 21 bp, Artificial Sequence
  Synthetic
ccggatatagcgaggcactat

SEQ ID NO: 2227 - DNA, 21 bp, Artificial Sequence
  Synthetic
acggtgttcgggacgaggacg

SEQ ID NO: 2228 - DNA, 21 bp, Artificial Sequence
  Synthetic
cacgtgtccaaaccgttcttg

SEQ ID NO: 2229 - DNA, 21 bp, Artificial Sequence
  Synthetic
acctcactgtcaacctcacgc

SEQ ID NO: 2230 - DNA, 21 bp, Artificial Sequence
  Synthetic
tcaaacgaacgcccctttatc

SEQ ID NO: 2231 - DNA, 21 bp, Artificial Sequence
  Synthetic
aatgcgttctccccgaaattg

SEQ ID NO: 2232 - DNA, 21 bp, Artificial Sequence
  Synthetic
tccgtgtccaaaccgttccag

SEQ ID NO: 2233 - DNA, 21 bp, Artificial Sequence
  Synthetic
tcagtatggggcgaccataag

SEQ ID NO: 2234 - DNA, 21 bp, Artificial Sequence
  Synthetic
tcaatcgcccgcccctttgta

SEQ ID NO: 2235 - DNA, 21 bp, Artificial Sequence
  Synthetic
acctcaatgaagccctttctg

SEQ ID NO: 2236 - DNA, 21 bp, Artificial Sequence
  Synthetic
accgtagccaacccctttcat

SEQ ID NO: 2237 - DNA, 21 bp, Artificial Sequence
  Synthetic
tcaaacgtacgcccctttatc

SEQ ID NO: 2238 - DNA, 21 bp, Artificial Sequence
  Synthetic
tcatcatcaaagccctttctg

SEQ ID NO: 2239 - DNA, 21 bp, Artificial Sequence
  Synthetic
tttgtatcaaagccctttctg

SEQ ID NO: 2240 - DNA, 21 bp, Artificial Sequence
  Synthetic
tcagtatcaaagccctttacc

SEQ ID NO: 2241 - DNA, 21 bp, Artificial Sequence
  Synthetic
aaggccgcctttgaccatatc

SEQ ID NO: 2242 - DNA, 21 bp, Artificial Sequence
  Synthetic
tccatggataggccgttcata

SEQ ID NO: 2243 - DNA, 21 bp, Artificial Sequence
  Synthetic
ccgcagatagcgagggtgtat

SEQ ID NO: 2244 - DNA, 21 bp, Artificial Sequence
  Synthetic
atgtccttgaggacgtccata

SEQ ID NO: 2245 - DNA, 21 bp, Artificial Sequence
  Synthetic
ttcacgttggcgacgccgaaa

SEQ ID NO: 2246 - DNA, 21 bp, Artificial Sequence
  Synthetic
ccgtccatagcgagggtgtat

SEQ ID NO: 2247 - DNA, 21 bp, Artificial Sequence
  Synthetic
aatacggtgtccacgtccagg

SEQ ID NO: 2248 - DNA, 21 bp, Artificial Sequence
  Synthetic
cacgatttgaaattgttcaaa

SEQ ID NO: 2249 - DNA, 21 bp, Artificial Sequence
  Synthetic
accatcacctttaagtcagta

SEQ ID NO: 2250 - DNA, 21 bp, Artificial Sequence
  Synthetic
atcgtatcaaagccctttctg

SEQ ID NO: 2251 - DNA, 21 bp, Artificial Sequence
  Synthetic
aacaccacctcaacctcaaag

SEQ ID NO: 2252 - DNA, 21 bp, Artificial Sequence
  Synthetic
tcagtatcaaagcccttttac

SEQ ID NO: 2253 - DNA, 21 bp, Artificial Sequence
  Synthetic
ttcacgttgaaaacgccgaaa

SEQ ID NO: 2254 - DNA, 21 bp, Artificial Sequence
  Synthetic
aatttcacgacggtgttccac

SEQ ID NO: 2255 - DNA, 21 bp, Artificial Sequence
  Synthetic
ttcacggtgacgacgccgaaa

SEQ ID NO: 2256 - DNA, 21 bp, Artificial Sequence
  Synthetic
tccaatgataggccgttcaaa

SEQ ID NO: 2257 - DNA, 21 bp, Artificial Sequence
  Synthetic
gtaggcgtagccctgggcatg

SEQ ID NO: 2258 - DNA, 21 bp, Artificial Sequence
  Synthetic
ttcacgttgacgtccccgaaa

SEQ ID NO: 2259 - DNA, 21 bp, Artificial Sequence
  Synthetic
atgaccatggccacctcacgc

SEQ ID NO: 2260 - DNA, 21 bp, Artificial Sequence
  Synthetic
tcaggctcaaagccctttctg

SEQ ID NO: 2261 - DNA, 21 bp, Artificial Sequence
  Synthetic
aacaccgtatcaacctcacgc

SEQ ID NO: 2262 - DNA, 21 bp, Artificial Sequence
  Synthetic
acgatgaaattcgcggatata

SEQ ID NO: 2263 - DNA, 21 bp, Artificial Sequence
  Synthetic
tatgtggggaatccgttcaaa

SEQ ID NO: 2264 - DNA, 21 bp, Artificial Sequence
  Synthetic
tcaaacgcccgcccctttatc

SEQ ID NO: 2265 - DNA, 21 bp, Artificial Sequence
  Synthetic
tccaataataggccgttcata

SEQ ID NO: 2266 - DNA, 21 bp, Artificial Sequence
  Synthetic
ataggggtgaggttggggacg

SEQ ID NO: 2267 - DNA, 21 bp, Artificial Sequence
  Synthetic
aattccttgcacgcgtccaaa

SEQ ID NO: 2268 - DNA, 21 bp, Artificial Sequence
  Synthetic
ggggtgacgcacgtgttcaaa

SEQ ID NO: 2269 - DNA, 21 bp, Artificial Sequence
  Synthetic
acgaggacgttcaaagatgtg

SEQ ID NO: 2270 - DNA, 21 bp, Artificial Sequence
  Synthetic
tcagtatcaaagccctttcaa

SEQ ID NO: 2271 - DNA, 21 bp, Artificial Sequence
  Synthetic
acggatatgaaatatttgtat

SEQ ID NO: 2272 - DNA, 21 bp, Artificial Sequence
  Synthetic
gtagtatcaaagccctttctg

SEQ ID NO: 2273 - DNA, 21 bp, Artificial Sequence
  Synthetic
accaagcaatttcaaaacgta

SEQ ID NO: 2274 - DNA, 21 bp, Artificial Sequence
  Synthetic
tcactgtcaaagccctttctg

SEQ ID NO: 2275 - DNA, 21 bp, Artificial Sequence
  Synthetic
acgataacgttcaaatatgtg

SEQ ID NO: 2276 - DNA, 21 bp, Artificial Sequence
  Synthetic
tcagtagaccgcccctttatc

SEQ ID NO: 2277 - DNA, 21 bp, Artificial Sequence
  Synthetic
tttaccctgatgacccccaag

SEQ ID NO: 2278 - DNA, 21 bp, Artificial Sequence
  Synthetic
gtgggggtgcagttcgggaaa

SEQ ID NO: 2279 - DNA, 21 bp, Artificial Sequence
  Synthetic
tttaccaccaccacccccaag

SEQ ID NO: 2280 - DNA, 21 bp, Artificial Sequence
  Synthetic
aaaacgcagttcaaagatgtg

SEQ ID NO: 2281 - DNA, 21 bp, Artificial Sequence
  Synthetic
tggatcacctttaaggacgta

SEQ ID NO: 2282 - DNA, 21 bp, Artificial Sequence
  Synthetic
atgggcctgtcacccccccgc

SEQ ID NO: 2283 - DNA, 21 bp, Artificial Sequence
  Synthetic
tccaatataaggccgttcata

SEQ ID NO: 2284 - DNA, 21 bp, Artificial Sequence
  Synthetic
tcaaactcaaagccctttctg

SEQ ID NO: 2285 - DNA, 21 bp, Artificial Sequence
  Synthetic
ccggagatagcgagggtgtat

SEQ ID NO: 2286 - DNA, 21 bp, Artificial Sequence
  Synthetic
accgtatcaaagccctttctg

SEQ ID NO: 2287 - DNA, 21 bp, Artificial Sequence
  Synthetic
aataatatgcacacgtccagg

SEQ ID NO: 2288 - DNA, 21 bp, Artificial Sequence
  Synthetic
ttggggagggcgttggggaat

SEQ ID NO: 2289 - DNA, 21 bp, Artificial Sequence
  Synthetic
tccttggataggccgttcata

SEQ ID NO: 2290 - DNA, 21 bp, Artificial Sequence
  Synthetic
gggatgaggtccttcacggtg

SEQ ID NO: 2291 - DNA, 21 bp, Artificial Sequence
  Synthetic
tcagaaacccatctgtttcgc

SEQ ID NO: 2292 - DNA, 21 bp, Artificial Sequence
  Synthetic
tcagtatcaaagccctttcat

SEQ ID NO: 2293 - DNA, 21 bp, Artificial Sequence
  Synthetic
cagacgaggttggcgtccgtg

SEQ ID NO: 2294 - DNA, 21 bp, Artificial Sequence
  Synthetic
cgcatctttaccgaacccccc

SEQ ID NO: 2295 - DNA, 21 bp, Artificial Sequence
  Synthetic
tcagtaaccaagccctttctg

SEQ ID NO: 2296 - DNA, 21 bp, Artificial Sequence
  Synthetic
tcaatcaacaagccctttgta

SEQ ID NO: 2297 - DNA, 21 bp, Artificial Sequence
  Synthetic
cgccccatgaacgcctcacat

SEQ ID NO: 2298 - DNA, 21 bp, Artificial Sequence
  Synthetic
tccgcggataggccgttcata

SEQ ID NO: 2299 - DNA, 21 bp, Artificial Sequence
  Synthetic
gtggagttcacgccgccgaaa

SEQ ID NO: 2300 - DNA, 21 bp, Artificial Sequence
  Synthetic
tttaccctgaccaccggcaag

SEQ ID NO: 2301 - DNA, 21 bp, Artificial Sequence
  Synthetic
ccccaatcaaacatgtcatgg

SEQ ID NO: 2302 - DNA, 21 bp, Artificial Sequence
  Synthetic
ctgaccctgacctcatcaaag

SEQ ID NO: 2303 - DNA, 21 bp, Artificial Sequence
  Synthetic
gtgggggtggcgttggggatg

SEQ ID NO: 2304 - DNA, 21 bp, Artificial Sequence
  Synthetic
accaagacctttaaggacgta

SEQ ID NO: 2305 - DNA, 21 bp, Artificial Sequence
  Synthetic
tcagtatcaaagccctttttt

SEQ ID NO: 2306 - DNA, 21 bp, Artificial Sequence
  Synthetic
tccaataaattcgagaatgtg

SEQ ID NO: 2307 - DNA, 21 bp, Artificial Sequence
  Synthetic
tcattttcaaagccctttctg

SEQ ID NO: 2308 - DNA, 21 bp, Artificial Sequence
  Synthetic
accgacctgggctacgcccgc

SEQ ID NO: 2309 - DNA, 21 bp, Artificial Sequence
  Synthetic
acgttcacgttcaaagatgtg

SEQ ID NO: 2310 - DNA, 21 bp, Artificial Sequence
  Synthetic
acgtccatgtccgtgtccagg

SEQ ID NO: 2311 - DNA, 21 bp, Artificial Sequence
  Synthetic
ttcacgttggatacgccgaaa

SEQ ID NO: 2312 - DNA, 21 bp, Artificial Sequence
  Synthetic
caactgaagttttcacatcaa

SEQ ID NO: 2313 - DNA, 21 bp, Artificial Sequence
  Synthetic
ttcacgttgacgacggcgaaa

SEQ ID NO: 2314 - DNA, 21 bp, Artificial Sequence
  Synthetic
accatccaatcaccctggaag

SEQ ID NO: 2315 - DNA, 21 bp, Artificial Sequence
  Synthetic
ccggatatagcgaggatatat

SEQ ID NO: 2316 - DNA, 21 bp, Artificial Sequence
  Synthetic
acggatacgaggccgttcata

SEQ ID NO: 2317 - DNA, 21 bp, Artificial Sequence
  Synthetic
tcagccaacaagccctttacc

SEQ ID NO: 2318 - DNA, 21 bp, Artificial Sequence
  Synthetic
aacaacacccaaatctttcgc

SEQ ID NO: 2319 - DNA, 21 bp, Artificial Sequence
  Synthetic
tcagtatcaatgccctttctg

SEQ ID NO: 2320 - DNA, 21 bp, Artificial Sequence
  Synthetic
ataacgatgtccacgtccata

SEQ ID NO: 2321 - DNA, 21 bp, Artificial Sequence
  Synthetic
tccgcgcagtatccgataagg

SEQ ID NO: 2322 - DNA, 21 bp, Artificial Sequence
  Synthetic
accaacgaccgcccctttatc

SEQ ID NO: 2323 - DNA, 21 bp, Artificial Sequence
  Synthetic
gggtcctggataccgccggag

SEQ ID NO: 2324 - DNA, 21 bp, Artificial Sequence
  Synthetic
ggctcatttgtacccccccgc

SEQ ID NO: 2325 - DNA, 21 bp, Artificial Sequence
  Synthetic
ccgaggatagcggattcctat

SEQ ID NO: 2326 - DNA, 21 bp, Artificial Sequence
  Synthetic
tccgtgtccaaaccgttctgg

SEQ ID NO: 2327 - DNA, 21 bp, Artificial Sequence
  Synthetic
ggcctggacaacatctttaag

SEQ ID NO: 2328 - DNA, 21 bp, Artificial Sequence
  Synthetic
tccgcgtggggggatttcaaa

SEQ ID NO: 2329 - DNA, 21 bp, Artificial Sequence
  Synthetic
tcagtatcaaagccctttaac

SEQ ID NO: 2330 - DNA, 21 bp, Artificial Sequence
  Synthetic
tttaccctgaccgaacccaag

SEQ ID NO: 2331 - DNA, 21 bp, Artificial Sequence
  Synthetic
accgacacccgcccctttatc

SEQ ID NO: 2332 - DNA, 21 bp, Artificial Sequence
  Synthetic
gtaggcgtacaatttggcaag

SEQ ID NO: 2333 - DNA, 21 bp, Artificial Sequence
  Synthetic
catgtatcaaagccctttctg

SEQ ID NO: 2334 - DNA, 21 bp, Artificial Sequence
  Synthetic
aatataataaggccgttcgcg

SEQ ID NO: 2335 - DNA, 21 bp, Artificial Sequence
  Synthetic
tcaaccgaccgcccctttatc

SEQ ID NO: 2336 - DNA, 21 bp, Artificial Sequence
  Synthetic
accgtaaagttttcagtaatc

SEQ ID NO: 2337 - DNA, 21 bp, Artificial Sequence
  Synthetic
accatcgtatttaaggacgta

SEQ ID NO: 2338 - DNA, 21 bp, Artificial Sequence
  Synthetic
gtagaatttaccccccccaag

SEQ ID NO: 2339 - DNA, 21 bp, Artificial Sequence
  Synthetic
gataataaaaatttgttcagg

SEQ ID NO: 2340 - DNA, 21 bp, Artificial Sequence
  Synthetic
tcacatgaccgcccctttatc

SEQ ID NO: 2341 - DNA, 21 bp, Artificial Sequence
  Synthetic
gtagccgtatttaagaacgta

SEQ ID NO: 2342 - DNA, 21 bp, Artificial Sequence
  Synthetic
tcactgaagtcagtattttca

SEQ ID NO: 2343 - DNA, 21 bp, Artificial Sequence
  Synthetic
caaaagcaatttatgaaccaa

SEQ ID NO: 2344 - DNA, 21 bp, Artificial Sequence
  Synthetic
acgccgtggcacccgcacggg

SEQ ID NO: 2345 - DNA, 21 bp, Artificial Sequence
  Synthetic
tccgtgttcaaaccgttcttg

SEQ ID NO: 2346 - DNA, 21 bp, Artificial Sequence
  Synthetic
tccgagtccaaaccgttcttg

SEQ ID NO: 2347 - DNA, 21 bp, Artificial Sequence
  Synthetic
tcaatgtcaaagccctttctg

SEQ ID NO: 2348 - DNA, 21 bp, Artificial Sequence
  Synthetic
gggtccacggggtggatagcg

SEQ ID NO: 2349 - DNA, 21 bp, Artificial Sequence
  Synthetic
tcactgaccaccccctttaag

SEQ ID NO: 2350 - DNA, 21 bp, Artificial Sequence
  Synthetic
gatatggagaggccgttcaaa

SEQ ID NO: 2351 - DNA, 21 bp, Artificial Sequence
  Synthetic
tcaaccaagtttcatgaagta

SEQ ID NO: 2352 - DNA, 21 bp, Artificial Sequence
  Synthetic
ccgaatttctccccgccgaaa

SEQ ID NO: 2353 - DNA, 21 bp, Artificial Sequence
  Synthetic
tggacgttgacgacgccgaaa

SEQ ID NO: 2354 - DNA, 21 bp, Artificial Sequence
  Synthetic
tcatcagaccgcccctttatc

SEQ ID NO: 2355 - DNA, 21 bp, Artificial Sequence
  Synthetic
tccataacgttcaaagatgtg

SEQ ID NO: 2356 - DNA, 21 bp, Artificial Sequence
  Synthetic
tcaaacaaccgcccctttatc

SEQ ID NO: 2357 - DNA, 21 bp, Artificial Sequence
  Synthetic
tcagcctggggcgaccatatg

SEQ ID NO: 2358 - DNA, 21 bp, Artificial Sequence
  Synthetic
atgatgaaatccatgtatccg

SEQ ID NO: 2359 - DNA, 21 bp, Artificial Sequence
  Synthetic
acctacacctttaaggacgta

SEQ ID NO: 2360 - DNA, 21 bp, Artificial Sequence
  Synthetic
tcccaggataggccgttcata

SEQ ID NO: 2361 - DNA, 21 bp, Artificial Sequence
  Synthetic
ggctcatggatcccccccgaa

SEQ ID NO: 2362 - DNA, 21 bp, Artificial Sequence
  Synthetic
tcaacccaatcaatgtttaag

SEQ ID NO: 2363 - DNA, 21 bp, Artificial Sequence
  Synthetic
accatcacctttaagaacgta

SEQ ID NO: 2364 - DNA, 21 bp, Artificial Sequence
  Synthetic
tccacgaaattccacgaggtg

SEQ ID NO: 2365 - DNA, 21 bp, Artificial Sequence
  Synthetic
tttgtagaaaagtttaaccgc

SEQ ID NO: 2366 - DNA, 21 bp, Artificial Sequence
  Synthetic
tccacgcagtccatgttcaaa

SEQ ID NO: 2367 - DNA, 21 bp, Artificial Sequence
  Synthetic
gacaacaagaacctgtttcgc

SEQ ID NO: 2368 - DNA, 21 bp, Artificial Sequence
  Synthetic
gcgataacgttcaaagatgtg

SEQ ID NO: 2369 - DNA, 21 bp, Artificial Sequence
  Synthetic
ttcacgttgttgacgccgaaa

SEQ ID NO: 2370 - DNA, 21 bp, Artificial Sequence
  Synthetic
tcagcctggggcaaccataag

SEQ ID NO: 2371 - DNA, 21 bp, Artificial Sequence
  Synthetic
tccccgtggggggatcacaaa

SEQ ID NO: 2372 - DNA, 21 bp, Artificial Sequence
  Synthetic
tccgtgcagaaaccgttcttg

SEQ ID NO: 2373 - DNA, 21 bp, Artificial Sequence
  Synthetic
tttaccctgcatacccccaag

SEQ ID NO: 2374 - DNA, 21 bp, Artificial Sequence
  Synthetic
aagaccacctttgaacatatc

SEQ ID NO: 2375 - DNA, 21 bp, Artificial Sequence
  Synthetic
accatcacctttaagatggta

SEQ ID NO: 2376 - DNA, 21 bp, Artificial Sequence
  Synthetic
atccaaggccgctttaacgta

SEQ ID NO: 2377 - DNA, 21 bp, Artificial Sequence
  Synthetic
ttcacgttgacgttgccgaaa

SEQ ID NO: 2378 - DNA, 21 bp, Artificial Sequence
  Synthetic
caaaccaagtttaactcagta

SEQ ID NO: 2379 - DNA, 21 bp, Artificial Sequence
  Synthetic
accaagaccttttcacaagta

SEQ ID NO: 2380 - DNA, 21 bp, Artificial Sequence
  Synthetic
atggtggagttccacaaagtg

SEQ ID NO: 2381 - DNA, 21 bp, Artificial Sequence
  Synthetic
tggtcactgaactcagccaag

SEQ ID NO: 2382 - DNA, 21 bp, Artificial Sequence
  Synthetic
tcctatgataggccgttcata

SEQ ID NO: 2383 - DNA, 21 bp, Artificial Sequence
  Synthetic
gatgtggtgtggaaaagggag

SEQ ID NO: 2384 - DNA, 21 bp, Artificial Sequence
  Synthetic
tcacaatcaaagccctttctg

SEQ ID NO: 2385 - DNA, 21 bp, Artificial Sequence
  Synthetic
tccaatgagaggccgttcata

SEQ ID NO: 2386 - DNA, 21 bp, Artificial Sequence
  Synthetic
acgaatgataggccgttcata

SEQ ID NO: 2387 - DNA, 21 bp, Artificial Sequence
  Synthetic
accgccatcaacccctgggta

SEQ ID NO: 2388 - DNA, 21 bp, Artificial Sequence
  Synthetic
acgatacagttcaaagatgtg

SEQ ID NO: 2389 - DNA, 21 bp, Artificial Sequence
  Synthetic
tccttggagttctccagggtg

SEQ ID NO: 2390 - DNA, 21 bp, Artificial Sequence
  Synthetic
tttaccctggaaacccccaag

SEQ ID NO: 2391 - DNA, 21 bp, Artificial Sequence
  Synthetic
ttcacgttgcagacgccgaaa

SEQ ID NO: 2392 - DNA, 21 bp, Artificial Sequence
  Synthetic
tatgagaataggccgttcgtg

SEQ ID NO: 2393 - DNA, 21 bp, Artificial Sequence
  Synthetic
aatgcgtggggggatcacaaa

SEQ ID NO: 2394 - DNA, 21 bp, Artificial Sequence
  Synthetic
aagaccgactttacccatatc

SEQ ID NO: 2395 - DNA, 21 bp, Artificial Sequence
  Synthetic
cagaaacagttcatgaatcag

SEQ ID NO: 2396 - DNA, 21 bp, Artificial Sequence
  Synthetic
gacaagaagggctgggtagcc

SEQ ID NO: 2397 - DNA, 21 bp, Artificial Sequence
  Synthetic
gggtccgagaggccgttcttg

SEQ ID NO: 2398 - DNA, 21 bp, Artificial Sequence
  Synthetic
gatgcgttcagggtgtccggg

SEQ ID NO: 2399 - DNA, 21 bp, Artificial Sequence
  Synthetic
tcccacgataggccgttcata

SEQ ID NO: 2400 - DNA, 21 bp, Artificial Sequence
  Synthetic
tcagtagacaagccctttctg

SEQ ID NO: 2401 - DNA, 21 bp, Artificial Sequence
  Synthetic
gcgttgcacgtgccgttcaaa

SEQ ID NO: 2402 - DNA, 21 bp, Artificial Sequence
  Synthetic
acccattcatttgaaaagatc

SEQ ID NO: 2403 - DNA, 21 bp, Artificial Sequence
  Synthetic
aaagataaattcaaagatata

SEQ ID NO: 2404 - DNA, 21 bp, Artificial Sequence
  Synthetic
tcctatgagttctccaaagtg

SEQ ID NO: 2405 - DNA, 21 bp, Artificial Sequence
  Synthetic
ccgttcgcgcacgggtccggg

SEQ ID NO: 2406 - DNA, 21 bp, Artificial Sequence
  Synthetic
ggggcgttctccccgccggcg

SEQ ID NO: 2407 - DNA, 21 bp, Artificial Sequence
  Synthetic
ccgccgtccttcaaaaatgtg

SEQ ID NO: 2408 - DNA, 21 bp, Artificial Sequence
  Synthetic
acgatagggtccttgttcaaa

SEQ ID NO: 2409 - DNA, 21 bp, Artificial Sequence
  Synthetic
acggtgtggaatgataggggg

SEQ ID NO: 2410 - DNA, 21 bp, Artificial Sequence
  Synthetic
gcctcaaagttttcatcaatc

SEQ ID NO: 2411 - DNA, 21 bp, Artificial Sequence
  Synthetic
tccgcgtggggggcgcacaaa

SEQ ID NO: 2412 - DNA, 21 bp, Artificial Sequence
  Synthetic
tcccagaaaacgccgttcttg

SEQ ID NO: 2413 - DNA, 21 bp, Artificial Sequence
  Synthetic
tccgtgtccaaattgttcttg

SEQ ID NO: 2414 - DNA, 21 bp, Artificial Sequence
  Synthetic
tcatacgaattttcaaaggta

SEQ ID NO: 2415 - DNA, 21 bp, Artificial Sequence
  Synthetic
gccggcaagtttcgcgacatc

SEQ ID NO: 2416 - DNA, 21 bp, Artificial Sequence
  Synthetic
gcggcggataggccgttcttg

SEQ ID NO: 2417 - DNA, 21 bp, Artificial Sequence
  Synthetic
gattcccagaggccgttcata

SEQ ID NO: 2418 - DNA, 21 bp, Artificial Sequence
  Synthetic
tccaatcacaggccgttcata

SEQ ID NO: 2419 - DNA, 21 bp, Artificial Sequence
  Synthetic
acgaaagcgttgccgttccac

SEQ ID NO: 2420 - DNA, 21 bp, Artificial Sequence
  Synthetic
tcccacacgaaaccgttcgcg

SEQ ID NO: 2421 - DNA, 21 bp, Artificial Sequence
  Synthetic
aaagcggcgttcgatcacata

SEQ ID NO: 2422 - DNA, 21 bp, Artificial Sequence
  Synthetic
tcaaagaccggctggatggcc

SEQ ID NO: 2423 - DNA, 21 bp, Artificial Sequence
  Synthetic
cagataacgttcaaagatgtg

SEQ ID NO: 2424 - DNA, 21 bp, Artificial Sequence
  Synthetic
cccaacttttcaccccccaag

SEQ ID NO: 2425 - DNA, 21 bp, Artificial Sequence
  Synthetic
tcagtatcaaagccctttgcc

SEQ ID NO: 2426 - DNA, 21 bp, Artificial Sequence
  Synthetic
gcggtgtccaaaccgttcttg

SEQ ID NO: 2427 - DNA, 21 bp, Artificial Sequence
  Synthetic
tccgtggataggccgttcata

SEQ ID NO: 2428 - DNA, 21 bp, Artificial Sequence
  Synthetic
aagaccgaatttgcctcaatc

SEQ ID NO: 2429 - DNA, 21 bp, Artificial Sequence
  Synthetic
tcagcctggggcgacaagaag

SEQ ID NO: 2430 - DNA, 21 bp, Artificial Sequence
  Synthetic
tccatagataggccgttcata

SEQ ID NO: 2431 - DNA, 21 bp, Artificial Sequence
  Synthetic
gatatagagaggttgttcaaa

SEQ ID NO: 2432 - DNA, 21 bp, Artificial Sequence
  Synthetic
tcagtatcacatccctttctg

SEQ ID NO: 2433 - DNA, 21 bp, Artificial Sequence
  Synthetic
tcaaacgaccgcccctttaag

SEQ ID NO: 2434 - DNA, 21 bp, Artificial Sequence
  Synthetic
tcagcctggggcgaacataag

SEQ ID NO: 2435 - DNA, 21 bp, Artificial Sequence
  Synthetic
tccaatgataggccgttcttg

SEQ ID NO: 2436 - DNA, 21 bp, Artificial Sequence
  Synthetic
tcaaacgaccgcccctttctg

SEQ ID NO: 2437 - DNA, 21 bp, Artificial Sequence
  Synthetic
caatcagtatttgcctcagta

SEQ ID NO: 2438 - DNA, 21 bp, Artificial Sequence
  Synthetic
tttaccctgaacacccccaag

SEQ ID NO: 2439 - DNA, 21 bp, Artificial Sequence
  Synthetic
accaaggccctgccctttcat

SEQ ID NO: 2440 - DNA, 21 bp, Artificial Sequence
  Synthetic
ttcacgttgacgacgacgaaa

SEQ ID NO: 2441 - DNA, 21 bp, Artificial Sequence
  Synthetic
tccacggataggccgttcata

SEQ ID NO: 2442 - DNA, 21 bp, Artificial Sequence
  Synthetic
aagacccaatttaaggacgta

SEQ ID NO: 2443 - DNA, 21 bp, Artificial Sequence
  Synthetic
tccccggtgaatatattcgtg

SEQ ID NO: 2444 - DNA, 21 bp, Artificial Sequence
  Synthetic
tcagcctggggcgaccatctg

SEQ ID NO: 2445 - DNA, 21 bp, Artificial Sequence
  Synthetic
ttggtgccgccggcgaatata

SEQ ID NO: 2446 - DNA, 21 bp, Artificial Sequence
  Synthetic
aacccctcatcaacctcatgg

SEQ ID NO: 2447 - DNA, 21 bp, Artificial Sequence
  Synthetic
ggctcagaacgcccctttctg

SEQ ID NO: 2448 - DNA, 21 bp, Artificial Sequence
  Synthetic
aatacgttgatggcgtccaaa

SEQ ID NO: 2449 - DNA, 21 bp, Artificial Sequence
  Synthetic
tttaccctgaccgtacccaag

SEQ ID NO: 2450 - DNA, 21 bp, Artificial Sequence
  Synthetic
gagcacttcgggaaaacgtat

SEQ ID NO: 2451 - DNA, 21 bp, Artificial Sequence
  Synthetic
accctgccctttcccaaccgc

SEQ ID NO: 2452 - DNA, 21 bp, Artificial Sequence
  Synthetic
tcctccgataggccgttcata

SEQ ID NO: 2453 - DNA, 21 bp, Artificial Sequence
  Synthetic
ctgtcaacccatccctttcgc

SEQ ID NO: 2454 - DNA, 21 bp, Artificial Sequence
  Synthetic
gatgcgatattcaggcaggcg

SEQ ID NO: 2455 - DNA, 21 bp, Artificial Sequence
  Synthetic
tccaataggttcgagcacgtg

SEQ ID NO: 2456 - DNA, 21 bp, Artificial Sequence
  Synthetic
tcatactcaaagccctttctg

SEQ ID NO: 2457 - DNA, 21 bp, Artificial Sequence
  Synthetic
aacaccctgaagaccgccatc

SEQ ID NO: 2458 - DNA, 21 bp, Artificial Sequence
  Synthetic
tcagcctggggcgacatcaag

SEQ ID NO: 2459 - DNA, 21 bp, Artificial Sequence
  Synthetic
acgaaaacgttctcccaggtg

SEQ ID NO: 2460 - DNA, 21 bp, Artificial Sequence
  Synthetic
acggatttggggtatgcgagg

SEQ ID NO: 2461 - DNA, 21 bp, Artificial Sequence
  Synthetic
aatgtgtggtccgagaggggg

SEQ ID NO: 2462 - DNA, 21 bp, Artificial Sequence
  Synthetic
cagttggcgaatccgttccag

SEQ ID NO: 2463 - DNA, 21 bp, Artificial Sequence
  Synthetic
acccgcgacctgccctttaag

SEQ ID NO: 2464 - DNA, 21 bp, Artificial Sequence
  Synthetic
accgtatttggcacccgcacc

SEQ ID NO: 2465 - DNA, 21 bp, Artificial Sequence
  Synthetic
tccgcgtggggggatgtgaaa

SEQ ID NO: 2466 - DNA, 21 bp, Artificial Sequence
  Synthetic
tcagtacaaaagccctttctg

SEQ ID NO: 2467 - DNA, 21 bp, Artificial Sequence
  Synthetic
gcgggggtgaggttggggtat

SEQ ID NO: 2468 - DNA, 21 bp, Artificial Sequence
  Synthetic
gacgcctttcgcgtatcaggc

SEQ ID NO: 2469 - DNA, 21 bp, Artificial Sequence
  Synthetic
gtataccataactcagccacc

SEQ ID NO: 2470 - DNA, 21 bp, Artificial Sequence
  Synthetic
ccggagtggcacgcgaaaacg

SEQ ID NO: 2471 - DNA, 21 bp, Artificial Sequence
  Synthetic
aacgtatcaaagccctttctg

SEQ ID NO: 2472 - DNA, 21 bp, Artificial Sequence
  Synthetic
tcatacgaccgcccctttatc

SEQ ID NO: 2473 - DNA, 21 bp, Artificial Sequence
  Synthetic
ccggatatagcgagggtgttc

SEQ ID NO: 2474 - DNA, 21 bp, Artificial Sequence
  Synthetic
tcaatcacctttaaggacgta

SEQ ID NO: 2475 - DNA, 21 bp, Artificial Sequence
  Synthetic
ccgccgatagcgagggtgtat

SEQ ID NO: 2476 - DNA, 21 bp, Artificial Sequence
  Synthetic
accatcgacaccccctttcgc

SEQ ID NO: 2477 - DNA, 21 bp, Artificial Sequence
  Synthetic
ttcacgttgatgacgccgaaa

SEQ ID NO: 2478 - DNA, 21 bp, Artificial Sequence
  Synthetic
tcatcaaagtttatcaacatc

SEQ ID NO: 2479 - DNA, 21 bp, Artificial Sequence
  Synthetic
gccgccgaccgcccctttctg

SEQ ID NO: 2480 - DNA, 21 bp, Artificial Sequence
  Synthetic
ttcacgttgacggagccgaaa

SEQ ID NO: 2481 - DNA, 21 bp, Artificial Sequence
  Synthetic
gccggcggctggggcgccccc

SEQ ID NO: 2482 - DNA, 21 bp, Artificial Sequence
  Synthetic
acgacgatgaaaccgttcaat

SEQ ID NO: 2483 - DNA, 21 bp, Artificial Sequence
  Synthetic
gacgtagtatggaagcgcgaa

SEQ ID NO: 2484 - DNA, 21 bp, Artificial Sequence
  Synthetic
acgatagatacgccgttcagg

SEQ ID NO: 2485 - DNA, 21 bp, Artificial Sequence
  Synthetic
tttaccctggacacccccaag

SEQ ID NO: 2486 - DNA, 21 bp, Artificial Sequence
  Synthetic
tcagcctggggcgaccaaaag

SEQ ID NO: 2487 - DNA, 21 bp, Artificial Sequence
  Synthetic
caaacccgcctggcctcagta

SEQ ID NO: 2488 - DNA, 21 bp, Artificial Sequence
  Synthetic
ttcacgttgaatacgccgaaa

SEQ ID NO: 2489 - DNA, 21 bp, Artificial Sequence
  Synthetic
ttcacgcagacgacgccgaaa

SEQ ID NO: 2490 - DNA, 21 bp, Artificial Sequence
  Synthetic
gactcacaacgcccctttatc

SEQ ID NO: 2491 - DNA, 21 bp, Artificial Sequence
  Synthetic
tcctcccagttccacgtggtg

SEQ ID NO: 2492 - DNA, 21 bp, Artificial Sequence
  Synthetic
tcactggaccgcccctttatc

SEQ ID NO: 2493 - DNA, 21 bp, Artificial Sequence
  Synthetic
caaaccaagttttcaggcatc

SEQ ID NO: 2494 - DNA, 21 bp, Artificial Sequence
  Synthetic
tcagcctggggcgacgtaaag

SEQ ID NO: 2495 - DNA, 21 bp, Artificial Sequence
  Synthetic
ttgtccacgcacccgttcagg

SEQ ID NO: 2496 - DNA, 21 bp, Artificial Sequence
  Synthetic
atgataacgttcaaagatgtg

SEQ ID NO: 2497 - DNA, 21 bp, Artificial Sequence
  Synthetic
tccgtgtccaaaccgttccac

SEQ ID NO: 2498 - DNA, 21 bp, Artificial Sequence
  Synthetic
accaaggaacatctgtttcgc

SEQ ID NO: 2499 - DNA, 21 bp, Artificial Sequence
  Synthetic
acgaggttggggtgggtggcg

SEQ ID NO: 2500 - DNA, 21 bp, Artificial Sequence
  Synthetic
ggcgccttttcaccccccgcc

SEQ ID NO: 2501 - DNA, 21 bp, Artificial Sequence
  Synthetic
aatacgttgaaaacggcgata

SEQ ID NO: 2502 - DNA, 21 bp, Artificial Sequence
  Synthetic
acgttgacgtccccgttcagg

SEQ ID NO: 2503 - DNA, 21 bp, Artificial Sequence
  Synthetic
acggatacgtcctatttcaaa

SEQ ID NO: 2504 - DNA, 21 bp, Artificial Sequence
  Synthetic
acgaaagagcacttgttcagg

SEQ ID NO: 2505 - DNA, 21 bp, Artificial Sequence
  Synthetic
acgtatacgttcaaagatgtg

SEQ ID NO: 2506 - DNA, 21 bp, Artificial Sequence
  Synthetic
tatagggataatatattcaaa

SEQ ID NO: 2507 - DNA, 21 bp, Artificial Sequence
  Synthetic
ccggatatagcgaggcagtat

SEQ ID NO: 2508 - DNA, 21 bp, Artificial Sequence
  Synthetic
tcacataccaagccctttgcc

SEQ ID NO: 2509 - DNA, 21 bp, Artificial Sequence
  Synthetic
gcccccatgacccaatcatgg

SEQ ID NO: 2510 - DNA, 21 bp, Artificial Sequence
  Synthetic
ccctttgcccatggctcaggc

SEQ ID NO: 2511 - DNA, 21 bp, Artificial Sequence
  Synthetic
aagacctcatttcatgccatc

SEQ ID NO: 2512 - DNA, 21 bp, Artificial Sequence
  Synthetic
tccgagaggtatccgataccg

SEQ ID NO: 2513 - DNA, 21 bp, Artificial Sequence
  Synthetic
accatctcatttaaggacgta

SEQ ID NO: 2514 - DNA, 21 bp, Artificial Sequence
  Synthetic
aacgacacccaattttttcgc

SEQ ID NO: 2515 - DNA, 21 bp, Artificial Sequence
  Synthetic
tcagtatcaaagctgtttctg

SEQ ID NO: 2516 - DNA, 21 bp, Artificial Sequence
  Synthetic
gcgccgatgacgcagtcctgg

SEQ ID NO: 2517 - DNA, 21 bp, Artificial Sequence
  Synthetic
tttaccgtaaccacccccaag

SEQ ID NO: 2518 - DNA, 21 bp, Artificial Sequence
  Synthetic
tttacccataccacccccaag

SEQ ID NO: 2519 - DNA, 21 bp, Artificial Sequence
  Synthetic
caatcaaactttggcaagttt

SEQ ID NO: 2520 - DNA, 21 bp, Artificial Sequence
  Synthetic
acgatagtgttcaaagatgtg

SEQ ID NO: 2521 - DNA, 21 bp, Artificial Sequence
  Synthetic
tttaccctgacctaccccaag

SEQ ID NO: 2522 - DNA, 21 bp, Artificial Sequence
  Synthetic
acgcactccttcgagaaaata

SEQ ID NO: 2523 - DNA, 21 bp, Artificial Sequence
  Synthetic
aacgtagaaaagccctggatc

SEQ ID NO: 2524 - DNA, 21 bp, Artificial Sequence
  Synthetic
tccgcgaataaaccgttcacg

SEQ ID NO: 2525 - DNA, 21 bp, Artificial Sequence
  Synthetic
gggaaatgggcgccgccggcg

SEQ ID NO: 2526 - DNA, 21 bp, Artificial Sequence
  Synthetic
gccgtatcaaagccctttctg

SEQ ID NO: 2527 - DNA, 21 bp, Artificial Sequence
  Synthetic
caatcatcatttcgcgccgta

SEQ ID NO: 2528 - DNA, 21 bp, Artificial Sequence
  Synthetic
tacgaaaaccgcccctttgta

SEQ ID NO: 2529 - DNA, 21 bp, Artificial Sequence
  Synthetic
gaggggagggcgttcgggacg

SEQ ID NO: 2530 - DNA, 21 bp, Artificial Sequence
  Synthetic
tcaaacgaccgcccctggatc

SEQ ID NO: 2531 - DNA, 21 bp, Artificial Sequence
  Synthetic
tcagcctggggcgtacataag

SEQ ID NO: 2532 - DNA, 21 bp, Artificial Sequence
  Synthetic
tcaaaccgctttgaacatgta

SEQ ID NO: 2533 - DNA, 21 bp, Artificial Sequence
  Synthetic
tattccgataggccgttcccg

SEQ ID NO: 2534 - DNA, 21 bp, Artificial Sequence
  Synthetic
acgccggatttcaaaccgagg

SEQ ID NO: 2535 - DNA, 21 bp, Artificial Sequence
  Synthetic
cagaatccggggtggttgccg

SEQ ID NO: 2536 - DNA, 21 bp, Artificial Sequence
  Synthetic
aacaccctgatggcctcaaag

SEQ ID NO: 2537 - DNA, 21 bp, Artificial Sequence
  Synthetic
aacaacatgcatacctcacgc

SEQ ID NO: 2538 - DNA, 21 bp, Artificial Sequence
  Synthetic
accgtaatggccccctttaag

SEQ ID NO: 2539 - DNA, 21 bp, Artificial Sequence
  Synthetic
tccgtgtccaaaccgttcccg

SEQ ID NO: 2540 - DNA, 21 bp, Artificial Sequence
  Synthetic
tccccggataggccgttcata

SEQ ID NO: 2541 - DNA, 21 bp, Artificial Sequence
  Synthetic
tccgcgtggggggatcacaaa

SEQ ID NO: 2542 - DNA, 21 bp, Artificial Sequence
  Synthetic
tccgcgtggggggatcacagg

SEQ ID NO: 2543 - DNA, 21 bp, Artificial Sequence
  Synthetic
gggatattgtccccgccgagg

SEQ ID NO: 2544 - DNA, 21 bp, Artificial Sequence
  Synthetic
ttcacgttgacggcgccgaaa

SEQ ID NO: 2545 - DNA, 21 bp, Artificial Sequence
  Synthetic
tccaggacggggtggatggcg

SEQ ID NO: 2546 - DNA, 21 bp, Artificial Sequence
  Synthetic
aagatcacctttaaggacgta

SEQ ID NO: 2547 - DNA, 21 bp, Artificial Sequence
  Synthetic
ttcacgttgacgacgccgatg

SEQ ID NO: 2548 - DNA, 21 bp, Artificial Sequence
  Synthetic
gtgacgcagttccacaatata

SEQ ID NO: 2549 - DNA, 21 bp, Artificial Sequence
  Synthetic
ggcatgtttaaccccccctca

SEQ ID NO: 2550 - DNA, 21 bp, Artificial Sequence
  Synthetic
ggggagtccaggccgttcata

SEQ ID NO: 2551 - DNA, 21 bp, Artificial Sequence
  Synthetic
tcagtagaaaagccctttctg

SEQ ID NO: 2552 - DNA, 21 bp, Artificial Sequence
  Synthetic
aactcactgcatgcctcaaag

SEQ ID NO: 2553 - DNA, 21 bp, Artificial Sequence
  Synthetic
aacgcctggggcgaccataag

SEQ ID NO: 2554 - DNA, 21 bp, Artificial Sequence
  Synthetic
atgtccgataatttctatccg

SEQ ID NO: 2555 - DNA, 21 bp, Artificial Sequence
  Synthetic
tcagtatcaaagcccttttca

SEQ ID NO: 2556 - DNA, 21 bp, Artificial Sequence
  Synthetic
tcatcacaatttcatgtagta

SEQ ID NO: 2557 - DNA, 21 bp, Artificial Sequence
  Synthetic
aatttggataaaatgttcagg

SEQ ID NO: 2558 - DNA, 21 bp, Artificial Sequence
  Synthetic
accatccattttaaggacgta

SEQ ID NO: 2559 - DNA, 21 bp, Artificial Sequence
  Synthetic
aaaacgacgttcgagcacata

SEQ ID NO: 2560 - DNA, 21 bp, Artificial Sequence
  Synthetic
tttacctcaaccacccccaag

SEQ ID NO: 2561 - DNA, 21 bp, Artificial Sequence
  Synthetic
tccgcgtggggggatcacatg

SEQ ID NO: 2562 - DNA, 21 bp, Artificial Sequence
  Synthetic
tcacgcaccggctggatggcc

SEQ ID NO: 2563 - DNA, 21 bp, Artificial Sequence
  Synthetic
accatggacaagccctttcat

SEQ ID NO: 2564 - DNA, 21 bp, Artificial Sequence
  Synthetic
ttgaatacgccgttcttgccg

SEQ ID NO: 2565 - DNA, 21 bp, Artificial Sequence
  Synthetic
acgataaatttcaaagatgtg

SEQ ID NO: 2566 - DNA, 21 bp, Artificial Sequence
  Synthetic
tcaaacaagtttgaaaacgta

SEQ ID NO: 2567 - DNA, 21 bp, Artificial Sequence
  Synthetic
ccggatatagcgagggtgtat

SEQ ID NO: 2568 - DNA, 21 bp, Artificial Sequence
  Synthetic
accatcaactttaaggacgta

SEQ ID NO: 2569 - DNA, 21 bp, Artificial Sequence
  Synthetic
acgttggcgtatccgttcaaa

SEQ ID NO: 2570 - DNA, 21 bp, Artificial Sequence
  Synthetic
tcagtatcacaaccctttctg

SEQ ID NO: 2571 - DNA, 21 bp, Artificial Sequence
  Synthetic
ttcacggcgacgacgccgaaa

SEQ ID NO: 2572 - DNA, 21 bp, Artificial Sequence
  Synthetic
tatgagacgcagtatttcaaa

SEQ ID NO: 2573 - DNA, 21 bp, Artificial Sequence
  Synthetic
aacccctggggcgaaaagaac

SEQ ID NO: 2574 - DNA, 21 bp, Artificial Sequence
  Synthetic
cccgacatcgcccgccattac

SEQ ID NO: 2575 - DNA, 21 bp, Artificial Sequence
  Synthetic
tttaccctgaagacccccaag

SEQ ID NO: 2576 - DNA, 21 bp, Artificial Sequence
  Synthetic
ttcacgttgacgacggggaaa

SEQ ID NO: 2577 - DNA, 21 bp, Artificial Sequence
  Synthetic
accctgtgggccaaggacggc

SEQ ID NO: 2578 - DNA, 21 bp, Artificial Sequence
  Synthetic
gatccgacgtggaaaagggag

SEQ ID NO: 2579 - DNA, 21 bp, Artificial Sequence
  Synthetic
acggcgataaatccgtgggtg

SEQ ID NO: 2580 - DNA, 21 bp, Artificial Sequence
  Synthetic
gatccgcacacgatatcctgg

SEQ ID NO: 2581 - DNA, 21 bp, Artificial Sequence
  Synthetic
tttaccctggtaacccccaag

SEQ ID NO: 2582 - DNA, 21 bp, Artificial Sequence
  Synthetic
aatgtggagaaaccgtggata

SEQ ID NO: 2583 - DNA, 21 bp, Artificial Sequence
  Synthetic
tcagcctggggcgacatgaag

SEQ ID NO: 2584 - DNA, 21 bp, Artificial Sequence
  Synthetic
ggggggttgccgatgataccg

SEQ ID NO: 2585 - DNA, 21 bp, Artificial Sequence
  Synthetic
tccaataatttctccaatgtg

SEQ ID NO: 2586 - DNA, 21 bp, Artificial Sequence
  Synthetic
tccgtgtccgtgccgttcttg

SEQ ID NO: 2587 - DNA, 21 bp, Artificial Sequence
  Synthetic
ggcatcctgtcacccccccgc

SEQ ID NO: 2588 - DNA, 21 bp, Artificial Sequence
  Synthetic
aatccgtcctccacgtcctgg

SEQ ID NO: 2589 - DNA, 21 bp, Artificial Sequence
  Synthetic
tccgtgtccaaaccgttcgcg

SEQ ID NO: 2590 - DNA, 21 bp, Artificial Sequence
  Synthetic
aaaacggagttcgcgtccata

SEQ ID NO: 2591 - DNA, 21 bp, Artificial Sequence
  Synthetic
tccgtgtcccacccgttcttg

SEQ ID NO: 2592 - DNA, 21 bp, Artificial Sequence
  Synthetic
gaatcatcaatctgggtagcc

SEQ ID NO: 2593 - DNA, 21 bp, Artificial Sequence
  Synthetic
tccgcgtcctccatattcaaa

SEQ ID NO: 2594 - DNA, 21 bp, Artificial Sequence
  Synthetic
cccgtaatcgcccgcgtatac

SEQ ID NO: 2595 - DNA, 21 bp, Artificial Sequence
  Synthetic
tccaatttcttgatagcgccg

SEQ ID NO: 2596 - DNA, 21 bp, Artificial Sequence
  Synthetic
tttaccctgaccctgcccaag

SEQ ID NO: 2597 - DNA, 21 bp, Artificial Sequence
  Synthetic
tcagtatttaagccctttctg

SEQ ID NO: 2598 - DNA, 21 bp, Artificial Sequence
  Synthetic
acccgcgccatgccctttaac

SEQ ID NO: 2599 - DNA, 21 bp, Artificial Sequence
  Synthetic
tccgtgtggggggatcacaaa

SEQ ID NO: 2600 - DNA, 21 bp, Artificial Sequence
  Synthetic
atctcaggctggttttcagaa

SEQ ID NO: 2601 - DNA, 21 bp, Artificial Sequence
  Synthetic
accatcacctttaaggacatc

SEQ ID NO: 2602 - DNA, 21 bp, Artificial Sequence
  Synthetic
aatgtggagaggttgtattcc

SEQ ID NO: 2603 - DNA, 21 bp, Artificial Sequence
  Synthetic
tccatatggggggatcacaaa

SEQ ID NO: 2604 - DNA, 21 bp, Artificial Sequence
  Synthetic
accccctggcatccccatggc

SEQ ID NO: 2605 - DNA, 21 bp, Artificial Sequence
  Synthetic
ttcacgttgacgatgccgaaa

SEQ ID NO: 2606 - DNA, 21 bp, Artificial Sequence
  Synthetic
tccgcgtggggggatacgaaa

SEQ ID NO: 2607 - DNA, 21 bp, Artificial Sequence
  Synthetic
cagtcccacttcgcgtccgtg

SEQ ID NO: 2608 - DNA, 21 bp, Artificial Sequence
  Synthetic
ttgttgaataatccgttcgcg

SEQ ID NO: 2609 - DNA, 21 bp, Artificial Sequence
  Synthetic
tacgtagaccgcctgtttaag

SEQ ID NO: 2610 - DNA, 21 bp, Artificial Sequence
  Synthetic
acggcgtggagggaggatggg

SEQ ID NO: 2611 - DNA, 21 bp, Artificial Sequence
  Synthetic
aatttgttctcctcccagttg

SEQ ID NO: 2612 - DNA, 21 bp, Artificial Sequence
  Synthetic
tcagcctggggcgactcaaag

SEQ ID NO: 2613 - DNA, 21 bp, Artificial Sequence
  Synthetic
cccgacatcgtacgcgtatac

SEQ ID NO: 2614 - DNA, 21 bp, Artificial Sequence
  Synthetic
tattccacggcgatgttcaaa

SEQ ID NO: 2615 - DNA, 21 bp, Artificial Sequence
  Synthetic
acgatagggcacatattctcc

SEQ ID NO: 2616 - DNA, 21 bp, Artificial Sequence
  Synthetic
cagtcctccttcagggcggtg

SEQ ID NO: 2617 - DNA, 21 bp, Artificial Sequence
  Synthetic
ttgacgttgacgtcctccaaa

SEQ ID NO: 2618 - DNA, 21 bp, Artificial Sequence
  Synthetic
tttaccatgaccacccccaag

SEQ ID NO: 2619 - DNA, 21 bp, Artificial Sequence
  Synthetic
gccatcacctttaaggacgta

SEQ ID NO: 2620 - DNA, 21 bp, Artificial Sequence
  Synthetic
accatcctgtttaaggacgta

SEQ ID NO: 2621 - DNA, 21 bp, Artificial Sequence
  Synthetic
accatcgcctttaaggacgta

SEQ ID NO: 2622 - DNA, 21 bp, Artificial Sequence
  Synthetic
tccgtgtccttgccgttcttg

SEQ ID NO: 2623 - DNA, 21 bp, Artificial Sequence
  Synthetic
cccgaatggcatgccaagacc

SEQ ID NO: 2624 - DNA, 21 bp, Artificial Sequence
  Synthetic
gggggggcgacgccgttcagg

SEQ ID NO: 2625 - DNA, 21 bp, Artificial Sequence
  Synthetic
cagacgaaattctccgggata

SEQ ID NO: 2626 - DNA, 21 bp, Artificial Sequence
  Synthetic
ccgataatagcgtccacgtat

SEQ ID NO: 2627 - DNA, 21 bp, Artificial Sequence
  Synthetic
aaaacggatttcacgcacata

SEQ ID NO: 2628 - DNA, 21 bp, Artificial Sequence
  Synthetic
tcctccgagaaaccgttccag

SEQ ID NO: 2629 - DNA, 21 bp, Artificial Sequence
  Synthetic
ggcatgcgctcatttaccgta

SEQ ID NO: 2630 - DNA, 21 bp, Artificial Sequence
  Synthetic
gcgtccaaattctcctccata

SEQ ID NO: 2631 - DNA, 21 bp, Artificial Sequence
  Synthetic
aacgtacaaatgccctttatc

SEQ ID NO: 2632 - DNA, 21 bp, Artificial Sequence
  Synthetic
tccatgtggggggatcacaaa

SEQ ID NO: 2633 - DNA, 21 bp, Artificial Sequence
  Synthetic
acgatacacttcaaagatgtg

SEQ ID NO: 2634 - DNA, 21 bp, Artificial Sequence
  Synthetic
aatacgtggttcccgaatggg

SEQ ID NO: 2635 - DNA, 21 bp, Artificial Sequence
  Synthetic
ttcacgacgacgacgccgaaa

SEQ ID NO: 2636 - DNA, 21 bp, Artificial Sequence
  Synthetic
ggctcattttcacgcccccaa

SEQ ID NO: 2637 - DNA, 21 bp, Artificial Sequence
  Synthetic
tacggcgaactgccctttcaa

SEQ ID NO: 2638 - DNA, 21 bp, Artificial Sequence
  Synthetic
gtggatccgaggaggggggtg

SEQ ID NO: 2639 - DNA, 21 bp, Artificial Sequence
  Synthetic
acgataacgttcaaagatata

SEQ ID NO: 2640 - DNA, 21 bp, Artificial Sequence
  Synthetic
acgttggagaatgtgttcaaa

SEQ ID NO: 2641 - DNA, 21 bp, Artificial Sequence
  Synthetic
atgatcacctttaaggacgta

SEQ ID NO: 2642 - DNA, 21 bp, Artificial Sequence
  Synthetic
cccgacatcgcccgcatctac

SEQ ID NO: 2643 - DNA, 21 bp, Artificial Sequence
  Synthetic
gacaagatcggctttaccccc

SEQ ID NO: 2644 - DNA, 21 bp, Artificial Sequence
  Synthetic
tatacgttgacgacgccgaaa

SEQ ID NO: 2645 - DNA, 21 bp, Artificial Sequence
  Synthetic
accatccaatttaaggacgta

SEQ ID NO: 2646 - DNA, 21 bp, Artificial Sequence
  Synthetic
gtgccgtggaataaacagacg

SEQ ID NO: 2647 - DNA, 21 bp, Artificial Sequence
  Synthetic
ccggatatagcgagggcgtat

SEQ ID NO: 2648 - DNA, 21 bp, Artificial Sequence
  Synthetic
aacgtagaacgcctgtactca

SEQ ID NO: 2649 - DNA, 21 bp, Artificial Sequence
  Synthetic
tcagaatcacattactttaag

SEQ ID NO: 2650 - DNA, 21 bp, Artificial Sequence
  Synthetic
tttaccctgacctttcccaag

SEQ ID NO: 2651 - DNA, 21 bp, Artificial Sequence
  Synthetic
acgataacgttcaaacacgtg

SEQ ID NO: 2652 - DNA, 21 bp, Artificial Sequence
  Synthetic
aggttggggtggatagatccg

SEQ ID NO: 2653 - DNA, 21 bp, Artificial Sequence
  Synthetic
aatccgaggtgggataatccg

SEQ ID NO: 2654 - DNA, 21 bp, Artificial Sequence
  Synthetic
tcagaatcaaagccctttctg

SEQ ID NO: 2655 - DNA, 21 bp, Artificial Sequence
  Synthetic
tcaaacaacttttcaaacgta

SEQ ID NO: 2656 - DNA, 21 bp, Artificial Sequence
  Synthetic
tccgagtcccactatttcaaa

SEQ ID NO: 2657 - DNA, 21 bp, Artificial Sequence
  Synthetic
gaccccacctggaagcgcgaa

SEQ ID NO: 2658 - DNA, 21 bp, Artificial Sequence
  Synthetic
tccgcgtggggggatcagaaa

SEQ ID NO: 2659 - DNA, 21 bp, Artificial Sequence
  Synthetic
tcagaacgctaccccatcccc

SEQ ID NO: 2660 - DNA, 21 bp, Artificial Sequence
  Synthetic
ggggcggtggggtgggcggcg

SEQ ID NO: 2661 - DNA, 21 bp, Artificial Sequence
  Synthetic
acgcacacgttcaaagatgtg

SEQ ID NO: 2662 - DNA, 21 bp, Artificial Sequence
  Synthetic
tcagcctggggcgacgccaag

SEQ ID NO: 2663 - DNA, 21 bp, Artificial Sequence
  Synthetic
atgaaagagacgttccacccg

SEQ ID NO: 2664 - DNA, 21 bp, Artificial Sequence
  Synthetic
tcagcctggggcgactttaag

SEQ ID NO: 2665 - DNA, 21 bp, Artificial Sequence
  Synthetic
tcaaccacctttaaggacatc

SEQ ID NO: 2666 - DNA, 21 bp, Artificial Sequence
  Synthetic
aactttaccaccgtatttcat

SEQ ID NO: 2667 - DNA, 21 bp, Artificial Sequence
  Synthetic
aacacctcatcaacctcacgc

SEQ ID NO: 2668 - DNA, 21 bp, Artificial Sequence
  Synthetic
tcagtatcagccccctttctg

SEQ ID NO: 2669 - DNA, 21 bp, Artificial Sequence
  Synthetic
ggccaatgggccggcggcggc

SEQ ID NO: 2670 - DNA, 21 bp, Artificial Sequence
  Synthetic
aatccgttcgggcacgcgatg

SEQ ID NO: 2671 - DNA, 21 bp, Artificial Sequence
  Synthetic
aatccgtggggggagaaaaat

SEQ ID NO: 2672 - DNA, 21 bp, Artificial Sequence
  Synthetic
ccccccctgtttcgcgaactg

SEQ ID NO: 2673 - DNA, 21 bp, Artificial Sequence
  Synthetic
cccaacatcgcccgcgtatac

SEQ ID NO: 2674 - DNA, 21 bp, Artificial Sequence
  Synthetic
tccttcgataggccgttcata

SEQ ID NO: 2675 - DNA, 21 bp, Artificial Sequence
  Synthetic
cagacgaatttcaatgtgatg

SEQ ID NO: 2676 - DNA, 21 bp, Artificial Sequence
  Synthetic
atatccgggtggttctccgag

SEQ ID NO: 2677 - DNA, 21 bp, Artificial Sequence
  Synthetic
tccaatgataggccgttcata

SEQ ID NO: 2678 - DNA, 21 bp, Artificial Sequence
  Synthetic
tccgcgtgggcgtccatgggg

SEQ ID NO: 2679 - DNA, 21 bp, Artificial Sequence
  Synthetic
ctggtaccccccaacaacgaa

SEQ ID NO: 2680 - DNA, 21 bp, Artificial Sequence
  Synthetic
acccccgactttaagccccgc

SEQ ID NO: 2681 - DNA, 21 bp, Artificial Sequence
  Synthetic
ccccccatcgcccgcgtatac

SEQ ID NO: 2682 - DNA, 21 bp, Artificial Sequence
  Synthetic
aggccgatgaatgcgtcccac

SEQ ID NO: 2683 - DNA, 21 bp, Artificial Sequence
  Synthetic
tcagtacgctttatcgacgta

SEQ ID NO: 2684 - DNA, 21 bp, Artificial Sequence
  Synthetic
ttcacgttgacgacgccgttg

SEQ ID NO: 2685 - DNA, 21 bp, Artificial Sequence
  Synthetic
aacctgttttcatcacaactg

SEQ ID NO: 2686 - DNA, 21 bp, Artificial Sequence
  Synthetic
ttcacgttgacgttcccgaaa

SEQ ID NO: 2687 - DNA, 21 bp, Artificial Sequence
  Synthetic
ccgcaggagttcaaacacgtg

SEQ ID NO: 2688 - DNA, 21 bp, Artificial Sequence
  Synthetic
aacctgtttaccgaaaagctg

SEQ ID NO: 2689 - DNA, 21 bp, Artificial Sequence
  Synthetic
tcagccatcaacctgcgctac

SEQ ID NO: 2690 - DNA, 21 bp, Artificial Sequence
  Synthetic
tccgtgtcccagccgttcttg

SEQ ID NO: 2691 - DNA, 21 bp, Artificial Sequence
  Synthetic
aggccggtgaatgagtgggtg

SEQ ID NO: 2692 - DNA, 21 bp, Artificial Sequence
  Synthetic
cagttggataggccgttctcc

SEQ ID NO: 2693 - DNA, 21 bp, Artificial Sequence
  Synthetic
atcaccatggaaacctcacgc

SEQ ID NO: 2694 - DNA, 21 bp, Artificial Sequence
  Synthetic
ctgctgaacaacccctttgcc

SEQ ID NO: 2695 - DNA, 21 bp, Artificial Sequence
  Synthetic
tactcaaccgccatgtttaag

SEQ ID NO: 2696 - DNA, 21 bp, Artificial Sequence
  Synthetic
aatgcgtggtccttggcgggg

SEQ ID NO: 2697 - DNA, 21 bp, Artificial Sequence
  Synthetic
gcccatgaatttcatctgatc

SEQ ID NO: 2698 - DNA, 21 bp, Artificial Sequence
  Synthetic
atcggcgtacgcctgggcacc

SEQ ID NO: 2699 - DNA, 21 bp, Artificial Sequence
  Synthetic
accatcatgtttaaggacgta

SEQ ID NO: 2700 - DNA, 21 bp, Artificial Sequence
  Synthetic
tcaaacgaccgcccctttatc

SEQ ID NO: 2701 - DNA, 21 bp, Artificial Sequence
  Synthetic
aatttgttcacggagaaattg

SEQ ID NO: 2702 - DNA, 21 bp, Artificial Sequence
  Synthetic
atgatgaagtcaatgtacccc

SEQ ID NO: 2703 - DNA, 21 bp, Artificial Sequence
  Synthetic
accatcatctttaaggacgta

SEQ ID NO: 2704 - DNA, 21 bp, Artificial Sequence
  Synthetic
tcagactggaccggcaagatg

SEQ ID NO: 2705 - DNA, 21 bp, Artificial Sequence
  Synthetic
acgatatatttcaaagatgtg

SEQ ID NO: 2706 - DNA, 21 bp, Artificial Sequence
  Synthetic
aatgatacgcagttcttcagg

SEQ ID NO: 2707 - DNA, 21 bp, Artificial Sequence
  Synthetic
gatgtgttcaggccgacgggg

SEQ ID NO: 2708 - DNA, 21 bp, Artificial Sequence
  Synthetic
tcaaacgaccgcccctttatg

SEQ ID NO: 2709 - DNA, 21 bp, Artificial Sequence
  Synthetic
acgatattcttcaaagatgtg

SEQ ID NO: 2710 - DNA, 21 bp, Artificial Sequence
  Synthetic
tttaccgccaccacccccaag

SEQ ID NO: 2711 - DNA, 21 bp, Artificial Sequence
  Synthetic
tgggatttgaaagggccgaaa

SEQ ID NO: 2712 - DNA, 21 bp, Artificial Sequence
  Synthetic
acggggacgtccccgttcaaa

SEQ ID NO: 2713 - DNA, 21 bp, Artificial Sequence
  Synthetic
accatcggccatatcttttca

SEQ ID NO: 2714 - DNA, 21 bp, Artificial Sequence
  Synthetic
tcagcctggggcgaccatgta

SEQ ID NO: 2715 - DNA, 21 bp, Artificial Sequence
  Synthetic
acgtccaatttcgcgcagata

SEQ ID NO: 2716 - DNA, 21 bp, Artificial Sequence
  Synthetic
tcatcagaaaagccctttcaa

SEQ ID NO: 2717 - DNA, 21 bp, Artificial Sequence
  Synthetic
ccggatatagcgaggatgtat

SEQ ID NO: 2718 - DNA, 21 bp, Artificial Sequence
  Synthetic
ccggatatagcgagggtgtgg

SEQ ID NO: 2719 - DNA, 21 bp, Artificial Sequence
  Synthetic
ttcacggtgaaaacgtccata

SEQ ID NO: 2720 - DNA, 21 bp, Artificial Sequence
  Synthetic
gtggcggtgttcaaaaatgtg

SEQ ID NO: 2721 - DNA, 21 bp, Artificial Sequence
  Synthetic
tcactggaattttcacgcgta

SEQ ID NO: 2722 - DNA, 21 bp, Artificial Sequence
  Synthetic
gcgcacgagttccacttgata

SEQ ID NO: 2723 - DNA, 21 bp, Artificial Sequence
  Synthetic
accgacacctcatactttaag

SEQ ID NO: 2724 - DNA, 21 bp, Artificial Sequence
  Synthetic
tcagcctggggcgcccataag

SEQ ID NO: 2725 - DNA, 21 bp, Artificial Sequence
  Synthetic
tcagccaccggctggtcagcc

SEQ ID NO: 2726 - DNA, 21 bp, Artificial Sequence
  Synthetic
acctttacctttaaggacgta

SEQ ID NO: 2727 - DNA, 21 bp, Artificial Sequence
  Synthetic
ggggattgggcgggggtgagg

SEQ ID NO: 2728 - DNA, 21 bp, Artificial Sequence
  Synthetic
gatccgagggggtggacgccg

SEQ ID NO: 2729 - DNA, 21 bp, Artificial Sequence
  Synthetic
ttcacgttggagacgccgaaa

SEQ ID NO: 2730 - DNA, 21 bp, Artificial Sequence
  Synthetic
accctggcctacccctttaag

SEQ ID NO: 2731 - DNA, 21 bp, Artificial Sequence
  Synthetic
gatttgtggaggccgaatgat

SEQ ID NO: 2732 - DNA, 21 bp, Artificial Sequence
  Synthetic
cccccctcatttaagaacgta

SEQ ID NO: 2733 - DNA, 21 bp, Artificial Sequence
  Synthetic
atcaccatgtcaacctcaatc

SEQ ID NO: 2734 - DNA, 21 bp, Artificial Sequence
  Synthetic
accatctactttaaggacgta

SEQ ID NO: 2735 - DNA, 21 bp, Artificial Sequence
  Synthetic
ccccgcatcgccgactcatac

SEQ ID NO: 2736 - DNA, 21 bp, Artificial Sequence
  Synthetic
tcaatggtatttgcctcaccc

SEQ ID NO: 2737 - DNA, 21 bp, Artificial Sequence
  Synthetic
ttcacgttgacgacgccgttc

SEQ ID NO: 2738 - DNA, 21 bp, Artificial Sequence
  Synthetic
tttaccgtaaagacctcaatc

SEQ ID NO: 2739 - DNA, 21 bp, Artificial Sequence
  Synthetic
acgataacgttcagggatgtg

SEQ ID NO: 2740 - DNA, 21 bp, Artificial Sequence
  Synthetic
tcaatctggggcgaccataag

SEQ ID NO: 2741 - DNA, 21 bp, Artificial Sequence
  Synthetic
cagagggatgtgccgttcagg

SEQ ID NO: 2742 - DNA, 21 bp, Artificial Sequence
  Synthetic
atgaaggaaacctttcatccc

SEQ ID NO: 2743 - DNA, 21 bp, Artificial Sequence
  Synthetic
aaattcacgttcggggatgtg

SEQ ID NO: 2744 - DNA, 21 bp, Artificial Sequence
  Synthetic
gaacattttggcaagacctac

SEQ ID NO: 2745 - DNA, 21 bp, Artificial Sequence
  Synthetic
tcaggcgacaagtactttaag

SEQ ID NO: 2746 - DNA, 21 bp, Artificial Sequence
  Synthetic
tcagtatcaaaggtatttctg

SEQ ID NO: 2747 - DNA, 21 bp, Artificial Sequence
  Synthetic
tccaatgataggccgttctat

SEQ ID NO: 2748 - DNA, 21 bp, Artificial Sequence
  Synthetic
ggcgtactggtacccccccgc

SEQ ID NO: 2749 - DNA, 21 bp, Artificial Sequence
  Synthetic
ggctcaaccggctggatcgcc

SEQ ID NO: 2750 - DNA, 21 bp, Artificial Sequence
  Synthetic
atgtcaatgaagacctcagta

SEQ ID NO: 2751 - DNA, 21 bp, Artificial Sequence
  Synthetic
caacgcgacgtaccctttcgc

SEQ ID NO: 2752 - DNA, 21 bp, Artificial Sequence
  Synthetic
gatgggaattggtccgcgttg

SEQ ID NO: 2753 - DNA, 21 bp, Artificial Sequence
  Synthetic
ggcgaatcacgcccctttatc

SEQ ID NO: 2754 - DNA, 21 bp, Artificial Sequence
  Synthetic
tactcagaccgcccctttccc

SEQ ID NO: 2755 - DNA, 21 bp, Artificial Sequence
  Synthetic
ctgggccgcgccctgggcaac

SEQ ID NO: 2756 - DNA, 21 bp, Artificial Sequence
  Synthetic
tatggggagttgccgttccag

SEQ ID NO: 2757 - DNA, 21 bp, Artificial Sequence
  Synthetic
caggatttgaaatatgtgagg

SEQ ID NO: 2758 - DNA, 21 bp, Artificial Sequence
  Synthetic
tccatatcccacccgtatata

SEQ ID NO: 2759 - DNA, 21 bp, Artificial Sequence
  Synthetic
ttggattggccggcgacgaaa

SEQ ID NO: 2760 - DNA, 21 bp, Artificial Sequence
  Synthetic
tcaaagtcaggctggatggcc

SEQ ID NO: 2761 - DNA, 21 bp, Artificial Sequence
  Synthetic
acggtgaatataccgttccag

SEQ ID NO: 2762 - DNA, 21 bp, Artificial Sequence
  Synthetic
acggatttgaaacagtccagg

SEQ ID NO: 2763 - DNA, 21 bp, Artificial Sequence
  Synthetic
caaacctcatttcgcgaaatc

SEQ ID NO: 2764 - DNA, 21 bp, Artificial Sequence
  Synthetic
tgggagaggttgggggatgtg

SEQ ID NO: 2765 - DNA, 21 bp, Artificial Sequence
  Synthetic
acgatatccttcaaagatgtg

SEQ ID NO: 2766 - DNA, 21 bp, Artificial Sequence
  Synthetic
tccgcgtgggggcagcacaaa

SEQ ID NO: 2767 - DNA, 21 bp, Artificial Sequence
  Synthetic
accatcacctttcgcgacgta

SEQ ID NO: 2768 - DNA, 21 bp, Artificial Sequence
  Synthetic
acgttgtcctccccgtggacg

SEQ ID NO: 2769 - DNA, 21 bp, Artificial Sequence
  Synthetic
tcacaactgggctttcatccc

SEQ ID NO: 2770 - DNA, 21 bp, Artificial Sequence
  Synthetic
acgttgtgggcgaaagatggg

SEQ ID NO: 2771 - DNA, 21 bp, Artificial Sequence
  Synthetic
gaacattggaccaactcaaag

SEQ ID NO: 2772 - DNA, 21 bp, Artificial Sequence
  Synthetic
cccgacatcatccgcgtatac

SEQ ID NO: 2773 - DNA, 21 bp, Artificial Sequence
  Synthetic
atgtccatgaaaacgtccgtg

SEQ ID NO: 2774 - DNA, 21 bp, Artificial Sequence
  Synthetic
ttcacgcacacgacgccgaaa

SEQ ID NO: 2775 - DNA, 21 bp, Artificial Sequence
  Synthetic
tccgcgtggggggatgcgaaa

SEQ ID NO: 2776 - DNA, 21 bp, Artificial Sequence
  Synthetic
acggtggcgaatccgttccac

SEQ ID NO: 2777 - DNA, 21 bp, Artificial Sequence
  Synthetic
accaagtcaggctggatggcc

SEQ ID NO: 2778 - DNA, 21 bp, Artificial Sequence
  Synthetic
tttaccctgaccacccccctg

SEQ ID NO: 2779 - DNA, 21 bp, Artificial Sequence
  Synthetic
gggtccttctccaggccgcag

SEQ ID NO: 2780 - DNA, 21 bp, Artificial Sequence
  Synthetic
tccgcgtgggggccgcacaaa

SEQ ID NO: 2781 - DNA, 21 bp, Artificial Sequence
  Synthetic
tccgcgtggggggattccaaa

SEQ ID NO: 2782 - DNA, 21 bp, Artificial Sequence
  Synthetic
acgatagcgttcaaagatgtg

SEQ ID NO: 2783 - DNA, 21 bp, Artificial Sequence
  Synthetic
cccgacatcgcccgcttttac

SEQ ID NO: 2784 - DNA, 21 bp, Artificial Sequence
  Synthetic
tacaacgaccgcccctttatc

SEQ ID NO: 2785 - DNA, 21 bp, Artificial Sequence
  Synthetic
acgataacgttcaaacaggtg

SEQ ID NO: 2786 - DNA, 21 bp, Artificial Sequence
  Synthetic
acgataacgttcaaatccgtg

SEQ ID NO: 2787 - DNA, 21 bp, Artificial Sequence
  Synthetic
acgacgatgaggacgtcccag

SEQ ID NO: 2788 - DNA, 21 bp, Artificial Sequence
  Synthetic
tcagtatcacgcccctttctg

SEQ ID NO: 2789 - DNA, 21 bp, Artificial Sequence
  Synthetic
acgataatgttcaaagatgtg

SEQ ID NO: 2790 - DNA, 21 bp, Artificial Sequence
  Synthetic
tccgcgacggggtggtccgcg

SEQ ID NO: 2791 - DNA, 21 bp, Artificial Sequence
  Synthetic
ttcacgtatacgacgccgaaa

SEQ ID NO: 2792 - DNA, 21 bp, Artificial Sequence
  Synthetic
acgataacgttcaaagatgtg

SEQ ID NO: 2793 - DNA, 21 bp, Artificial Sequence
  Synthetic
tcactggactttaagaacatc

SEQ ID NO: 2794 - DNA, 21 bp, Artificial Sequence
  Synthetic
tttaccctgaccgaccccaag

SEQ ID NO: 2795 - DNA, 21 bp, Artificial Sequence
  Synthetic
ccgaaatggaatgagacgaat

SEQ ID NO: 2796 - DNA, 21 bp, Artificial Sequence
  Synthetic
atggggttgtccccgccgagg

SEQ ID NO: 2797 - DNA, 21 bp, Artificial Sequence
  Synthetic
caaatcaacttttcagtacaa

SEQ ID NO: 2798 - DNA, 21 bp, Artificial Sequence
  Synthetic
tatttgaatgtgttcgtgggg

SEQ ID NO: 2799 - DNA, 21 bp, Artificial Sequence
  Synthetic
gtggtggggtggcacagggag

SEQ ID NO: 2800 - DNA, 21 bp, Artificial Sequence
  Synthetic
tcagcctggggcgacctgaag

SEQ ID NO: 2801 - DNA, 21 bp, Artificial Sequence
  Synthetic
aacgacctgaagtacacccgc

SEQ ID NO: 2802 - DNA, 21 bp, Artificial Sequence
  Synthetic
accatcacctttaaggacgta

SEQ ID NO: 2803 - DNA, 21 bp, Artificial Sequence
  Synthetic
ttcacgttgacgaatccgaaa

SEQ ID NO: 2804 - DNA, 21 bp, Artificial Sequence
  Synthetic
tccgtgtataaaccgttcttg

SEQ ID NO: 2805 - DNA, 21 bp, Artificial Sequence
  Synthetic
aacgtatggtcagaacgcggc

SEQ ID NO: 2806 - DNA, 21 bp, Artificial Sequence
  Synthetic
tccaaatccgggtggatggcg

SEQ ID NO: 2807 - DNA, 21 bp, Artificial Sequence
  Synthetic
cccgacatcgcccgccaatac

SEQ ID NO: 2808 - DNA, 21 bp, Artificial Sequence
  Synthetic
tcagcctggggcgaccatcgc

SEQ ID NO: 2809 - DNA, 21 bp, Artificial Sequence
  Synthetic
ggcgacttttcagtaccccgc

SEQ ID NO: 2810 - DNA, 21 bp, Artificial Sequence
  Synthetic
acccatacctttaaggacgta

SEQ ID NO: 2811 - DNA, 21 bp, Artificial Sequence
  Synthetic
tgggatataaatgggccgaaa

SEQ ID NO: 2812 - DNA, 21 bp, Artificial Sequence
  Synthetic
cagacgaaattctccgatgtg

SEQ ID NO: 2813 - DNA, 21 bp, Artificial Sequence
  Synthetic
acgtattccgggtggccggcg

SEQ ID NO: 2814 - DNA, 21 bp, Artificial Sequence
  Synthetic
acctcaatgtcagtatcacgc

SEQ ID NO: 2815 - DNA, 21 bp, Artificial Sequence
  Synthetic
tcaaacgaccgccccttttac

SEQ ID NO: 2816 - DNA, 21 bp, Artificial Sequence
  Synthetic
tcagcctggggcgactacaag

SEQ ID NO: 2817 - DNA, 21 bp, Artificial Sequence
  Synthetic
aatacgtcctccacgtccagg

SEQ ID NO: 2818 - DNA, 21 bp, Artificial Sequence
  Synthetic
tccgcgtggggggatcacgtg

SEQ ID NO: 2819 - DNA, 21 bp, Artificial Sequence
  Synthetic
tatttggatcagtatttcacg

SEQ ID NO: 2820 - DNA, 21 bp, Artificial Sequence
  Synthetic
cccgacatcgcccgcgtatgg

SEQ ID NO: 2821 - DNA, 21 bp, Artificial Sequence
  Synthetic
cccatcatcgcctcaacctac

SEQ ID NO: 2822 - DNA, 21 bp, Artificial Sequence
  Synthetic
gccggccataagctgggctac

SEQ ID NO: 2823 - DNA, 21 bp, Artificial Sequence
  Synthetic
accaccatgcgcacctcacaa

SEQ ID NO: 2824 - DNA, 21 bp, Artificial Sequence
  Synthetic
caggcgaaattcaatgtgata

SEQ ID NO: 2825 - DNA, 21 bp, Artificial Sequence
  Synthetic
ccggatatagcgaggacgtat

SEQ ID NO: 2826 - DNA, 21 bp, Artificial Sequence
  Synthetic
ggctacaccatgcccttttca

SEQ ID NO: 2827 - DNA, 21 bp, Artificial Sequence
  Synthetic
ttgtatacgaatatgtccatg

SEQ ID NO: 2828 - DNA, 21 bp, Artificial Sequence
  Synthetic
gacgccatctttcgccaagcc

SEQ ID NO: 2829 - DNA, 21 bp, Artificial Sequence
  Synthetic
tcatcatggggcgaccataag

SEQ ID NO: 2830 - DNA, 21 bp, Artificial Sequence
  Synthetic
cccatcatcgcccgcgtatac

SEQ ID NO: 2831 - DNA, 21 bp, Artificial Sequence
  Synthetic
tcagcccaataccccatccgc

SEQ ID NO: 2832 - DNA, 21 bp, Artificial Sequence
  Synthetic
caactggaccgccccttttca

SEQ ID NO: 2833 - DNA, 21 bp, Artificial Sequence
  Synthetic
gataaaatagggttcacgccg

SEQ ID NO: 2834 - DNA, 21 bp, Artificial Sequence
  Synthetic
gtgggggtgaggatgggggtg

SEQ ID NO: 2835 - DNA, 21 bp, Artificial Sequence
  Synthetic
aggttgtccttcaaagatgtg

SEQ ID NO: 2836 - DNA, 21 bp, Artificial Sequence
  Synthetic
tccgcgtggggggatcacata

SEQ ID NO: 2837 - DNA, 21 bp, Artificial Sequence
  Synthetic
caaaccaactttaacgtaatg

SEQ ID NO: 2838 - DNA, 21 bp, Artificial Sequence
  Synthetic
gtgtatcacaattccgcgacg

SEQ ID NO: 2839 - DNA, 21 bp, Artificial Sequence
  Synthetic
ttcacgtccacgacgccgaaa

SEQ ID NO: 2840 - DNA, 21 bp, Artificial Sequence
  Synthetic
accctggaaaacgtatttaag

SEQ ID NO: 2841 - DNA, 21 bp, Artificial Sequence
  Synthetic
aagccctcatcaatgtcatgg

SEQ ID NO: 2842 - DNA, 21 bp, Artificial Sequence
  Synthetic
ccccaagaatttaagcatgta

SEQ ID NO: 2843 - DNA, 21 bp, Artificial Sequence
  Synthetic
gcgataaaattcgaggcgata

SEQ ID NO: 2844 - DNA, 21 bp, Artificial Sequence
  Synthetic
tcacaaaagaccccctttctg

SEQ ID NO: 2845 - DNA, 21 bp, Artificial Sequence
  Synthetic
tccgtgtccacgccgttcttg

SEQ ID NO: 2846 - DNA, 21 bp, Artificial Sequence
  Synthetic
tcccagttggggttccacccg

SEQ ID NO: 2847 - DNA, 21 bp, Artificial Sequence
  Synthetic
cagataaatttctccgtgcag

SEQ ID NO: 2848 - DNA, 21 bp, Artificial Sequence
  Synthetic
accgtaacctttaaggacgta

SEQ ID NO: 2849 - DNA, 21 bp, Artificial Sequence
  Synthetic
gtagacccccgccgcggcgta

SEQ ID NO: 2850 - DNA, 21 bp, Artificial Sequence
  Synthetic
tcccaccagttctccgtgata

SEQ ID NO: 2851 - DNA, 21 bp, Artificial Sequence
  Synthetic
aacgaccaacgcccctttctg

SEQ ID NO: 2852 - DNA, 21 bp, Artificial Sequence
  Synthetic
tcaatgtggggcgaccataag

SEQ ID NO: 2853 - DNA, 21 bp, Artificial Sequence
  Synthetic
ccggtgatagcgagggtgtat

SEQ ID NO: 2854 - DNA, 21 bp, Artificial Sequence
  Synthetic
accggctttaccccccccctg

SEQ ID NO: 2855 - DNA, 21 bp, Artificial Sequence
  Synthetic
tccgtgtccaaattcttcttg

SEQ ID NO: 2856 - DNA, 21 bp, Artificial Sequence
  Synthetic
tcacccgtaaacatctttgta

SEQ ID NO: 2857 - DNA, 21 bp, Artificial Sequence
  Synthetic
accatcacctttaagcaagta

SEQ ID NO: 2858 - DNA, 21 bp, Artificial Sequence
  Synthetic
tccgcgtggggggatcaccac

SEQ ID NO: 2859 - DNA, 21 bp, Artificial Sequence
  Synthetic
tcagcctggggcgacaccaag

SEQ ID NO: 2860 - DNA, 21 bp, Artificial Sequence
  Synthetic
acgaaatccgggtggatggcg

SEQ ID NO: 2861 - DNA, 21 bp, Artificial Sequence
  Synthetic
accgtacgctttaacaacgta

SEQ ID NO: 2862 - DNA, 21 bp, Artificial Sequence
  Synthetic
tttaccctgaccaccaccaag

SEQ ID NO: 2863 - DNA, 21 bp, Artificial Sequence
  Synthetic
tataatgataggccgttcata

SEQ ID NO: 2864 - DNA, 21 bp, Artificial Sequence
  Synthetic
tacaccctgaccacccccaag

SEQ ID NO: 2865 - DNA, 21 bp, Artificial Sequence
  Synthetic
cagaggatagcggatatgttc

SEQ ID NO: 2866 - DNA, 21 bp, Artificial Sequence
  Synthetic
tcagcctggggcccccataag

SEQ ID NO: 2867 - DNA, 21 bp, Artificial Sequence
  Synthetic
aatacgtggggggatataaaa

SEQ ID NO: 2868 - DNA, 21 bp, Artificial Sequence
  Synthetic
cccaacatcgtaaacaccttt

SEQ ID NO: 2869 - DNA, 21 bp, Artificial Sequence
  Synthetic
ccggatatagtgagggtgtat

SEQ ID NO: 2870 - DNA, 21 bp, Artificial Sequence
  Synthetic
tccgtgtggggggtgaatgcg

SEQ ID NO: 2871 - DNA, 21 bp, Artificial Sequence
  Synthetic
tcagtatcaaagccctttccc

SEQ ID NO: 2872 - DNA, 21 bp, Artificial Sequence
  Synthetic
tcaggcgaccgcccctttatc

SEQ ID NO: 2873 - DNA, 21 bp, Artificial Sequence
  Synthetic
gaagtaaagaacccctggctg

SEQ ID NO: 2874 - DNA, 21 bp, Artificial Sequence
  Synthetic
acgagggcgatgccgttcaat

SEQ ID NO: 2875 - DNA, 21 bp, Artificial Sequence
  Synthetic
tttaccctgaccaccccctac

SEQ ID NO: 2876 - DNA, 21 bp, Artificial Sequence
  Synthetic
acggtgacgttcaaagatgtg

SEQ ID NO: 2877 - DNA, 21 bp, Artificial Sequence
  Synthetic
aatgtgcagatgccgttcata

SEQ ID NO: 2878 - DNA, 21 bp, Artificial Sequence
  Synthetic
gagtcctccatatgggtggcg

SEQ ID NO: 2879 - DNA, 21 bp, Artificial Sequence
  Synthetic
gggcagtgggcgggggggggg

SEQ ID NO: 2880 - DNA, 21 bp, Artificial Sequence
  Synthetic
acgaggacgttcgagcacgtg

SEQ ID NO: 2881 - DNA, 21 bp, Artificial Sequence
  Synthetic
tccttcgcgaggatagggcag

SEQ ID NO: 2882 - DNA, 21 bp, Artificial Sequence
  Synthetic
cccgacatcgcccgctcatac

SEQ ID NO: 2883 - DNA, 21 bp, Artificial Sequence
  Synthetic
gacgtatttcgccccaccggc

SEQ ID NO: 2884 - DNA, 21 bp, Artificial Sequence
  Synthetic
tccaatgataggccgttctgg

SEQ ID NO: 2885 - DNA, 21 bp, Artificial Sequence
  Synthetic
accaagtcaaccccctttatc

SEQ ID NO: 2886 - DNA, 21 bp, Artificial Sequence
  Synthetic
tccatggtgttcgcgtccccg

SEQ ID NO: 2887 - DNA, 21 bp, Artificial Sequence
  Synthetic
caaaccgccctgcgcatggta

SEQ ID NO: 2888 - DNA, 21 bp, Artificial Sequence
  Synthetic
cccctgatcgcccgcgtatac

SEQ ID NO: 2889 - DNA, 21 bp, Artificial Sequence
  Synthetic
ggggcgtccgcgtggggggcg

SEQ ID NO: 2890 - DNA, 21 bp, Artificial Sequence
  Synthetic
tccccgtggggggcggcgtcc

SEQ ID NO: 2891 - DNA, 21 bp, Artificial Sequence
  Synthetic
accgtatggaacgaccgcggc

SEQ ID NO: 2892 - DNA, 21 bp, Artificial Sequence
  Synthetic
tttaccctgatcacccccaag

SEQ ID NO: 2893 - DNA, 21 bp, Artificial Sequence
  Synthetic
ttgatgccgaatccgttcggg

SEQ ID NO: 2894 - DNA, 21 bp, Artificial Sequence
  Synthetic
ttgcagacgcacgtgttcggg

SEQ ID NO: 2895 - DNA, 21 bp, Artificial Sequence
  Synthetic
tcacatcaattttcagtaatc

SEQ ID NO: 2896 - DNA, 21 bp, Artificial Sequence
  Synthetic
accgtatggcaagtagaaggc

SEQ ID NO: 2897 - DNA, 21 bp, Artificial Sequence
  Synthetic
acgataacgttcaaagcggtg

SEQ ID NO: 2898 - DNA, 21 bp, Artificial Sequence
  Synthetic
aacatgttttcagccaacctg

SEQ ID NO: 2899 - DNA, 21 bp, Artificial Sequence
  Synthetic
tccgcgtggggggtgcacaaa

SEQ ID NO: 2900 - DNA, 21 bp, Artificial Sequence
  Synthetic
gccatcaagtttgaagccatc

SEQ ID NO: 2901 - DNA, 21 bp, Artificial Sequence
  Synthetic
ggcggcgccaccccctttcgc

SEQ ID NO: 2902 - DNA, 21 bp, Artificial Sequence
  Synthetic
cagaaagattatgggatgtgg

SEQ ID NO: 2903 - DNA, 21 bp, Artificial Sequence
  Synthetic
ctgatgcccaacccctttggc

SEQ ID NO: 2904 - DNA, 21 bp, Artificial Sequence
  Synthetic
accgacatgaagtacctgtac

SEQ ID NO: 2905 - DNA, 21 bp, Artificial Sequence
  Synthetic
tccttgaaatccgtgttctcc

SEQ ID NO: 2906 - DNA, 21 bp, Artificial Sequence
  Synthetic
tcaaacgaccgcccctttcaa

SEQ ID NO: 2907 - DNA, 21 bp, Artificial Sequence
  Synthetic
tccggggataggccgttcata

SEQ ID NO: 2908 - DNA, 21 bp, Artificial Sequence
  Synthetic
accatcacctttaagtacgta

SEQ ID NO: 2909 - DNA, 21 bp, Artificial Sequence
  Synthetic
aggaatacgttctccaatgtg

SEQ ID NO: 2910 - DNA, 21 bp, Artificial Sequence
  Synthetic
caagccaagtttaacgtaatc

SEQ ID NO: 2911 - DNA, 21 bp, Artificial Sequence
  Synthetic
atgaacgtatcactgtacccc

SEQ ID NO: 2912 - DNA, 21 bp, Artificial Sequence
  Synthetic
gccctgcatgtaccctttaag

SEQ ID NO: 2913 - DNA, 21 bp, Artificial Sequence
  Synthetic
cccatgatcgcccgcgtatac

SEQ ID NO: 2914 - DNA, 21 bp, Artificial Sequence
  Synthetic
ttgccgaaatggacggagata

SEQ ID NO: 2915 - DNA, 21 bp, Artificial Sequence
  Synthetic
acggggttcacgccgccgttg

SEQ ID NO: 2916 - DNA, 21 bp, Artificial Sequence
  Synthetic
ctgtacaccaacatgtcaatg

SEQ ID NO: 2917 - DNA, 21 bp, Artificial Sequence
  Synthetic
tccaggtccgggtggatggcg

SEQ ID NO: 2918 - DNA, 21 bp, Artificial Sequence
  Synthetic
gcgcactggacgagggatggg

SEQ ID NO: 2919 - DNA, 21 bp, Artificial Sequence
  Synthetic
acgataacgttcaaaatggtg

SEQ ID NO: 2920 - DNA, 21 bp, Artificial Sequence
  Synthetic
gcccattggacccgcgacggc

SEQ ID NO: 2921 - DNA, 21 bp, Artificial Sequence
  Synthetic
tcagcctgggcctcaatgggc

SEQ ID NO: 2922 - DNA, 21 bp, Artificial Sequence
  Synthetic
tccataaaacagccgtggacg

SEQ ID NO: 2923 - DNA, 21 bp, Artificial Sequence
  Synthetic
accatcaccttttgcgacgta

SEQ ID NO: 2924 - DNA, 21 bp, Artificial Sequence
  Synthetic
tgggtagcccccaagatgtca

SEQ ID NO: 2925 - DNA, 21 bp, Artificial Sequence
  Synthetic
tcagcctggggcgaccatatc

SEQ ID NO: 2926 - DNA, 21 bp, Artificial Sequence
  Synthetic
tccaatgataggccgttccag

SEQ ID NO: 2927 - DNA, 21 bp, Artificial Sequence
  Synthetic
tccgtgtggaaaaatcagggg

SEQ ID NO: 2928 - DNA, 21 bp, Artificial Sequence
  Synthetic
ggctacacccaagtatactca

SEQ ID NO: 2929 - DNA, 21 bp, Artificial Sequence
  Synthetic
gacctgtggcgccccaacgac

SEQ ID NO: 2930 - DNA, 21 bp, Artificial Sequence
  Synthetic
acccgcctgggctgggtagcc

SEQ ID NO: 2931 - DNA, 21 bp, Artificial Sequence
  Synthetic
tcctcctggggggatcacaaa

SEQ ID NO: 2932 - DNA, 21 bp, Artificial Sequence
  Synthetic
aatgatttcgcgtccccgagg

SEQ ID NO: 2933 - DNA, 21 bp, Artificial Sequence
  Synthetic
tttaccctgaccggccccaag

SEQ ID NO: 2934 - DNA, 21 bp, Artificial Sequence
  Synthetic
cacagggattggccggggtcc

SEQ ID NO: 2935 - DNA, 21 bp, Artificial Sequence
  Synthetic
cgccccgtaaacgaatgggta

SEQ ID NO: 2936 - DNA, 21 bp, Artificial Sequence
  Synthetic
atggagaaagtgttcacggtg

SEQ ID NO: 2937 - DNA, 21 bp, Artificial Sequence
  Synthetic
tcagcctggggcgacaacaag

SEQ ID NO: 2938 - DNA, 21 bp, Artificial Sequence
  Synthetic
tccgcgtggggggatcactat

SEQ ID NO: 2939 - DNA, 21 bp, Artificial Sequence
  Synthetic
tttaccaacaccacccccaag

SEQ ID NO: 2940 - DNA, 21 bp, Artificial Sequence
  Synthetic
gataaaaatgggtgggtggcg

SEQ ID NO: 2941 - DNA, 21 bp, Artificial Sequence
  Synthetic
aatgatcagaggccgttcttg

SEQ ID NO: 2942 - DNA, 21 bp, Artificial Sequence
  Synthetic
aatacgatgaggacgtccaat

SEQ ID NO: 2943 - DNA, 21 bp, Artificial Sequence
  Synthetic
tgccgctcaaccaacggcatc

SEQ ID NO: 2944 - DNA, 21 bp, Artificial Sequence
  Synthetic
tcagtatcatacccctttctg

SEQ ID NO: 2945 - DNA, 21 bp, Artificial Sequence
  Synthetic
tcaaactaccgcccctttatc

SEQ ID NO: 2946 - DNA, 21 bp, Artificial Sequence
  Synthetic
tcactgtttcgcatcgacggc

SEQ ID NO: 2947 - DNA, 21 bp, Artificial Sequence
  Synthetic
aactcactgaccacctcagta

SEQ ID NO: 2948 - DNA, 21 bp, Artificial Sequence
  Synthetic
atggaaaaggtatttaccgta

SEQ ID NO: 2949 - DNA, 21 bp, Artificial Sequence
  Synthetic
atgtacaaggacttttcagta

SEQ ID NO: 2950 - DNA, 21 bp, Artificial Sequence
  Synthetic
tcaccctggggcgccgcctca

SEQ ID NO: 2951 - DNA, 21 bp, Artificial Sequence
  Synthetic
aatgcgtggggggatgtgttg

SEQ ID NO: 2952 - DNA, 21 bp, Artificial Sequence
  Synthetic
tgggacatcaacggccccaag

SEQ ID NO: 2953 - DNA, 21 bp, Artificial Sequence
  Synthetic
cccaagtggaacgaaaccaac

SEQ ID NO: 2954 - DNA, 21 bp, Artificial Sequence
  Synthetic
atgaatgtgtccttgtatccg

SEQ ID NO: 2955 - DNA, 21 bp, Artificial Sequence
  Synthetic
accttttttgccacccccccc

SEQ ID NO: 2956 - DNA, 21 bp, Artificial Sequence
  Synthetic
ttctccttgacgacgccgaaa

SEQ ID NO: 2957 - DNA, 21 bp, Artificial Sequence
  Synthetic
accgacctgaagcaatcacgc

SEQ ID NO: 2958 - DNA, 21 bp, Artificial Sequence
  Synthetic
agggaggagttcaggaatata

SEQ ID NO: 2959 - DNA, 21 bp, Artificial Sequence
  Synthetic
ggcgccgtaggctgggccgcc

SEQ ID NO: 2960 - DNA, 21 bp, Artificial Sequence
  Synthetic
aggatgttcaatccgccggag

SEQ ID NO: 2961 - DNA, 21 bp, Artificial Sequence
  Synthetic
tccgattggacggggaaaatg

SEQ ID NO: 2962 - DNA, 21 bp, Artificial Sequence
  Synthetic
caagacctgaagtacgtacgc

SEQ ID NO: 2963 - DNA, 21 bp, Artificial Sequence
  Synthetic
ttgtccaatgggtgggtgccg

SEQ ID NO: 2964 - DNA, 21 bp, Artificial Sequence
  Synthetic
tcagtatcaaacccctttctg

SEQ ID NO: 2965 - DNA, 21 bp, Artificial Sequence
  Synthetic
aaaccgtcctccatgtcctgg

SEQ ID NO: 2966 - DNA, 21 bp, Artificial Sequence
  Synthetic
gtaggcgtacgcatgggcgta

SEQ ID NO: 2967 - DNA, 21 bp, Artificial Sequence
  Synthetic
acccgcaccggctggatggcc

SEQ ID NO: 2968 - DNA, 21 bp, Artificial Sequence
  Synthetic
catcgcgactggcccggctca

SEQ ID NO: 2969 - DNA, 21 bp, Artificial Sequence
  Synthetic
atgtcagacaacttttacccc

SEQ ID NO: 2970 - DNA, 21 bp, Artificial Sequence
  Synthetic
tcctatttcggggagcagaat

SEQ ID NO: 2971 - DNA, 21 bp, Artificial Sequence
  Synthetic
tccgtgtccaatccgttcttg

SEQ ID NO: 2972 - DNA, 21 bp, Artificial Sequence
  Synthetic
tcagcctggggcgaccatcat

SEQ ID NO: 2973 - DNA, 21 bp, Artificial Sequence
  Synthetic
acgcacttcttgcagcagccg

SEQ ID NO: 2974 - DNA, 21 bp, Artificial Sequence
  Synthetic
ggcaacgaccgcccctttatc

SEQ ID NO: 2975 - DNA, 21 bp, Artificial Sequence
  Synthetic
aaagcggcgttcaataatata

SEQ ID NO: 2976 - DNA, 21 bp, Artificial Sequence
  Synthetic
acgaaatccacgccgttcata

SEQ ID NO: 2977 - DNA, 21 bp, Artificial Sequence
  Synthetic
tccgcgataaatttgaggtat

SEQ ID NO: 2978 - DNA, 21 bp, Artificial Sequence
  Synthetic
tccgcgtggggggattataaa

SEQ ID NO: 2979 - DNA, 21 bp, Artificial Sequence
  Synthetic
tccgtgaggaaaccgttcttg

SEQ ID NO: 2980 - DNA, 21 bp, Artificial Sequence
  Synthetic
gatgtgttcaggttgggggat

SEQ ID NO: 2981 - DNA, 21 bp, Artificial Sequence
  Synthetic
gggtatacgcaggtgtattcc

SEQ ID NO: 2982 - DNA, 21 bp, Artificial Sequence
  Synthetic
gagcactggacgaattccaaa

SEQ ID NO: 2983 - DNA, 21 bp, Artificial Sequence
  Synthetic
gacaagaacggctgggtagcc

SEQ ID NO: 2984 - DNA, 21 bp, Artificial Sequence
  Synthetic
gacgcctggggcgaccataag

SEQ ID NO: 2985 - DNA, 21 bp, Artificial Sequence
  Synthetic
gacggcaactggtcagccctg

SEQ ID NO: 2986 - DNA, 21 bp, Artificial Sequence
  Synthetic
ttcacgttgacggatccgaaa

SEQ ID NO: 2987 - DNA, 21 bp, Artificial Sequence
  Synthetic
tccgtgtcctccccgttcttg

SEQ ID NO: 2988 - DNA, 21 bp, Artificial Sequence
  Synthetic
caaaccaagttttcagacgta

SEQ ID NO: 2989 - DNA, 21 bp, Artificial Sequence
  Synthetic
tcccagaatttcaaagcgccg

SEQ ID NO: 2990 - DNA, 21 bp, Artificial Sequence
  Synthetic
acgacgatgacggagtccagg

SEQ ID NO: 2991 - DNA, 21 bp, Artificial Sequence
  Synthetic
accaccatgaccgaatcacgc

SEQ ID NO: 2992 - DNA, 21 bp, Artificial Sequence
  Synthetic
gataaacagaaaccgttcttg

SEQ ID NO: 2993 - DNA, 21 bp, Artificial Sequence
  Synthetic
aacatctggtcaaccaacggc

SEQ ID NO: 2994 - DNA, 21 bp, Artificial Sequence
  Synthetic
aaggccgcctttaacaacatc

SEQ ID NO: 2995 - DNA, 21 bp, Artificial Sequence
  Synthetic
ttcacgttgtatacgccgaaa

SEQ ID NO: 2996 - DNA, 21 bp, Artificial Sequence
  Synthetic
cgcatgtttaacccccccgaa

SEQ ID NO: 2997 - DNA, 21 bp, Artificial Sequence
  Synthetic
accatcacctttaaggccgta

SEQ ID NO: 2998 - DNA, 21 bp, Artificial Sequence
  Synthetic
gaggggaggaggataggggat

SEQ ID NO: 2999 - DNA, 21 bp, Artificial Sequence
  Synthetic
tccaatttcaggccgttcata

SEQ ID NO: 3000 - DNA, 21 bp, Artificial Sequence
  Synthetic
gtagtaggctggcatcgcgaa

SEQ ID NO: 3001 - DNA, 21 bp, Artificial Sequence
  Synthetic
gcgggggggtggggggcgccg

SEQ ID NO: 3002 - DNA, 21 bp, Artificial Sequence
  Synthetic
atgacgatgtccacgtccgtg

SEQ ID NO: 3003 - DNA, 21 bp, Artificial Sequence
  Synthetic
tacctgaacgtatttgtaggc

SEQ ID NO: 3004 - DNA, 21 bp, Artificial Sequence
  Synthetic
ctggccaagctgaacaagaac

SEQ ID NO: 3005 - DNA, 21 bp, Artificial Sequence
  Synthetic
tcagtatcaaccccctttctg

SEQ ID NO: 3006 - DNA, 21 bp, Artificial Sequence
  Synthetic
gaggtgtccaaaccgttcttg

SEQ ID NO: 3007 - DNA, 21 bp, Artificial Sequence
  Synthetic
ccggatataataagggtgtat

SEQ ID NO: 3008 - DNA, 21 bp, Artificial Sequence
  Synthetic
acggtgtggcaggtggagggg

SEQ ID NO: 3009 - DNA, 21 bp, Artificial Sequence
  Synthetic
tccgcgtgggggtcccacaaa

SEQ ID NO: 3010 - DNA, 21 bp, Artificial Sequence
  Synthetic
gccggctcatttaaggacatc

SEQ ID NO: 3011 - DNA, 21 bp, Artificial Sequence
  Synthetic
tccgattccaaaccgttcttg

SEQ ID NO: 3012 - DNA, 21 bp, Artificial Sequence
  Synthetic
caaaaccccggctggctgccc

SEQ ID NO: 3013 - DNA, 21 bp, Artificial Sequence
  Synthetic
tgggagaatttcaaatccgtg

SEQ ID NO: 3014 - DNA, 21 bp, Artificial Sequence
  Synthetic
tccttgttcaggatagatggg

SEQ ID NO: 3015 - DNA, 21 bp, Artificial Sequence
  Synthetic
gacaagcaaaagccctttctg

SEQ ID NO: 3016 - DNA, 21 bp, Artificial Sequence
  Synthetic
atgaccatgtcaacctcagta

SEQ ID NO: 3017 - DNA, 21 bp, Artificial Sequence
  Synthetic
acgttgacgttcaaagatgtg

SEQ ID NO: 3018 - DNA, 21 bp, Artificial Sequence
  Synthetic
tcagcctggggcgacgacaag

SEQ ID NO: 3019 - DNA, 21 bp, Artificial Sequence
  Synthetic
tccgcgtggggggatgataaa

SEQ ID NO: 3020 - DNA, 21 bp, Artificial Sequence
  Synthetic
gtaacccaatttcataacatc

SEQ ID NO: 3021 - DNA, 21 bp, Artificial Sequence
  Synthetic
gggaatgataggccgttcata

SEQ ID NO: 3022 - DNA, 21 bp, Artificial Sequence
  Synthetic
aacgcctggtcactggccggc

SEQ ID NO: 3023 - DNA, 21 bp, Artificial Sequence
  Synthetic
tcatgggaccgcccctttatc

SEQ ID NO: 3024 - DNA, 21 bp, Artificial Sequence
  Synthetic
tcacaaatctcaatgtacaag

SEQ ID NO: 3025 - DNA, 21 bp, Artificial Sequence
  Synthetic
tccgtgtccgcgccgttcttg

SEQ ID NO: 3026 - DNA, 21 bp, Artificial Sequence
  Synthetic
aacccccgctgggacaacccc

SEQ ID NO: 3027 - DNA, 21 bp, Artificial Sequence
  Synthetic
accgtaaacatcccctttcaa

SEQ ID NO: 3028 - DNA, 21 bp, Artificial Sequence
  Synthetic
tccgtgtggtccgagcacggg

SEQ ID NO: 3029 - DNA, 21 bp, Artificial Sequence
  Synthetic
acccgcacctttgaacatgta

SEQ ID NO: 3030 - DNA, 21 bp, Artificial Sequence
  Synthetic
acctttcccggctggcccgcc

SEQ ID NO: 3031 - DNA, 21 bp, Artificial Sequence
  Synthetic
ctgtcaaacggctgggtaccc

SEQ ID NO: 3032 - DNA, 21 bp, Artificial Sequence
  Synthetic
ggggatttctccgtgccgagg

SEQ ID NO: 3033 - DNA, 21 bp, Artificial Sequence
  Synthetic
aacaccatgtcacaatcaaag

SEQ ID NO: 3034 - DNA, 21 bp, Artificial Sequence
  Synthetic
tgggtggcgccgaaaatgtcc

SEQ ID NO: 3035 - DNA, 21 bp, Artificial Sequence
  Synthetic
tcagtatgggccctgaacggc

SEQ ID NO: 3036 - DNA, 21 bp, Artificial Sequence
  Synthetic
cgcgaagaatttcgcaacatc

SEQ ID NO: 3037 - DNA, 21 bp, Artificial Sequence
  Synthetic
cccatcacctttaaggacgta

SEQ ID NO: 3038 - DNA, 21 bp, Artificial Sequence
  Synthetic
gaaaagcaaggctgggtagcc

SEQ ID NO: 3039 - DNA, 21 bp, Artificial Sequence
  Synthetic
ttcaatttgacgacgccgaaa

SEQ ID NO: 3040 - DNA, 21 bp, Artificial Sequence
  Synthetic
ctggccaagtgcggcctgaac

SEQ ID NO: 3041 - DNA, 21 bp, Artificial Sequence
  Synthetic
ttcgggttggcggcgtccagg

SEQ ID NO: 3042 - DNA, 21 bp, Artificial Sequence
  Synthetic
aattccttgacgacgtccgtg

SEQ ID NO: 3043 - DNA, 21 bp, Artificial Sequence
  Synthetic
ggcggcctgcccatgatcccc

SEQ ID NO: 3044 - DNA, 21 bp, Artificial Sequence
  Synthetic
ccgccgacgaatatatccagg

SEQ ID NO: 3045 - DNA, 21 bp, Artificial Sequence
  Synthetic
tgggaacgcctgggcgacgta

SEQ ID NO: 3046 - DNA, 21 bp, Artificial Sequence
  Synthetic
aaccaaacctcaatctacaag

SEQ ID NO: 3047 - DNA, 21 bp, Artificial Sequence
  Synthetic
ccgacgaatgcggtgtcctgg

SEQ ID NO: 3048 - DNA, 21 bp, Artificial Sequence
  Synthetic
tggaccctgaccacccccaag

SEQ ID NO: 3049 - DNA, 21 bp, Artificial Sequence
  Synthetic
ttcacgttgacgacgccgtgg

SEQ ID NO: 3050 - DNA, 21 bp, Artificial Sequence
  Synthetic
acgaaatccttcgcgcagata

SEQ ID NO: 3051 - DNA, 21 bp, Artificial Sequence
  Synthetic
caaaaggactacggcatgtgg

SEQ ID NO: 3052 - DNA, 21 bp, Artificial Sequence
  Synthetic
tcagtatggaagaaccaaggc

SEQ ID NO: 3053 - DNA, 21 bp, Artificial Sequence
  Synthetic
acgatgacgttcaaagatgtg

SEQ ID NO: 3054 - DNA, 21 bp, Artificial Sequence
  Synthetic
accgcctggcgcgaagacggc

SEQ ID NO: 3055 - DNA, 21 bp, Artificial Sequence
  Synthetic
aatacgacgaaaacgtccgtg

SEQ ID NO: 3056 - DNA, 21 bp, Artificial Sequence
  Synthetic
tcagcctggggctcacataag

SEQ ID NO: 3057 - DNA, 21 bp, Artificial Sequence
  Synthetic
gcggggcacaaattggggtat

SEQ ID NO: 3058 - DNA, 21 bp, Artificial Sequence
  Synthetic
acctcaaactttgcccaaatc

SEQ ID NO: 3059 - DNA, 21 bp, Artificial Sequence
  Synthetic
atgtcagtacgctttaccccc

SEQ ID NO: 3060 - DNA, 21 bp, Artificial Sequence
  Synthetic
gagaaacaggggtgggtggcg

SEQ ID NO: 3061 - DNA, 21 bp, Artificial Sequence
  Synthetic
gatcagtggaggccgtccggg

SEQ ID NO: 3062 - DNA, 21 bp, Artificial Sequence
  Synthetic
tttcaagacaagcattggctg

SEQ ID NO: 3063 - DNA, 21 bp, Artificial Sequence
  Synthetic
tccgcgtggggggatgagaaa

SEQ ID NO: 3064 - DNA, 21 bp, Artificial Sequence
  Synthetic
aggatattcacggagccgccg

SEQ ID NO: 3065 - DNA, 21 bp, Artificial Sequence
  Synthetic
tcagcctggggcgaccatcaa

SEQ ID NO: 3066 - DNA, 21 bp, Artificial Sequence
  Synthetic
ttcacgaatacgacgccgaaa

SEQ ID NO: 3067 - DNA, 21 bp, Artificial Sequence
  Synthetic
atgaggaatgatttcataccg

SEQ ID NO: 3068 - DNA, 21 bp, Artificial Sequence
  Synthetic
gccgaaaagtttgaacatgta

SEQ ID NO: 3069 - DNA, 21 bp, Artificial Sequence
  Synthetic
cagacgtccttcagggagata

SEQ ID NO: 3070 - DNA, 21 bp, Artificial Sequence
  Synthetic
aatacgttgagggagtccata

SEQ ID NO: 3071 - DNA, 21 bp, Artificial Sequence
  Synthetic
gacctgttttcagacaagcgc

SEQ ID NO: 3072 - DNA, 21 bp, Artificial Sequence
  Synthetic
tcagcctggtcagaaaagatg

SEQ ID NO: 3073 - DNA, 21 bp, Artificial Sequence
  Synthetic
tccgcgacgaattggggggcg

SEQ ID NO: 3074 - DNA, 21 bp, Artificial Sequence
  Synthetic
caacgcatcgccgacatgttt

SEQ ID NO: 3075 - DNA, 21 bp, Artificial Sequence
  Synthetic
gccggcgtacgcctgggctac

SEQ ID NO: 3076 - DNA, 21 bp, Artificial Sequence
  Synthetic
aatatgtatcacttgacgggg

SEQ ID NO: 3077 - DNA, 21 bp, Artificial Sequence
  Synthetic
aacatgtggtcagccaacggc

SEQ ID NO: 3078 - DNA, 21 bp, Artificial Sequence
  Synthetic
gtgtggatagcgcaggcgcag

SEQ ID NO: 3079 - DNA, 21 bp, Artificial Sequence
  Synthetic
aaaacggagttcgcgagggtg

SEQ ID NO: 3080 - DNA, 21 bp, Artificial Sequence
  Synthetic
atgtccgtgaggttcacgccg

SEQ ID NO: 3081 - DNA, 21 bp, Artificial Sequence
  Synthetic
ctgaacaccccctttctgccc

SEQ ID NO: 3082 - DNA, 21 bp, Artificial Sequence
  Synthetic
accaccgaccgcacctcaaag

SEQ ID NO: 3083 - DNA, 21 bp, Artificial Sequence
  Synthetic
ctgcccaagtggaccgaaatc

SEQ ID NO: 3084 - DNA, 21 bp, Artificial Sequence
  Synthetic
tccgtgtccaaaccgttcttg

SEQ ID NO: 3085 - DNA, 21 bp, Artificial Sequence
  Synthetic
tcagtatcaaagccctttctg

SEQ ID NO: 3086 - DNA, 21 bp, Artificial Sequence
  Synthetic
ttcacgttgacgacgccgaaa

SEQ ID NO: 3087 - DNA, 21 bp, Artificial Sequence
  Synthetic
tttaccctgaccacccccaag

SEQ ID NO: 3088 - protein, 7 aa, Artificial Sequence
  Synthetic
SLDRPFI

SEQ ID NO: 3089 - protein, 7 aa, Artificial Sequence
  Synthetic
SVLKPFL

SEQ ID NO: 3090 - protein, 7 aa, Artificial Sequence
  Synthetic
TLTSPFR

SEQ ID NO: 3091 - protein, 7 aa, Artificial Sequence
  Synthetic
SPSKPFL

SEQ ID NO: 3092 - protein, 7 aa, Artificial Sequence
  Synthetic
SISKPFL

SEQ ID NO: 3093 - protein, 7 aa, Artificial Sequence
  Synthetic
SVIKPFL

SEQ ID NO: 3094 - protein, 7 aa, Artificial Sequence
  Synthetic
TLTSPFR

SEQ ID NO: 3095 - protein, 7 aa, Artificial Sequence
  Synthetic
SLSKPFL

SEQ ID NO: 3096 - protein, 7 aa, Artificial Sequence
  Synthetic
SVSRPFL

SEQ ID NO: 3097 - protein, 7 aa, Artificial Sequence
  Synthetic
TSMKPFL

SEQ ID NO: 3098 - protein, 7 aa, Artificial Sequence
  Synthetic
SVMKPFL

SEQ ID NO: 3099 - protein, 7 aa, Artificial Sequence
  Synthetic
TVSKPFL

SEQ ID NO: 3100 - protein, 7 aa, Artificial Sequence
  Synthetic
SASKPFL

SEQ ID NO: 3101 - protein, 7 aa, Artificial Sequence
  Synthetic
SVGKPFL

SEQ ID NO: 3102 - protein, 7 aa, Artificial Sequence
  Synthetic
TVSKPFL

SEQ ID NO: 3103 - protein, 7 aa, Artificial Sequence
  Synthetic
TSMKPFL

SEQ ID NO: 3104 - protein, 7 aa, Artificial Sequence
  Synthetic
TLAYPFK

SEQ ID NO: 3105 - protein, 7 aa, Artificial Sequence
  Synthetic
SVAKPFL

SEQ ID NO: 3106 - protein, 7 aa, Artificial Sequence
  Synthetic
SVSRPFL

SEQ ID NO: 3107 - protein, 7 aa, Artificial Sequence
  Synthetic
SLSKPFL

SEQ ID NO: 3108 - protein, 7 aa, Artificial Sequence
  Synthetic
GSFVPPR

SEQ ID NO: 3109 - protein, 7 aa, Artificial Sequence
  Synthetic
FTLTYPK

SEQ ID NO: 3110 - protein, 7 aa, Artificial Sequence
  Synthetic
SASKPFL

SEQ ID NO: 3111 - protein, 7 aa, Artificial Sequence
  Synthetic
SVSKPFI

SEQ ID NO: 3112 - protein, 7 aa, Artificial Sequence
  Synthetic
SLDRPFI

SEQ ID NO: 3113 - protein, 7 aa, Artificial Sequence
  Synthetic
STSKPFL

SEQ ID NO: 3114 - protein, 7 aa, Artificial Sequence
  Synthetic
LVSKPFL

SEQ ID NO: 3115 - protein, 7 aa, Artificial Sequence
  Synthetic
SISKPFL

SEQ ID NO: 3116 - protein, 7 aa, Artificial Sequence
  Synthetic
SVHKPFL

SEQ ID NO: 3117 - protein, 7 aa, Artificial Sequence
  Synthetic
FTLTSPK

SEQ ID NO: 3118 - protein, 7 aa, Artificial Sequence
  Synthetic
SVVKPFL

SEQ ID NO: 3119 - protein, 7 aa, Artificial Sequence
  Synthetic
FTQTTPK

SEQ ID NO: 3120 - protein, 7 aa, Artificial Sequence
  Synthetic
SVNKPFL

SEQ ID NO: 3121 - protein, 7 aa, Artificial Sequence
  Synthetic
SVQKPFL

SEQ ID NO: 3122 - protein, 7 aa, Artificial Sequence
  Synthetic
SVDRPFI

SEQ ID NO: 3123 - protein, 7 aa, Artificial Sequence
  Synthetic
SPSKPFL

SEQ ID NO: 3124 - protein, 7 aa, Artificial Sequence
  Synthetic
GVDRPFK

SEQ ID NO: 3125 - protein, 7 aa, Artificial Sequence
  Synthetic
FTLTTSK

SEQ ID NO: 3126 - protein, 7 aa, Artificial Sequence
  Synthetic
SQSKPFL

SEQ ID NO: 3127 - protein, 7 aa, Artificial Sequence
  Synthetic
SVLKPFL

SEQ ID NO: 3128 - protein, 7 aa, Artificial Sequence
  Synthetic
YVSKPFL

SEQ ID NO: 3129 - protein, 7 aa, Artificial Sequence
  Synthetic
SVSKPFI

SEQ ID NO: 3130 - protein, 7 aa, Artificial Sequence
  Synthetic
SVFKPFL

SEQ ID NO: 3131 - protein, 7 aa, Artificial Sequence
  Synthetic
STSKPFL

SEQ ID NO: 3132 - protein, 7 aa, Artificial Sequence
  Synthetic
FTAQYPK

SEQ ID NO: 3133 - protein, 7 aa, Artificial Sequence
  Synthetic
FTLTHPK

SEQ ID NO: 3134 - protein, 7 aa, Artificial Sequence
  Synthetic
SYDRPFI

SEQ ID NO: 3135 - protein, 7 aa, Artificial Sequence
  Synthetic
SQSKPFL

SEQ ID NO: 3136 - protein, 7 aa, Artificial Sequence
  Synthetic
SMDRPFI

SEQ ID NO: 3137 - protein, 7 aa, Artificial Sequence
  Synthetic
FTMTTPK

SEQ ID NO: 3138 - protein, 7 aa, Artificial Sequence
  Synthetic
SVAKPFL

SEQ ID NO: 3139 - protein, 7 aa, Artificial Sequence
  Synthetic
SIDRPFI

SEQ ID NO: 3140 - protein, 7 aa, Artificial Sequence
  Synthetic
SSSKPFL

SEQ ID NO: 3141 - protein, 7 aa, Artificial Sequence
  Synthetic
SFDRPFI

SEQ ID NO: 3142 - protein, 7 aa, Artificial Sequence
  Synthetic
FTLVTPK

SEQ ID NO: 3143 - protein, 7 aa, Artificial Sequence
  Synthetic
SVMKPFL

SEQ ID NO: 3144 - protein, 7 aa, Artificial Sequence
  Synthetic
SVEKPFL

SEQ ID NO: 3145 - protein, 7 aa, Artificial Sequence
  Synthetic
SIARPFV

SEQ ID NO: 3146 - protein, 7 aa, Artificial Sequence
  Synthetic
ASKFSSI

SEQ ID NO: 3147 - protein, 7 aa, Artificial Sequence
  Synthetic
SHSKPFL

SEQ ID NO: 3148 - protein, 7 aa, Artificial Sequence
  Synthetic
SHDRPFI

SEQ ID NO: 3149 - protein, 7 aa, Artificial Sequence
  Synthetic
SVGKPFL

SEQ ID NO: 3150 - protein, 7 aa, Artificial Sequence
  Synthetic
FTLTTGK

SEQ ID NO: 3151 - protein, 7 aa, Artificial Sequence
  Synthetic
IVSKPFL

SEQ ID NO: 3152 - protein, 7 aa, Artificial Sequence
  Synthetic
STDRPFI

SEQ ID NO: 3153 - protein, 7 aa, Artificial Sequence
  Synthetic
FTLDTPK

SEQ ID NO: 3154 - protein, 7 aa, Artificial Sequence
  Synthetic
SIARPFV

SEQ ID NO: 3155 - protein, 7 aa, Artificial Sequence
  Synthetic
SVTKPFL

SEQ ID NO: 3156 - protein, 7 aa, Artificial Sequence
  Synthetic
SVIKPFL

SEQ ID NO: 3157 - protein, 7 aa, Artificial Sequence
  Synthetic
SIDRPFI

SEQ ID NO: 3158 - protein, 7 aa, Artificial Sequence
  Synthetic
FTMTTPK

SEQ ID NO: 3159 - protein, 7 aa, Artificial Sequence
  Synthetic
FTLSTPK

SEQ ID NO: 3160 - protein, 7 aa, Artificial Sequence
  Synthetic
SSSKPFL

SEQ ID NO: 3161 - protein, 7 aa, Artificial Sequence
  Synthetic
FTITTPK

SEQ ID NO: 3162 - protein, 7 aa, Artificial Sequence
  Synthetic
FTLSTPK

SEQ ID NO: 3163 - protein, 7 aa, Artificial Sequence
  Synthetic
SMSKPFL

SEQ ID NO: 3164 - protein, 7 aa, Artificial Sequence
  Synthetic
SVSKPFQ

SEQ ID NO: 3165 - protein, 7 aa, Artificial Sequence
  Synthetic
MVSKPFL

SEQ ID NO: 3166 - protein, 7 aa, Artificial Sequence
  Synthetic
SVHKPFL

SEQ ID NO: 3167 - protein, 7 aa, Artificial Sequence
  Synthetic
SVSKPFN

SEQ ID NO: 3168 - protein, 7 aa, Artificial Sequence
  Synthetic
FTLTHPK

SEQ ID NO: 3169 - protein, 7 aa, Artificial Sequence
  Synthetic
SVDKPFL

SEQ ID NO: 3170 - protein, 7 aa, Artificial Sequence
  Synthetic
YVSKPFL

SEQ ID NO: 3171 - protein, 7 aa, Artificial Sequence
  Synthetic
SVRKPFL

SEQ ID NO: 3172 - protein, 7 aa, Artificial Sequence
  Synthetic
SQDRPFI

SEQ ID NO: 3173 - protein, 7 aa, Artificial Sequence
  Synthetic
SVSKPFV

SEQ ID NO: 3174 - protein, 7 aa, Artificial Sequence
  Synthetic
SAWGDAK

SEQ ID NO: 3175 - protein, 7 aa, Artificial Sequence
  Synthetic
SNIRPFI

SEQ ID NO: 3176 - protein, 7 aa, Artificial Sequence
  Synthetic
SGSKPFL

SEQ ID NO: 3177 - protein, 7 aa, Artificial Sequence
  Synthetic
GSFVPPR

SEQ ID NO: 3178 - protein, 7 aa, Artificial Sequence
  Synthetic
NVSKPFL

SEQ ID NO: 3179 - protein, 7 aa, Artificial Sequence
  Synthetic
AVSKPFL

SEQ ID NO: 3180 - protein, 7 aa, Artificial Sequence
  Synthetic
TNDRPFI

SEQ ID NO: 3181 - protein, 7 aa, Artificial Sequence
  Synthetic
SVNKPFL

SEQ ID NO: 3182 - protein, 7 aa, Artificial Sequence
  Synthetic
SKDRPFI

SEQ ID NO: 3183 - protein, 7 aa, Artificial Sequence
  Synthetic
QVSKPFL

SEQ ID NO: 3184 - protein, 7 aa, Artificial Sequence
  Synthetic
SVSKPFS

SEQ ID NO: 3185 - protein, 7 aa, Artificial Sequence
  Synthetic
SVDKPFL

SEQ ID NO: 3186 - protein, 7 aa, Artificial Sequence
  Synthetic
QSNFGKF

SEQ ID NO: 3187 - protein, 7 aa, Artificial Sequence
  Synthetic
SVSKPFY

SEQ ID NO: 3188 - protein, 7 aa, Artificial Sequence
  Synthetic
NVSKPFL

SEQ ID NO: 3189 - protein, 7 aa, Artificial Sequence
  Synthetic
FTLTVPK

SEQ ID NO: 3190 - protein, 7 aa, Artificial Sequence
  Synthetic
MMAKPFL

SEQ ID NO: 3191 - protein, 7 aa, Artificial Sequence
  Synthetic
LSNGWVP

SEQ ID NO: 3192 - protein, 7 aa, Artificial Sequence
  Synthetic
SYDRPFI

SEQ ID NO: 3193 - protein, 7 aa, Artificial Sequence
  Synthetic
FTLTVPK

SEQ ID NO: 3194 - protein, 7 aa, Artificial Sequence
  Synthetic
FTLTSPK

SEQ ID NO: 3195 - protein, 7 aa, Artificial Sequence
  Synthetic
FTFTTPK

SEQ ID NO: 3196 - protein, 7 aa, Artificial Sequence
  Synthetic
SVSKPFL

SEQ ID NO: 3197 - protein, 7 aa, Artificial Sequence
  Synthetic
SVSKPFL

SEQ ID NO: 3198 - protein, 7 aa, Artificial Sequence
  Synthetic
FTLTTPK

SEQ ID NO: 3199 - protein, 7 aa, Artificial Sequence
  Synthetic
FTLTTPK

SEQ ID NO: 3200 - DNA, 21 bp, Artificial Sequence
  Synthetic
tcactggaccgcccctttatc

SEQ ID NO: 3201 - DNA, 21 bp, Artificial Sequence
  Synthetic
tcagtactgaagccctttctg

SEQ ID NO: 3202 - DNA, 21 bp, Artificial Sequence
  Synthetic
accctgacctcaccctttcgc

SEQ ID NO: 3203 - DNA, 21 bp, Artificial Sequence
  Synthetic
tccccgtccaaaccgttcttg

SEQ ID NO: 3204 - DNA, 21 bp, Artificial Sequence
  Synthetic
tccatatccaaaccgttcttg

SEQ ID NO: 3205 - DNA, 21 bp, Artificial Sequence
  Synthetic
tcagtaatcaagccctttctg

SEQ ID NO: 3206 - DNA, 21 bp, Artificial Sequence
  Synthetic
acgttgacgtccccgttcagg

SEQ ID NO: 3207 - DNA, 21 bp, Artificial Sequence
  Synthetic
tccttgtccaaaccgttcttg

SEQ ID NO: 3208 - DNA, 21 bp, Artificial Sequence
  Synthetic
tccgtgtccaggccgttcttg

SEQ ID NO: 3209 - DNA, 21 bp, Artificial Sequence
  Synthetic
acgtccatgaaaccgttcttg

SEQ ID NO: 3210 - DNA, 21 bp, Artificial Sequence
  Synthetic
tccgtgatgaaaccgttcttg

SEQ ID NO: 3211 - DNA, 21 bp, Artificial Sequence
  Synthetic
acggtgtccaaaccgttcttg

SEQ ID NO: 3212 - DNA, 21 bp, Artificial Sequence
  Synthetic
tcagcctcaaagccctttctg

SEQ ID NO: 3213 - DNA, 21 bp, Artificial Sequence
  Synthetic
tccgtggggaaaccgttcttg

SEQ ID NO: 3214 - DNA, 21 bp, Artificial Sequence
  Synthetic
accgtatcaaagccctttctg

SEQ ID NO: 3215 - DNA, 21 bp, Artificial Sequence
  Synthetic
acctcaatgaagccctttctg

SEQ ID NO: 3216 - DNA, 21 bp, Artificial Sequence
  Synthetic
acgttggcgtatccgttcaaa

SEQ ID NO: 3217 - DNA, 21 bp, Artificial Sequence
  Synthetic
tcagtagccaagccctttctg

SEQ ID NO: 3218 - DNA, 21 bp, Artificial Sequence
  Synthetic
tcagtatcacgcccctttctg

SEQ ID NO: 3219 - DNA, 21 bp, Artificial Sequence
  Synthetic
tcactgtcaaagccctttctg

SEQ ID NO: 3220 - DNA, 21 bp, Artificial Sequence
  Synthetic
ggctcatttgtacccccccgc

SEQ ID NO: 3221 - DNA, 21 bp, Artificial Sequence
  Synthetic
ttcacgttgacgtatccgaaa

SEQ ID NO: 3222 - DNA, 21 bp, Artificial Sequence
  Synthetic
tccgcgtccaaaccgttcttg

SEQ ID NO: 3223 - DNA, 21 bp, Artificial Sequence
  Synthetic
tccgtgtccaaaccgttcata

SEQ ID NO: 3224 - DNA, 21 bp, Artificial Sequence
  Synthetic
tccttggataggccgttcata

SEQ ID NO: 3225 - DNA, 21 bp, Artificial Sequence
  Synthetic
tccacgtccaaaccgttcttg

SEQ ID NO: 3226 - DNA, 21 bp, Artificial Sequence
  Synthetic
ctggtatcaaagccctttctg

SEQ ID NO: 3227 - DNA, 21 bp, Artificial Sequence
  Synthetic
tcaatctcaaagccctttctg

SEQ ID NO: 3228 - DNA, 21 bp, Artificial Sequence
  Synthetic
tccgtgcacaaaccgttcttg

SEQ ID NO: 3229 - DNA, 21 bp, Artificial Sequence
  Synthetic
ttcacgttgacgtccccgaaa

SEQ ID NO: 3230 - DNA, 21 bp, Artificial Sequence
  Synthetic
tcagtagtaaagccctttctg

SEQ ID NO: 3231 - DNA, 21 bp, Artificial Sequence
  Synthetic
tttacccaaaccacccccaag

SEQ ID NO: 3232 - DNA, 21 bp, Artificial Sequence
  Synthetic
tcagtaaacaagccctttctg

SEQ ID NO: 3233 - DNA, 21 bp, Artificial Sequence
  Synthetic
tcagtacaaaagccctttctg

SEQ ID NO: 3234 - DNA, 21 bp, Artificial Sequence
  Synthetic
tcagtagaccgcccctttatc

SEQ ID NO: 3235 - DNA, 21 bp, Artificial Sequence
  Synthetic
tcaccctcaaagccctttctg

SEQ ID NO: 3236 - DNA, 21 bp, Artificial Sequence
  Synthetic
ggggtggataggccgttcaaa

SEQ ID NO: 3237 - DNA, 21 bp, Artificial Sequence
  Synthetic
tttaccctgaccacctcaaag

SEQ ID NO: 3238 - DNA, 21 bp, Artificial Sequence
  Synthetic
tcccagtccaaaccgttcttg

SEQ ID NO: 3239 - DNA, 21 bp, Artificial Sequence
  Synthetic
tccgtgttgaaaccgttcttg

SEQ ID NO: 3240 - DNA, 21 bp, Artificial Sequence
  Synthetic
tacgtatcaaagccctttctg

SEQ ID NO: 3241 - DNA, 21 bp, Artificial Sequence
  Synthetic
tcagtatcaaagccctttatc

SEQ ID NO: 3242 - DNA, 21 bp, Artificial Sequence
  Synthetic
tccgtgttcaaaccgttcttg

SEQ ID NO: 3243 - DNA, 21 bp, Artificial Sequence
  Synthetic
tcaacctcaaagccctttctg

SEQ ID NO: 3244 - DNA, 21 bp, Artificial Sequence
  Synthetic
ttcacggcgcagtatccgaaa

SEQ ID NO: 3245 - DNA, 21 bp, Artificial Sequence
  Synthetic
ttcacgttgacgcacccgaaa

SEQ ID NO: 3246 - DNA, 21 bp, Artificial Sequence
  Synthetic
tcatacgaccgcccctttatc

SEQ ID NO: 3247 - DNA, 21 bp, Artificial Sequence
  Synthetic
tcacaatcaaagccctttctg

SEQ ID NO: 3248 - DNA, 21 bp, Artificial Sequence
  Synthetic
tcaatggaccgcccctttatc

SEQ ID NO: 3249 - DNA, 21 bp, Artificial Sequence
  Synthetic
ttcacgatgacgacgccgaaa

SEQ ID NO: 3250 - DNA, 21 bp, Artificial Sequence
  Synthetic
tccgtggcgaaaccgttcttg

SEQ ID NO: 3251 - DNA, 21 bp, Artificial Sequence
  Synthetic
tcaatcgaccgcccctttatc

SEQ ID NO: 3252 - DNA, 21 bp, Artificial Sequence
  Synthetic
tcatcatcaaagccctttctg

SEQ ID NO: 3253 - DNA, 21 bp, Artificial Sequence
  Synthetic
tccttcgataggccgttcata

SEQ ID NO: 3254 - DNA, 21 bp, Artificial Sequence
  Synthetic
ttcacgttggtgacgccgaaa

SEQ ID NO: 3255 - DNA, 21 bp, Artificial Sequence
  Synthetic
tcagtaatgaagccctttctg

SEQ ID NO: 3256 - DNA, 21 bp, Artificial Sequence
  Synthetic
tccgtggagaaaccgttcttg

SEQ ID NO: 3257 - DNA, 21 bp, Artificial Sequence
  Synthetic
tcaatcgcccgcccctttgta

SEQ ID NO: 3258 - DNA, 21 bp, Artificial Sequence
  Synthetic
gcctcaaagttttcatcaatc

SEQ ID NO: 3259 - DNA, 21 bp, Artificial Sequence
  Synthetic
tcccactccaaaccgttcttg

SEQ ID NO: 3260 - DNA, 21 bp, Artificial Sequence
  Synthetic
tcacatgaccgcccctttatc

SEQ ID NO: 3261 - DNA, 21 bp, Artificial Sequence
  Synthetic
tcagtaggcaagccctttctg

SEQ ID NO: 3262 - DNA, 21 bp, Artificial Sequence
  Synthetic
ttcacgttgacgacggggaaa

SEQ ID NO: 3263 - DNA, 21 bp, Artificial Sequence
  Synthetic
atcgtatcaaagccctttctg

SEQ ID NO: 3264 - DNA, 21 bp, Artificial Sequence
  Synthetic
tcaaccgaccgcccctttatc

SEQ ID NO: 3265 - DNA, 21 bp, Artificial Sequence
  Synthetic
tttaccctggacacccccaag

SEQ ID NO: 3266 - DNA, 21 bp, Artificial Sequence
  Synthetic
tccatagcgaggccgttcgtg

SEQ ID NO: 3267 - DNA, 21 bp, Artificial Sequence
  Synthetic
tccgtgacgaaaccgttcttg

SEQ ID NO: 3268 - DNA, 21 bp, Artificial Sequence
  Synthetic
tccgtgataaaaccgttcttg

SEQ ID NO: 3269 - DNA, 21 bp, Artificial Sequence
  Synthetic
tccatagataggccgttcata

SEQ ID NO: 3270 - DNA, 21 bp, Artificial Sequence
  Synthetic
tttaccatgaccacccccaag

SEQ ID NO: 3271 - DNA, 21 bp, Artificial Sequence
  Synthetic
tttaccctgtcaacccccaag

SEQ ID NO: 3272 - DNA, 21 bp, Artificial Sequence
  Synthetic
tcctcctccaaaccgttcttg

SEQ ID NO: 3273 - DNA, 21 bp, Artificial Sequence
  Synthetic
tttaccatcaccacccccaag

SEQ ID NO: 3274 - DNA, 21 bp, Artificial Sequence
  Synthetic
ttcacgttgtccacgccgaaa

SEQ ID NO: 3275 - DNA, 21 bp, Artificial Sequence
  Synthetic
tcaatgtcaaagccctttctg

SEQ ID NO: 3276 - DNA, 21 bp, Artificial Sequence
  Synthetic
tccgtgtccaaaccgttccag

SEQ ID NO: 3277 - DNA, 21 bp, Artificial Sequence
  Synthetic
atggtgtccaaaccgttcttg

SEQ ID NO: 3278 - DNA, 21 bp, Artificial Sequence
  Synthetic
tcagtacataagccctttctg

SEQ ID NO: 3279 - DNA, 21 bp, Artificial Sequence
  Synthetic
tccgtgtccaaaccgttcaat

SEQ ID NO: 3280 - DNA, 21 bp, Artificial Sequence
  Synthetic
tttaccctgacccatcccaag

SEQ ID NO: 3281 - DNA, 21 bp, Artificial Sequence
  Synthetic
tccgtggataaaccgttcttg

SEQ ID NO: 3282 - DNA, 21 bp, Artificial Sequence
  Synthetic
tatgtgtccaaaccgttcttg

SEQ ID NO: 3283 - DNA, 21 bp, Artificial Sequence
  Synthetic
tccgtgaggaaaccgttcttg

SEQ ID NO: 3284 - DNA, 21 bp, Artificial Sequence
  Synthetic
tcacaagaccgcccctttatc

SEQ ID NO: 3285 - DNA, 21 bp, Artificial Sequence
  Synthetic
tccgtgtccaaaccgttcgtg

SEQ ID NO: 3286 - DNA, 21 bp, Artificial Sequence
  Synthetic
tcagcctggggcgacgccaag

SEQ ID NO: 3287 - DNA, 21 bp, Artificial Sequence
  Synthetic
tccaatataaggccgttcata

SEQ ID NO: 3288 - DNA, 21 bp, Artificial Sequence
  Synthetic
tccgggtccaaaccgttcttg

SEQ ID NO: 3289 - DNA, 21 bp, Artificial Sequence
  Synthetic
gggtccttcgtgccgccgagg

SEQ ID NO: 3290 - DNA, 21 bp, Artificial Sequence
  Synthetic
aacgtatcaaagccctttctg

SEQ ID NO: 3291 - DNA, 21 bp, Artificial Sequence
  Synthetic
gcggtgtccaaaccgttcttg

SEQ ID NO: 3292 - DNA, 21 bp, Artificial Sequence
  Synthetic
acgaatgataggccgttcata

SEQ ID NO: 3293 - DNA, 21 bp, Artificial Sequence
  Synthetic
tccgtgaataaaccgttcttg

SEQ ID NO: 3294 - DNA, 21 bp, Artificial Sequence
  Synthetic
tcaaaggaccgcccctttatc

SEQ ID NO: 3295 - DNA, 21 bp, Artificial Sequence
  Synthetic
caagtatcaaagccctttctg

SEQ ID NO: 3296 - DNA, 21 bp, Artificial Sequence
  Synthetic
tccgtgtccaaaccgttctcc

SEQ ID NO: 3297 - DNA, 21 bp, Artificial Sequence
  Synthetic
tcagtagacaagccctttctg

SEQ ID NO: 3298 - DNA, 21 bp, Artificial Sequence
  Synthetic
cagtccaatttcgggaaattc

SEQ ID NO: 3299 - DNA, 21 bp, Artificial Sequence
  Synthetic
tccgtgtccaaaccgttctat

SEQ ID NO: 3300 - DNA, 21 bp, Artificial Sequence
  Synthetic
aatgtgtccaaaccgttcttg

SEQ ID NO: 3301 - DNA, 21 bp, Artificial Sequence
  Synthetic
ttcacgttgacggtgccgaaa

SEQ ID NO: 3302 - DNA, 21 bp, Artificial Sequence
  Synthetic
atgatggcgaaaccgttcttg

SEQ ID NO: 3303 - DNA, 21 bp, Artificial Sequence
  Synthetic
ttgtccaatgggtgggtgccg

SEQ ID NO: 3304 - DNA, 21 bp, Artificial Sequence
  Synthetic
tcctatgataggccgttcata

SEQ ID NO: 3305 - DNA, 21 bp, Artificial Sequence
  Synthetic
tttaccctgaccgtacccaag

SEQ ID NO: 3306 - DNA, 21 bp, Artificial Sequence
  Synthetic
tttaccctgacctcacccaag

SEQ ID NO: 3307 - DNA, 21 bp, Artificial Sequence
  Synthetic
ttcacgttcacgacgccgaaa

SEQ ID NO: 3308 - DNA, 21 bp, Artificial Sequence
  Synthetic
tccgtgtccaaaccgttcttg

SEQ ID NO: 3309 - DNA, 21 bp, Artificial Sequence
  Synthetic
tcagtatcaaagccctttctg

SEQ ID NO: 3310 - DNA, 21 bp, Artificial Sequence
  Synthetic
ttcacgttgacgacgccgaaa

SEQ ID NO: 3311 - DNA, 21 bp, Artificial Sequence
  Synthetic
tttaccctgaccacccccaag

SEQ ID NO: 3312 - protein, 7 aa, Artificial Sequence
  Synthetic
ALDRPFI

SEQ ID NO: 3313 - protein, 7 aa, Artificial Sequence
  Synthetic
ELFLSGR

SEQ ID NO: 3314 - protein, 7 aa, Artificial Sequence
  Synthetic
LTLTTSV

SEQ ID NO: 3315 - protein, 7 aa, Artificial Sequence
  Synthetic
LTMTTSV

SEQ ID NO: 3316 - protein, 7 aa, Artificial Sequence
  Synthetic
YIFDGGG

SEQ ID NO: 3317 - protein, 7 aa, Artificial Sequence
  Synthetic
SSVFREV

SEQ ID NO: 3318 - protein, 7 aa, Artificial Sequence
  Synthetic
TPQRPFI

SEQ ID NO: 3319 - protein, 7 aa, Artificial Sequence
  Synthetic
WGAASQF

SEQ ID NO: 3320 - protein, 7 aa, Artificial Sequence
  Synthetic
VGVPLGH

SEQ ID NO: 3321 - protein, 7 aa, Artificial Sequence
  Synthetic
SVDKPFL

SEQ ID NO: 3322 - protein, 7 aa, Artificial Sequence
  Synthetic
FVSGGPY

SEQ ID NO: 3323 - protein, 7 aa, Artificial Sequence
  Synthetic
GTFLPPS

SEQ ID NO: 3324 - protein, 7 aa, Artificial Sequence
  Synthetic
SIGKPFI

SEQ ID NO: 3325 - protein, 7 aa, Artificial Sequence
  Synthetic
GALGWAP

SEQ ID NO: 3326 - protein, 7 aa, Artificial Sequence
  Synthetic
SAARPFT

SEQ ID NO: 3327 - protein, 7 aa, Artificial Sequence
  Synthetic
NKLGWVA

SEQ ID NO: 3328 - protein, 7 aa, Artificial Sequence
  Synthetic
WTGEYPR

SEQ ID NO: 3329 - protein, 7 aa, Artificial Sequence
  Synthetic
QLRFVEV

SEQ ID NO: 3330 - protein, 7 aa, Artificial Sequence
  Synthetic
GLWESGG

SEQ ID NO: 3331 - protein, 7 aa, Artificial Sequence
  Synthetic
PSSSTSW

SEQ ID NO: 3332 - protein, 7 aa, Artificial Sequence
  Synthetic
HVKFEAI

SEQ ID NO: 3333 - protein, 7 aa, Artificial Sequence
  Synthetic
TVWREGG

SEQ ID NO: 3334 - protein, 7 aa, Artificial Sequence
  Synthetic
TSGRPFV

SEQ ID NO: 3335 - protein, 7 aa, Artificial Sequence
  Synthetic
GKQGFVA

SEQ ID NO: 3336 - protein, 7 aa, Artificial Sequence
  Synthetic
AGVALGR

SEQ ID NO: 3337 - protein, 7 aa, Artificial Sequence
  Synthetic
HAVGWTA

SEQ ID NO: 3338 - protein, 7 aa, Artificial Sequence
  Synthetic
SPSLPFR

SEQ ID NO: 3339 - protein, 7 aa, Artificial Sequence
  Synthetic
VGRPLGV

SEQ ID NO: 3340 - protein, 7 aa, Artificial Sequence
  Synthetic
SARFEFV

SEQ ID NO: 3341 - protein, 7 aa, Artificial Sequence
  Synthetic
SDVMPFR

SEQ ID NO: 3342 - protein, 7 aa, Artificial Sequence
  Synthetic
GALGFIA

SEQ ID NO: 3343 - protein, 7 aa, Artificial Sequence
  Synthetic
TVWRNEG

SEQ ID NO: 3344 - protein, 7 aa, Artificial Sequence
  Synthetic
PVSSSSW

SEQ ID NO: 3345 - protein, 7 aa, Artificial Sequence
  Synthetic
SSAGWVA

SEQ ID NO: 3346 - protein, 7 aa, Artificial Sequence
  Synthetic
VGISPPR

SEQ ID NO: 3347 - protein, 7 aa, Artificial Sequence
  Synthetic
LGRALGQ

SEQ ID NO: 3348 - protein, 7 aa, Artificial Sequence
  Synthetic
VGRPLGA

SEQ ID NO: 3349 - protein, 7 aa, Artificial Sequence
  Synthetic
DAWRRDG

SEQ ID NO: 3350 - protein, 7 aa, Artificial Sequence
  Synthetic
GALGFIA

SEQ ID NO: 3351 - protein, 7 aa, Artificial Sequence
  Synthetic
TPGTPWL

SEQ ID NO: 3352 - protein, 7 aa, Artificial Sequence
  Synthetic
YDQHLFR

SEQ ID NO: 3353 - protein, 7 aa, Artificial Sequence
  Synthetic
EGRALGL

SEQ ID NO: 3354 - protein, 7 aa, Artificial Sequence
  Synthetic
LEFHPPR

SEQ ID NO: 3355 - protein, 7 aa, Artificial Sequence
  Synthetic
LGRALGL

SEQ ID NO: 3356 - protein, 7 aa, Artificial Sequence
  Synthetic
SQSRPFQ

SEQ ID NO: 3357 - protein, 7 aa, Artificial Sequence
  Synthetic
AGCGVVC

SEQ ID NO: 3358 - protein, 7 aa, Artificial Sequence
  Synthetic
SKTGWAP

SEQ ID NO: 3359 - protein, 7 aa, Artificial Sequence
  Synthetic
TPASPFL

SEQ ID NO: 3360 - protein, 7 aa, Artificial Sequence
  Synthetic
AAFSPPK

SEQ ID NO: 3361 - protein, 7 aa, Artificial Sequence
  Synthetic
SEKYGIF

SEQ ID NO: 3362 - protein, 7 aa, Artificial Sequence
  Synthetic
GIGRPFT

SEQ ID NO: 3363 - protein, 7 aa, Artificial Sequence
  Synthetic
DWRGEQY

SEQ ID NO: 3364 - protein, 7 aa, Artificial Sequence
  Synthetic
YGHMPFS

SEQ ID NO: 3365 - protein, 7 aa, Artificial Sequence
  Synthetic
SRVGWVA

SEQ ID NO: 3366 - protein, 7 aa, Artificial Sequence
  Synthetic
TKAQPFL

SEQ ID NO: 3367 - protein, 7 aa, Artificial Sequence
  Synthetic
SPTMVFK

SEQ ID NO: 3368 - protein, 7 aa, Artificial Sequence
  Synthetic
TSKLPFF

SEQ ID NO: 3369 - protein, 7 aa, Artificial Sequence
  Synthetic
TLRFESI

SEQ ID NO: 3370 - protein, 7 aa, Artificial Sequence
  Synthetic
EGFAPPK

SEQ ID NO: 3371 - protein, 7 aa, Artificial Sequence
  Synthetic
VTLSTSK

SEQ ID NO: 3372 - protein, 7 aa, Artificial Sequence
  Synthetic
TQRFENI

SEQ ID NO: 3373 - protein, 7 aa, Artificial Sequence
  Synthetic
WTDVGPR

SEQ ID NO: 3374 - protein, 7 aa, Artificial Sequence
  Synthetic
TSTHWTP

SEQ ID NO: 3375 - protein, 7 aa, Artificial Sequence
  Synthetic
WASGGPY

SEQ ID NO: 3376 - protein, 7 aa, Artificial Sequence
  Synthetic
TTLQTSR

SEQ ID NO: 3377 - protein, 7 aa, Artificial Sequence
  Synthetic
TNMTVSR

SEQ ID NO: 3378 - protein, 7 aa, Artificial Sequence
  Synthetic
SILGFVA

SEQ ID NO: 3379 - protein, 7 aa, Artificial Sequence
  Synthetic
APVGWTA

SEQ ID NO: 3380 - protein, 7 aa, Artificial Sequence
  Synthetic
TLAKPFH

SEQ ID NO: 3381 - protein, 7 aa, Artificial Sequence
  Synthetic
TVWRSDG

SEQ ID NO: 3382 - protein, 7 aa, Artificial Sequence
  Synthetic
QKTFTNM

SEQ ID NO: 3383 - protein, 7 aa, Artificial Sequence
  Synthetic
GRLPIVP

SEQ ID NO: 3384 - protein, 7 aa, Artificial Sequence
  Synthetic
PVMTSSW

SEQ ID NO: 3385 - protein, 7 aa, Artificial Sequence
  Synthetic
SALGFIA

SEQ ID NO: 3386 - protein, 7 aa, Artificial Sequence
  Synthetic
DLHKPWI

SEQ ID NO: 3387 - protein, 7 aa, Artificial Sequence
  Synthetic
NTLATAR

SEQ ID NO: 3388 - protein, 7 aa, Artificial Sequence
  Synthetic
LTIRTSI

SEQ ID NO: 3389 - protein, 7 aa, Artificial Sequence
  Synthetic
GQWQPPS

SEQ ID NO: 3390 - protein, 7 aa, Artificial Sequence
  Synthetic
PLIATRI

SEQ ID NO: 3391 - protein, 7 aa, Artificial Sequence
  Synthetic
ENMPWAK

SEQ ID NO: 3392 - protein, 7 aa, Artificial Sequence
  Synthetic
IVTKPFL

SEQ ID NO: 3393 - protein, 7 aa, Artificial Sequence
  Synthetic
LGVQLGK

SEQ ID NO: 3394 - protein, 7 aa, Artificial Sequence
  Synthetic
ADIGWAA

SEQ ID NO: 3395 - protein, 7 aa, Artificial Sequence
  Synthetic
GMWSPPE

SEQ ID NO: 3396 - protein, 7 aa, Artificial Sequence
  Synthetic
GVDRPFL

SEQ ID NO: 3397 - protein, 7 aa, Artificial Sequence
  Synthetic
SVDNPFR

SEQ ID NO: 3398 - protein, 7 aa, Artificial Sequence
  Synthetic
SIDKPFY

SEQ ID NO: 3399 - protein, 7 aa, Artificial Sequence
  Synthetic
YEDRLWH

SEQ ID NO: 3400 - protein, 7 aa, Artificial Sequence
  Synthetic
TLKTPFI

SEQ ID NO: 3401 - protein, 7 aa, Artificial Sequence
  Synthetic
QSRFADI

SEQ ID NO: 3402 - protein, 7 aa, Artificial Sequence
  Synthetic
LNLKTSI

SEQ ID NO: 3403 - protein, 7 aa, Artificial Sequence
  Synthetic
DGLWPHG

SEQ ID NO: 3404 - protein, 7 aa, Artificial Sequence
  Synthetic
TGSKPFL

SEQ ID NO: 3405 - protein, 7 aa, Artificial Sequence
  Synthetic
TRDRPFI

SEQ ID NO: 3406 - protein, 7 aa, Artificial Sequence
  Synthetic
GPQMPFR

SEQ ID NO: 3407 - protein, 7 aa, Artificial Sequence
  Synthetic
VGIRLGL

SEQ ID NO: 3408 - protein, 7 aa, Artificial Sequence
  Synthetic
GVFSPPP

SEQ ID NO: 3409 - protein, 7 aa, Artificial Sequence
  Synthetic
LGVQLGR

SEQ ID NO: 3410 - protein, 7 aa, Artificial Sequence
  Synthetic
NLTRPFI

SEQ ID NO: 3411 - protein, 7 aa, Artificial Sequence
  Synthetic
PSSSHTW

SEQ ID NO: 3412 - protein, 7 aa, Artificial Sequence
  Synthetic
SVWRELG

SEQ ID NO: 3413 - protein, 7 aa, Artificial Sequence
  Synthetic
STERPWL

SEQ ID NO: 3414 - protein, 7 aa, Artificial Sequence
  Synthetic
IEFAPPR

SEQ ID NO: 3415 - protein, 7 aa, Artificial Sequence
  Synthetic
LTLQTSI

SEQ ID NO: 3416 - protein, 7 aa, Artificial Sequence
  Synthetic
DFARPFL

SEQ ID NO: 3417 - protein, 7 aa, Artificial Sequence
  Synthetic
KSEWGSY

SEQ ID NO: 3418 - protein, 7 aa, Artificial Sequence
  Synthetic
LGIALGK

SEQ ID NO: 3419 - protein, 7 aa, Artificial Sequence
  Synthetic
SAMTTSW

SEQ ID NO: 3420 - protein, 7 aa, Artificial Sequence
  Synthetic
SSIGWSA

SEQ ID NO: 3421 - protein, 7 aa, Artificial Sequence
  Synthetic
WPPNLTM

SEQ ID NO: 3422 - protein, 7 aa, Artificial Sequence
  Synthetic
GIFDGGG

SEQ ID NO: 3423 - protein, 7 aa, Artificial Sequence
  Synthetic
SAETPFR

SEQ ID NO: 3424 - protein, 7 aa, Artificial Sequence
  Synthetic
AVYFEKV

SEQ ID NO: 3425 - protein, 7 aa, Artificial Sequence
  Synthetic
IASRPFL

SEQ ID NO: 3426 - protein, 7 aa, Artificial Sequence
  Synthetic
SGEFCKQ

SEQ ID NO: 3427 - protein, 7 aa, Artificial Sequence
  Synthetic
LLNRPFA

SEQ ID NO: 3428 - protein, 7 aa, Artificial Sequence
  Synthetic
PVSSSTW

SEQ ID NO: 3429 - protein, 7 aa, Artificial Sequence
  Synthetic
LKVNGYP

SEQ ID NO: 3430 - protein, 7 aa, Artificial Sequence
  Synthetic
STTTPFR

SEQ ID NO: 3431 - protein, 7 aa, Artificial Sequence
  Synthetic
TTGRPFV

SEQ ID NO: 3432 - protein, 7 aa, Artificial Sequence
  Synthetic
VGMRLGY

SEQ ID NO: 3433 - protein, 7 aa, Artificial Sequence
  Synthetic
TSIGFIA

SEQ ID NO: 3434 - protein, 7 aa, Artificial Sequence
  Synthetic
GIVGWVP

SEQ ID NO: 3435 - protein, 7 aa, Artificial Sequence
  Synthetic
DISHVFR

SEQ ID NO: 3436 - protein, 7 aa, Artificial Sequence
  Synthetic
VGRPLGS

SEQ ID NO: 3437 - protein, 7 aa, Artificial Sequence
  Synthetic
SPLKPFL

SEQ ID NO: 3438 - protein, 7 aa, Artificial Sequence
  Synthetic
VPTNTSW

SEQ ID NO: 3439 - protein, 7 aa, Artificial Sequence
  Synthetic
RTFSPPS

SEQ ID NO: 3440 - protein, 7 aa, Artificial Sequence
  Synthetic
SSIGWTP

SEQ ID NO: 3441 - protein, 7 aa, Artificial Sequence
  Synthetic
SGARPFI

SEQ ID NO: 3442 - protein, 7 aa, Artificial Sequence
  Synthetic
VGTPWVA

SEQ ID NO: 3443 - protein, 7 aa, Artificial Sequence
  Synthetic
VEFSPPR

SEQ ID NO: 3444 - protein, 7 aa, Artificial Sequence
  Synthetic
TLWRTEG

SEQ ID NO: 3445 - protein, 7 aa, Artificial Sequence
  Synthetic
TLARPFA

SEQ ID NO: 3446 - protein, 7 aa, Artificial Sequence
  Synthetic
AALGWAA

SEQ ID NO: 3447 - protein, 7 aa, Artificial Sequence
  Synthetic
DPFRLQG

SEQ ID NO: 3448 - protein, 7 aa, Artificial Sequence
  Synthetic
GSFLPPS

SEQ ID NO: 3449 - protein, 7 aa, Artificial Sequence
  Synthetic
HSSGWVA

SEQ ID NO: 3450 - protein, 7 aa, Artificial Sequence
  Synthetic
PPIAQSL

SEQ ID NO: 3451 - protein, 7 aa, Artificial Sequence
  Synthetic
NAFGPHL

SEQ ID NO: 3452 - protein, 7 aa, Artificial Sequence
  Synthetic
LDPIPFK

SEQ ID NO: 3453 - protein, 7 aa, Artificial Sequence
  Synthetic
WTKLGSV

SEQ ID NO: 3454 - protein, 7 aa, Artificial Sequence
  Synthetic
ATFTPPK

SEQ ID NO: 3455 - protein, 7 aa, Artificial Sequence
  Synthetic
SRQGWAP

SEQ ID NO: 3456 - protein, 7 aa, Artificial Sequence
  Synthetic
QVRFSGI

SEQ ID NO: 3457 - protein, 7 aa, Artificial Sequence
  Synthetic
PRIAMAL

SEQ ID NO: 3458 - protein, 7 aa, Artificial Sequence
  Synthetic
TMTSPFR

SEQ ID NO: 3459 - protein, 7 aa, Artificial Sequence
  Synthetic
PAIASKL

SEQ ID NO: 3460 - protein, 7 aa, Artificial Sequence
  Synthetic
SNLFHNV

SEQ ID NO: 3461 - protein, 7 aa, Artificial Sequence
  Synthetic
PLLGTRL

SEQ ID NO: 3462 - protein, 7 aa, Artificial Sequence
  Synthetic
FRDRPFI

SEQ ID NO: 3463 - protein, 7 aa, Artificial Sequence
  Synthetic
TREKPFQ

SEQ ID NO: 3464 - protein, 7 aa, Artificial Sequence
  Synthetic
YGASPFH

SEQ ID NO: 3465 - protein, 7 aa, Artificial Sequence
  Synthetic
TSSTPFR

SEQ ID NO: 3466 - protein, 7 aa, Artificial Sequence
  Synthetic
IPGWYER

SEQ ID NO: 3467 - protein, 7 aa, Artificial Sequence
  Synthetic
VSNMPFR

SEQ ID NO: 3468 - protein, 7 aa, Artificial Sequence
  Synthetic
AISRTSW

SEQ ID NO: 3469 - protein, 7 aa, Artificial Sequence
  Synthetic
SIARPFS

SEQ ID NO: 3470 - protein, 7 aa, Artificial Sequence
  Synthetic
GEFGFVP

SEQ ID NO: 3471 - protein, 7 aa, Artificial Sequence
  Synthetic
MPVIPTP

SEQ ID NO: 3472 - protein, 7 aa, Artificial Sequence
  Synthetic
VGKPLGY

SEQ ID NO: 3473 - protein, 7 aa, Artificial Sequence
  Synthetic
TMKQPFI

SEQ ID NO: 3474 - protein, 7 aa, Artificial Sequence
  Synthetic
QREFCAL

SEQ ID NO: 3475 - protein, 7 aa, Artificial Sequence
  Synthetic
YLEKLFQ

SEQ ID NO: 3476 - protein, 7 aa, Artificial Sequence
  Synthetic
VGRPLGA

SEQ ID NO: 3477 - protein, 7 aa, Artificial Sequence
  Synthetic
GSFSPPA

SEQ ID NO: 3478 - protein, 7 aa, Artificial Sequence
  Synthetic
FTLNSSR

SEQ ID NO: 3479 - protein, 7 aa, Artificial Sequence
  Synthetic
DMFHLSG

SEQ ID NO: 3480 - protein, 7 aa, Artificial Sequence
  Synthetic
SAVFSQV

SEQ ID NO: 3481 - protein, 7 aa, Artificial Sequence
  Synthetic
GTMGWAP

SEQ ID NO: 3482 - protein, 7 aa, Artificial Sequence
  Synthetic
LLSAPFR

SEQ ID NO: 3483 - protein, 7 aa, Artificial Sequence
  Synthetic
SPKGWAP

SEQ ID NO: 3484 - protein, 7 aa, Artificial Sequence
  Synthetic
TKDWPFQ

SEQ ID NO: 3485 - protein, 7 aa, Artificial Sequence
  Synthetic
LGRALGM

SEQ ID NO: 3486 - protein, 7 aa, Artificial Sequence
  Synthetic
LGVALGM

SEQ ID NO: 3487 - protein, 7 aa, Artificial Sequence
  Synthetic
RTGWPGA

SEQ ID NO: 3488 - protein, 7 aa, Artificial Sequence
  Synthetic
GAGFFSE

SEQ ID NO: 3489 - protein, 7 aa, Artificial Sequence
  Synthetic
NVWQVAG

SEQ ID NO: 3490 - protein, 7 aa, Artificial Sequence
  Synthetic
FTLKEPK

SEQ ID NO: 3491 - protein, 7 aa, Artificial Sequence
  Synthetic
CPPGWCG

SEQ ID NO: 3492 - protein, 7 aa, Artificial Sequence
  Synthetic
TMEYMLG

SEQ ID NO: 3493 - protein, 7 aa, Artificial Sequence
  Synthetic
KASFASI

SEQ ID NO: 3494 - protein, 7 aa, Artificial Sequence
  Synthetic
SLAHPFH

SEQ ID NO: 3495 - protein, 7 aa, Artificial Sequence
  Synthetic
SAVFKHV

SEQ ID NO: 3496 - protein, 7 aa, Artificial Sequence
  Synthetic
LGRALGH

SEQ ID NO: 3497 - protein, 7 aa, Artificial Sequence
  Synthetic
SLNVPFR

SEQ ID NO: 3498 - protein, 7 aa, Artificial Sequence
  Synthetic
NIWYPTG

SEQ ID NO: 3499 - protein, 7 aa, Artificial Sequence
  Synthetic
LGRALGH

SEQ ID NO: 3500 - protein, 7 aa, Artificial Sequence
  Synthetic
KVQFKDV

SEQ ID NO: 3501 - protein, 7 aa, Artificial Sequence
  Synthetic
RVKFESV

SEQ ID NO: 3502 - protein, 7 aa, Artificial Sequence
  Synthetic
LSFTPPQ

SEQ ID NO: 3503 - protein, 7 aa, Artificial Sequence
  Synthetic
SKQFASV

SEQ ID NO: 3504 - protein, 7 aa, Artificial Sequence
  Synthetic
GLTRPFT

SEQ ID NO: 3505 - protein, 7 aa, Artificial Sequence
  Synthetic
AVEFKNV

SEQ ID NO: 3506 - protein, 7 aa, Artificial Sequence
  Synthetic
GAFAPPQ

SEQ ID NO: 3507 - protein, 7 aa, Artificial Sequence
  Synthetic
HPLWGDV

SEQ ID NO: 3508 - protein, 7 aa, Artificial Sequence
  Synthetic
GIAKPFL

SEQ ID NO: 3509 - protein, 7 aa, Artificial Sequence
  Synthetic
FGLKLAI

SEQ ID NO: 3510 - protein, 7 aa, Artificial Sequence
  Synthetic
VGRPLGA

SEQ ID NO: 3511 - protein, 7 aa, Artificial Sequence
  Synthetic
VGANPFV

SEQ ID NO: 3512 - protein, 7 aa, Artificial Sequence
  Synthetic
GWGSYGG

SEQ ID NO: 3513 - protein, 7 aa, Artificial Sequence
  Synthetic
CLPALGC

SEQ ID NO: 3514 - protein, 7 aa, Artificial Sequence
  Synthetic
SSSRPFM

SEQ ID NO: 3515 - protein, 7 aa, Artificial Sequence
  Synthetic
SSRFESV

SEQ ID NO: 3516 - protein, 7 aa, Artificial Sequence
  Synthetic
NAIGWVA

SEQ ID NO: 3517 - protein, 7 aa, Artificial Sequence
  Synthetic
TVARPFI

SEQ ID NO: 3518 - protein, 7 aa, Artificial Sequence
  Synthetic
VLGSSRL

SEQ ID NO: 3519 - protein, 7 aa, Artificial Sequence
  Synthetic
SRSFSNV

SEQ ID NO: 3520 - protein, 7 aa, Artificial Sequence
  Synthetic
PEMRHSW

SEQ ID NO: 3521 - protein, 7 aa, Artificial Sequence
  Synthetic
YGTSPFS

SEQ ID NO: 3522 - protein, 7 aa, Artificial Sequence
  Synthetic
GRFYPPE

SEQ ID NO: 3523 - protein, 7 aa, Artificial Sequence
  Synthetic
SKSFSMI

SEQ ID NO: 3524 - protein, 7 aa, Artificial Sequence
  Synthetic
SRVFAEV

SEQ ID NO: 3525 - protein, 7 aa, Artificial Sequence
  Synthetic
TVTAPWH

SEQ ID NO: 3526 - protein, 7 aa, Artificial Sequence
  Synthetic
DTSRPFL

SEQ ID NO: 3527 - protein, 7 aa, Artificial Sequence
  Synthetic
VGRPLGF

SEQ ID NO: 3528 - protein, 7 aa, Artificial Sequence
  Synthetic
SPIGWSP

SEQ ID NO: 3529 - protein, 7 aa, Artificial Sequence
  Synthetic
PQNHVSW

SEQ ID NO: 3530 - protein, 7 aa, Artificial Sequence
  Synthetic
MNSSFRP

SEQ ID NO: 3531 - protein, 7 aa, Artificial Sequence
  Synthetic
SPQHTSW

SEQ ID NO: 3532 - protein, 7 aa, Artificial Sequence
  Synthetic
SVWRELG

SEQ ID NO: 3533 - protein, 7 aa, Artificial Sequence
  Synthetic
SVVFREV

SEQ ID NO: 3534 - protein, 7 aa, Artificial Sequence
  Synthetic
RDFATLH

SEQ ID NO: 3535 - protein, 7 aa, Artificial Sequence
  Synthetic
SLTKPFN

SEQ ID NO: 3536 - protein, 7 aa, Artificial Sequence
  Synthetic
VGKPLGT

SEQ ID NO: 3537 - protein, 7 aa, Artificial Sequence
  Synthetic
TAASPFR

SEQ ID NO: 3538 - protein, 7 aa, Artificial Sequence
  Synthetic
DVRGFIA

SEQ ID NO: 3539 - protein, 7 aa, Artificial Sequence
  Synthetic
FLMGGPH

SEQ ID NO: 3540 - protein, 7 aa, Artificial Sequence
  Synthetic
MADRPWL

SEQ ID NO: 3541 - protein, 7 aa, Artificial Sequence
  Synthetic
WERLGVV

SEQ ID NO: 3542 - protein, 7 aa, Artificial Sequence
  Synthetic
YGVSPFS

SEQ ID NO: 3543 - protein, 7 aa, Artificial Sequence
  Synthetic
FEGHIFR

SEQ ID NO: 3544 - protein, 7 aa, Artificial Sequence
  Synthetic
GQFSPPS

SEQ ID NO: 3545 - protein, 7 aa, Artificial Sequence
  Synthetic
VGFSPPK

SEQ ID NO: 3546 - protein, 7 aa, Artificial Sequence
  Synthetic
SATKPFH

SEQ ID NO: 3547 - protein, 7 aa, Artificial Sequence
  Synthetic
VGVPLGR

SEQ ID NO: 3548 - protein, 7 aa, Artificial Sequence
  Synthetic
NSLQTSK

SEQ ID NO: 3549 - protein, 7 aa, Artificial Sequence
  Synthetic
YESRMFL

SEQ ID NO: 3550 - protein, 7 aa, Artificial Sequence
  Synthetic
VWAGVGS

SEQ ID NO: 3551 - protein, 7 aa, Artificial Sequence
  Synthetic
NTMAASR

SEQ ID NO: 3552 - protein, 7 aa, Artificial Sequence
  Synthetic
FGIRLAV

SEQ ID NO: 3553 - protein, 7 aa, Artificial Sequence
  Synthetic
ITLRTSV

SEQ ID NO: 3554 - protein, 7 aa, Artificial Sequence
  Synthetic
SDWRGLV

SEQ ID NO: 3555 - protein, 7 aa, Artificial Sequence
  Synthetic
SKVFEIV

SEQ ID NO: 3556 - protein, 7 aa, Artificial Sequence
  Synthetic
MKSFAAV

SEQ ID NO: 3557 - protein, 7 aa, Artificial Sequence
  Synthetic
SRVGFVA

SEQ ID NO: 3558 - protein, 7 aa, Artificial Sequence
  Synthetic
SKVFHDV

SEQ ID NO: 3559 - protein, 7 aa, Artificial Sequence
  Synthetic
KPAGWVA

SEQ ID NO: 3560 - protein, 7 aa, Artificial Sequence
  Synthetic
EVRWGIF

SEQ ID NO: 3561 - protein, 7 aa, Artificial Sequence
  Synthetic
GSFMPPP

SEQ ID NO: 3562 - protein, 7 aa, Artificial Sequence
  Synthetic
FSLSTSR

SEQ ID NO: 3563 - protein, 7 aa, Artificial Sequence
  Synthetic
AAVGWVA

SEQ ID NO: 3564 - protein, 7 aa, Artificial Sequence
  Synthetic
SLRVPFH

SEQ ID NO: 3565 - protein, 7 aa, Artificial Sequence
  Synthetic
FLQGGPY

SEQ ID NO: 3566 - protein, 7 aa, Artificial Sequence
  Synthetic
TMTKPFV

SEQ ID NO: 3567 - protein, 7 aa, Artificial Sequence
  Synthetic
PTSINSW

SEQ ID NO: 3568 - protein, 7 aa, Artificial Sequence
  Synthetic
TVWASNG

SEQ ID NO: 3569 - protein, 7 aa, Artificial Sequence
  Synthetic
NGVRLGF

SEQ ID NO: 3570 - protein, 7 aa, Artificial Sequence
  Synthetic
WPLPQFG

SEQ ID NO: 3571 - protein, 7 aa, Artificial Sequence
  Synthetic
SVVGWSA

SEQ ID NO: 3572 - protein, 7 aa, Artificial Sequence
  Synthetic
GAFSPPM

SEQ ID NO: 3573 - protein, 7 aa, Artificial Sequence
  Synthetic
STTRPFN

SEQ ID NO: 3574 - protein, 7 aa, Artificial Sequence
  Synthetic
SLQTPFK

SEQ ID NO: 3575 - protein, 7 aa, Artificial Sequence
  Synthetic
RHPGWVA

SEQ ID NO: 3576 - protein, 7 aa, Artificial Sequence
  Synthetic
LGMALGR

SEQ ID NO: 3577 - protein, 7 aa, Artificial Sequence
  Synthetic
QPDMGLW

SEQ ID NO: 3578 - protein, 7 aa, Artificial Sequence
  Synthetic
LGLLRTP

SEQ ID NO: 3579 - protein, 7 aa, Artificial Sequence
  Synthetic
TVWKMAG

SEQ ID NO: 3580 - protein, 7 aa, Artificial Sequence
  Synthetic
PFINGSG

SEQ ID NO: 3581 - protein, 7 aa, Artificial Sequence
  Synthetic
NPIGWAA

SEQ ID NO: 3582 - protein, 7 aa, Artificial Sequence
  Synthetic
TVWRADG

SEQ ID NO: 3583 - protein, 7 aa, Artificial Sequence
  Synthetic
VEPLPFR

SEQ ID NO: 3584 - protein, 7 aa, Artificial Sequence
  Synthetic
GRLPVMP

SEQ ID NO: 3585 - protein, 7 aa, Artificial Sequence
  Synthetic
YTGKPFQ

SEQ ID NO: 3586 - protein, 7 aa, Artificial Sequence
  Synthetic
SAIKPFL

SEQ ID NO: 3587 - protein, 7 aa, Artificial Sequence
  Synthetic
SLRMPFS

SEQ ID NO: 3588 - protein, 7 aa, Artificial Sequence
  Synthetic
DSFFPPK

SEQ ID NO: 3589 - protein, 7 aa, Artificial Sequence
  Synthetic
SLRFEAV

SEQ ID NO: 3590 - protein, 7 aa, Artificial Sequence
  Synthetic
VDNFAIC

SEQ ID NO: 3591 - protein, 7 aa, Artificial Sequence
  Synthetic
PENALSW

SEQ ID NO: 3592 - protein, 7 aa, Artificial Sequence
  Synthetic
YQGHLFA

SEQ ID NO: 3593 - protein, 7 aa, Artificial Sequence
  Synthetic
SAWGPLS

SEQ ID NO: 3594 - protein, 7 aa, Artificial Sequence
  Synthetic
TIWSKIG

SEQ ID NO: 3595 - protein, 7 aa, Artificial Sequence
  Synthetic
VGMPLGK

SEQ ID NO: 3596 - protein, 7 aa, Artificial Sequence
  Synthetic
DKIFRLG

SEQ ID NO: 3597 - protein, 7 aa, Artificial Sequence
  Synthetic
WDRSGPY

SEQ ID NO: 3598 - protein, 7 aa, Artificial Sequence
  Synthetic
FTTLYPK

SEQ ID NO: 3599 - protein, 7 aa, Artificial Sequence
  Synthetic
MHDKPWI

SEQ ID NO: 3600 - protein, 7 aa, Artificial Sequence
  Synthetic
HQIGWIG

SEQ ID NO: 3601 - protein, 7 aa, Artificial Sequence
  Synthetic
FTQSTPR

SEQ ID NO: 3602 - protein, 7 aa, Artificial Sequence
  Synthetic
TNQQPWL

SEQ ID NO: 3603 - protein, 7 aa, Artificial Sequence
  Synthetic
DLHRPFH

SEQ ID NO: 3604 - protein, 7 aa, Artificial Sequence
  Synthetic
WDAAGPR

SEQ ID NO: 3605 - protein, 7 aa, Artificial Sequence
  Synthetic
SVLQPFR

SEQ ID NO: 3606 - protein, 7 aa, Artificial Sequence
  Synthetic
DLWRRDG

SEQ ID NO: 3607 - protein, 7 aa, Artificial Sequence
  Synthetic
GDFAHPR

SEQ ID NO: 3608 - protein, 7 aa, Artificial Sequence
  Synthetic
TLIPLHR

SEQ ID NO: 3609 - protein, 7 aa, Artificial Sequence
  Synthetic
LTMSTSR

SEQ ID NO: 3610 - protein, 7 aa, Artificial Sequence
  Synthetic
LGVRLGV

SEQ ID NO: 3611 - protein, 7 aa, Artificial Sequence
  Synthetic
EQSRPFL

SEQ ID NO: 3612 - protein, 7 aa, Artificial Sequence
  Synthetic
SAWGTAH

SEQ ID NO: 3613 - protein, 7 aa, Artificial Sequence
  Synthetic
TLWREGG

SEQ ID NO: 3614 - protein, 7 aa, Artificial Sequence
  Synthetic
GEMRPFL

SEQ ID NO: 3615 - protein, 7 aa, Artificial Sequence
  Synthetic
LPEAPFR

SEQ ID NO: 3616 - protein, 7 aa, Artificial Sequence
  Synthetic
SNMGFVA

SEQ ID NO: 3617 - protein, 7 aa, Artificial Sequence
  Synthetic
PLNNTSW

SEQ ID NO: 3618 - protein, 7 aa, Artificial Sequence
  Synthetic
LGRPLGA

SEQ ID NO: 3619 - protein, 7 aa, Artificial Sequence
  Synthetic
GIWLPHG

SEQ ID NO: 3620 - protein, 7 aa, Artificial Sequence
  Synthetic
SLRLPFQ

SEQ ID NO: 3621 - protein, 7 aa, Artificial Sequence
  Synthetic
QTAFNRI

SEQ ID NO: 3622 - protein, 7 aa, Artificial Sequence
  Synthetic
YGDQLFR

SEQ ID NO: 3623 - protein, 7 aa, Artificial Sequence
  Synthetic
PKAFALV

SEQ ID NO: 3624 - protein, 7 aa, Artificial Sequence
  Synthetic
NTMSTSR

SEQ ID NO: 3625 - protein, 7 aa, Artificial Sequence
  Synthetic
GQEQFFR

SEQ ID NO: 3626 - protein, 7 aa, Artificial Sequence
  Synthetic
GREGWIP

SEQ ID NO: 3627 - protein, 7 aa, Artificial Sequence
  Synthetic
ADQIWVA

SEQ ID NO: 3628 - protein, 7 aa, Artificial Sequence
  Synthetic
YDARPFL

SEQ ID NO: 3629 - protein, 7 aa, Artificial Sequence
  Synthetic
SVLGWAP

SEQ ID NO: 3630 - protein, 7 aa, Artificial Sequence
  Synthetic
LDPLPFQ

SEQ ID NO: 3631 - protein, 7 aa, Artificial Sequence
  Synthetic
SAKLPFL

SEQ ID NO: 3632 - protein, 7 aa, Artificial Sequence
  Synthetic
SHWGERV

SEQ ID NO: 3633 - protein, 7 aa, Artificial Sequence
  Synthetic
GPFGPQY

SEQ ID NO: 3634 - protein, 7 aa, Artificial Sequence
  Synthetic
WGAMPFQ

SEQ ID NO: 3635 - protein, 7 aa, Artificial Sequence
  Synthetic
GVFNPPT

SEQ ID NO: 3636 - protein, 7 aa, Artificial Sequence
  Synthetic
LGRALGT

SEQ ID NO: 3637 - protein, 7 aa, Artificial Sequence
  Synthetic
TVLNPFI

SEQ ID NO: 3638 - protein, 7 aa, Artificial Sequence
  Synthetic
TGGRPFI

SEQ ID NO: 3639 - protein, 7 aa, Artificial Sequence
  Synthetic
VVFESPR

SEQ ID NO: 3640 - protein, 7 aa, Artificial Sequence
  Synthetic
TLRDPWL

SEQ ID NO: 3641 - protein, 7 aa, Artificial Sequence
  Synthetic
MKLDFKP

SEQ ID NO: 3642 - protein, 7 aa, Artificial Sequence
  Synthetic
PVDRATW

SEQ ID NO: 3643 - protein, 7 aa, Artificial Sequence
  Synthetic
YGQQYFL

SEQ ID NO: 3644 - protein, 7 aa, Artificial Sequence
  Synthetic
TLSHPFV

SEQ ID NO: 3645 - protein, 7 aa, Artificial Sequence
  Synthetic
MQRPMLV

SEQ ID NO: 3646 - protein, 7 aa, Artificial Sequence
  Synthetic
SHWGEMK

SEQ ID NO: 3647 - protein, 7 aa, Artificial Sequence
  Synthetic
SVWDGGG

SEQ ID NO: 3648 - protein, 7 aa, Artificial Sequence
  Synthetic
TPSSPFR

SEQ ID NO: 3649 - protein, 7 aa, Artificial Sequence
  Synthetic
TAGWGAA

SEQ ID NO: 3650 - protein, 7 aa, Artificial Sequence
  Synthetic
YDGRPWA

SEQ ID NO: 3651 - protein, 7 aa, Artificial Sequence
  Synthetic
SVSLPFR

SEQ ID NO: 3652 - protein, 7 aa, Artificial Sequence
  Synthetic
SETKPWH

SEQ ID NO: 3653 - protein, 7 aa, Artificial Sequence
  Synthetic
LGRPLGT

SEQ ID NO: 3654 - protein, 7 aa, Artificial Sequence
  Synthetic
AGVRLGL

SEQ ID NO: 3655 - protein, 7 aa, Artificial Sequence
  Synthetic
TELAYFK

SEQ ID NO: 3656 - protein, 7 aa, Artificial Sequence
  Synthetic
TPWYATG

SEQ ID NO: 3657 - protein, 7 aa, Artificial Sequence
  Synthetic
SAGTPFR

SEQ ID NO: 3658 - protein, 7 aa, Artificial Sequence
  Synthetic
RDFSPPQ

SEQ ID NO: 3659 - protein, 7 aa, Artificial Sequence
  Synthetic
NVWSSVG

SEQ ID NO: 3660 - protein, 7 aa, Artificial Sequence
  Synthetic
AVWLPHG

SEQ ID NO: 3661 - protein, 7 aa, Artificial Sequence
  Synthetic
ALPHGWQ

SEQ ID NO: 3662 - protein, 7 aa, Artificial Sequence
  Synthetic
KSCGMAC

SEQ ID NO: 3663 - protein, 7 aa, Artificial Sequence
  Synthetic
SIAGWVA

SEQ ID NO: 3664 - protein, 7 aa, Artificial Sequence
  Synthetic
ETGWHPA

SEQ ID NO: 3665 - protein, 7 aa, Artificial Sequence
  Synthetic
FTLNSPR

SEQ ID NO: 3666 - protein, 7 aa, Artificial Sequence
  Synthetic
DGFGFHP

SEQ ID NO: 3667 - protein, 7 aa, Artificial Sequence
  Synthetic
LTLMTSI

SEQ ID NO: 3668 - protein, 7 aa, Artificial Sequence
  Synthetic
DVWRAEG

SEQ ID NO: 3669 - protein, 7 aa, Artificial Sequence
  Synthetic
TTRAPFM

SEQ ID NO: 3670 - protein, 7 aa, Artificial Sequence
  Synthetic
TTALPFR

SEQ ID NO: 3671 - protein, 7 aa, Artificial Sequence
  Synthetic
TTTHWTP

SEQ ID NO: 3672 - protein, 7 aa, Artificial Sequence
  Synthetic
DWRGVQH

SEQ ID NO: 3673 - protein, 7 aa, Artificial Sequence
  Synthetic
VGVYPPK

SEQ ID NO: 3674 - protein, 7 aa, Artificial Sequence
  Synthetic
SVRFSEV

SEQ ID NO: 3675 - protein, 7 aa, Artificial Sequence
  Synthetic
APQQPWL

SEQ ID NO: 3676 - protein, 7 aa, Artificial Sequence
  Synthetic
VPGWYPD

SEQ ID NO: 3677 - protein, 7 aa, Artificial Sequence
  Synthetic
TRSNPFG

SEQ ID NO: 3678 - protein, 7 aa, Artificial Sequence
  Synthetic
DGGIWIA

SEQ ID NO: 3679 - protein, 7 aa, Artificial Sequence
  Synthetic
GVWYPNG

SEQ ID NO: 3680 - protein, 7 aa, Artificial Sequence
  Synthetic
VSFSPPS

SEQ ID NO: 3681 - protein, 7 aa, Artificial Sequence
  Synthetic
MRAGFTV

SEQ ID NO: 3682 - protein, 7 aa, Artificial Sequence
  Synthetic
NMWDAGG

SEQ ID NO: 3683 - protein, 7 aa, Artificial Sequence
  Synthetic
IGSLPFR

SEQ ID NO: 3684 - protein, 7 aa, Artificial Sequence
  Synthetic
IREWPNP

SEQ ID NO: 3685 - protein, 7 aa, Artificial Sequence
  Synthetic
WDTAGPR

SEQ ID NO: 3686 - protein, 7 aa, Artificial Sequence
  Synthetic
DVFKLSG

SEQ ID NO: 3687 - protein, 7 aa, Artificial Sequence
  Synthetic
TEQRPFL

SEQ ID NO: 3688 - protein, 7 aa, Artificial Sequence
  Synthetic
LGTPLGK

SEQ ID NO: 3689 - protein, 7 aa, Artificial Sequence
  Synthetic
SAMGWAP

SEQ ID NO: 3690 - protein, 7 aa, Artificial Sequence
  Synthetic
SRTFSSV

SEQ ID NO: 3691 - protein, 7 aa, Artificial Sequence
  Synthetic
YELNYFH

SEQ ID NO: 3692 - protein, 7 aa, Artificial Sequence
  Synthetic
YGERLFL

SEQ ID NO: 3693 - protein, 7 aa, Artificial Sequence
  Synthetic
SPPQPWL

SEQ ID NO: 3694 - protein, 7 aa, Artificial Sequence
  Synthetic
TTALPFL

SEQ ID NO: 3695 - protein, 7 aa, Artificial Sequence
  Synthetic
ALRFEAV

SEQ ID NO: 3696 - protein, 7 aa, Artificial Sequence
  Synthetic
GRDWPYA

SEQ ID NO: 3697 - protein, 7 aa, Artificial Sequence
  Synthetic
SHVFSAV

SEQ ID NO: 3698 - protein, 7 aa, Artificial Sequence
  Synthetic
FGDSPFR

SEQ ID NO: 3699 - protein, 7 aa, Artificial Sequence
  Synthetic
TDTRPFL

SEQ ID NO: 3700 - protein, 7 aa, Artificial Sequence
  Synthetic
YDGNYFV

SEQ ID NO: 3701 - protein, 7 aa, Artificial Sequence
  Synthetic
GDYGFLP

SEQ ID NO: 3702 - protein, 7 aa, Artificial Sequence
  Synthetic
MVKFEQV

SEQ ID NO: 3703 - protein, 7 aa, Artificial Sequence
  Synthetic
QTSFAAV

SEQ ID NO: 3704 - protein, 7 aa, Artificial Sequence
  Synthetic
GKGPWLP

SEQ ID NO: 3705 - protein, 7 aa, Artificial Sequence
  Synthetic
TAVRPFV

SEQ ID NO: 3706 - protein, 7 aa, Artificial Sequence
  Synthetic
TAFQPPR

SEQ ID NO: 3707 - protein, 7 aa, Artificial Sequence
  Synthetic
QRIFADV

SEQ ID NO: 3708 - protein, 7 aa, Artificial Sequence
  Synthetic
SIPRPFP

SEQ ID NO: 3709 - protein, 7 aa, Artificial Sequence
  Synthetic
TIREPWL

SEQ ID NO: 3710 - protein, 7 aa, Artificial Sequence
  Synthetic
EPHTISW

SEQ ID NO: 3711 - protein, 7 aa, Artificial Sequence
  Synthetic
DPFRPQG

SEQ ID NO: 3712 - protein, 7 aa, Artificial Sequence
  Synthetic
MPVKGWV

SEQ ID NO: 3713 - protein, 7 aa, Artificial Sequence
  Synthetic
WTMEYPL

SEQ ID NO: 3714 - protein, 7 aa, Artificial Sequence
  Synthetic
TKRYPIP

SEQ ID NO: 3715 - protein, 7 aa, Artificial Sequence
  Synthetic
TPQVPFK

SEQ ID NO: 3716 - protein, 7 aa, Artificial Sequence
  Synthetic
WSLKTSV

SEQ ID NO: 3717 - protein, 7 aa, Artificial Sequence
  Synthetic
ITMSTSK

SEQ ID NO: 3718 - protein, 7 aa, Artificial Sequence
  Synthetic
VQGWYNE

SEQ ID NO: 3719 - protein, 7 aa, Artificial Sequence
  Synthetic
FHGAAFL

SEQ ID NO: 3720 - protein, 7 aa, Artificial Sequence
  Synthetic
IEFTPPR

SEQ ID NO: 3721 - protein, 7 aa, Artificial Sequence
  Synthetic
TSDRPFQ

SEQ ID NO: 3722 - protein, 7 aa, Artificial Sequence
  Synthetic
PLSFKNV

SEQ ID NO: 3723 - protein, 7 aa, Artificial Sequence
  Synthetic
TVAKPFH

SEQ ID NO: 3724 - protein, 7 aa, Artificial Sequence
  Synthetic
SSCGVVC

SEQ ID NO: 3725 - protein, 7 aa, Artificial Sequence
  Synthetic
DVTRPFL

SEQ ID NO: 3726 - protein, 7 aa, Artificial Sequence
  Synthetic
VGVPIGR

SEQ ID NO: 3727 - protein, 7 aa, Artificial Sequence
  Synthetic
YQDRVFL

SEQ ID NO: 3728 - protein, 7 aa, Artificial Sequence
  Synthetic
NSFSPPR

SEQ ID NO: 3729 - protein, 7 aa, Artificial Sequence
  Synthetic
GSLGWAP

SEQ ID NO: 3730 - protein, 7 aa, Artificial Sequence
  Synthetic
SLRYPIP

SEQ ID NO: 3731 - protein, 7 aa, Artificial Sequence
  Synthetic
DVFRLAG

SEQ ID NO: 3732 - protein, 7 aa, Artificial Sequence
  Synthetic
FPNWTSP

SEQ ID NO: 3733 - protein, 7 aa, Artificial Sequence
  Synthetic
STDRPWL

SEQ ID NO: 3734 - protein, 7 aa, Artificial Sequence
  Synthetic
DLSRPFV

SEQ ID NO: 3735 - protein, 7 aa, Artificial Sequence
  Synthetic
NTFSPPS

SEQ ID NO: 3736 - protein, 7 aa, Artificial Sequence
  Synthetic
GVTRPFI

SEQ ID NO: 3737 - protein, 7 aa, Artificial Sequence
  Synthetic
EGVRLGL

SEQ ID NO: 3738 - protein, 7 aa, Artificial Sequence
  Synthetic
STFSPPR

SEQ ID NO: 3739 - protein, 7 aa, Artificial Sequence
  Synthetic
GRAGWVA

SEQ ID NO: 3740 - protein, 7 aa, Artificial Sequence
  Synthetic
GEWSPPK

SEQ ID NO: 3741 - protein, 7 aa, Artificial Sequence
  Synthetic
TTVAPFR

SEQ ID NO: 3742 - protein, 7 aa, Artificial Sequence
  Synthetic
NAWGIAH

SEQ ID NO: 3743 - protein, 7 aa, Artificial Sequence
  Synthetic
VQTFCTG

SEQ ID NO: 3744 - protein, 7 aa, Artificial Sequence
  Synthetic
SVNNPFK

SEQ ID NO: 3745 - protein, 7 aa, Artificial Sequence
  Synthetic
ALSGWVA

SEQ ID NO: 3746 - protein, 7 aa, Artificial Sequence
  Synthetic
NSLSTSR

SEQ ID NO: 3747 - protein, 7 aa, Artificial Sequence
  Synthetic
PYKFNID

SEQ ID NO: 3748 - protein, 7 aa, Artificial Sequence
  Synthetic
LPDRPFM

SEQ ID NO: 3749 - protein, 7 aa, Artificial Sequence
  Synthetic
AGFSPPV

SEQ ID NO: 3750 - protein, 7 aa, Artificial Sequence
  Synthetic
TSNWPGS

SEQ ID NO: 3751 - protein, 7 aa, Artificial Sequence
  Synthetic
SAVGWAA

SEQ ID NO: 3752 - protein, 7 aa, Artificial Sequence
  Synthetic
VGVALGL

SEQ ID NO: 3753 - protein, 7 aa, Artificial Sequence
  Synthetic
MPPFFQQ

SEQ ID NO: 3754 - protein, 7 aa, Artificial Sequence
  Synthetic
GNYGFVP

SEQ ID NO: 3755 - protein, 7 aa, Artificial Sequence
  Synthetic
GAWVVQA

SEQ ID NO: 3756 - protein, 7 aa, Artificial Sequence
  Synthetic
LKHGFTV

SEQ ID NO: 3757 - protein, 7 aa, Artificial Sequence
  Synthetic
SALGWAP

SEQ ID NO: 3758 - protein, 7 aa, Artificial Sequence
  Synthetic
DPFRKSG

SEQ ID NO: 3759 - protein, 7 aa, Artificial Sequence
  Synthetic
IGTTPFR

SEQ ID NO: 3760 - protein, 7 aa, Artificial Sequence
  Synthetic
TGVKGIF

SEQ ID NO: 3761 - protein, 7 aa, Artificial Sequence
  Synthetic
YQQRYFA

SEQ ID NO: 3762 - protein, 7 aa, Artificial Sequence
  Synthetic
ASTFGTF

SEQ ID NO: 3763 - protein, 7 aa, Artificial Sequence
  Synthetic
STDRPFK

SEQ ID NO: 3764 - protein, 7 aa, Artificial Sequence
  Synthetic
SSSFKNV

SEQ ID NO: 3765 - protein, 7 aa, Artificial Sequence
  Synthetic
MLSKPFL

SEQ ID NO: 3766 - protein, 7 aa, Artificial Sequence
  Synthetic
NPAGWVP

SEQ ID NO: 3767 - protein, 7 aa, Artificial Sequence
  Synthetic
NPSNTSW

SEQ ID NO: 3768 - protein, 7 aa, Artificial Sequence
  Synthetic
TVWSQTG

SEQ ID NO: 3769 - protein, 7 aa, Artificial Sequence
  Synthetic
VGVQLGC

SEQ ID NO: 3770 - protein, 7 aa, Artificial Sequence
  Synthetic
IDGWFVK

SEQ ID NO: 3771 - protein, 7 aa, Artificial Sequence
  Synthetic
TVDRPFV

SEQ ID NO: 3772 - protein, 7 aa, Artificial Sequence
  Synthetic
SLTLPFK

SEQ ID NO: 3773 - protein, 7 aa, Artificial Sequence
  Synthetic
VGKPLGQ

SEQ ID NO: 3774 - protein, 7 aa, Artificial Sequence
  Synthetic
DPVFRMA

SEQ ID NO: 3775 - protein, 7 aa, Artificial Sequence
  Synthetic
SSVFREV

SEQ ID NO: 3776 - protein, 7 aa, Artificial Sequence
  Synthetic
VGPMPFL

SEQ ID NO: 3777 - protein, 7 aa, Artificial Sequence
  Synthetic
WTMENPK

SEQ ID NO: 3778 - protein, 7 aa, Artificial Sequence
  Synthetic
YVDHIFR

SEQ ID NO: 3779 - protein, 7 aa, Artificial Sequence
  Synthetic
GSFSPPT

SEQ ID NO: 3780 - protein, 7 aa, Artificial Sequence
  Synthetic
GLLGFVA

SEQ ID NO: 3781 - protein, 7 aa, Artificial Sequence
  Synthetic
VAFENPR

SEQ ID NO: 3782 - protein, 7 aa, Artificial Sequence
  Synthetic
SLGGWVA

SEQ ID NO: 3783 - protein, 7 aa, Artificial Sequence
  Synthetic
GVWLPPE

SEQ ID NO: 3784 - protein, 7 aa, Artificial Sequence
  Synthetic
SEFIPPR

SEQ ID NO: 3785 - protein, 7 aa, Artificial Sequence
  Synthetic
DLSHVFR

SEQ ID NO: 3786 - protein, 7 aa, Artificial Sequence
  Synthetic
VGSFCHA

SEQ ID NO: 3787 - protein, 7 aa, Artificial Sequence
  Synthetic
TTDNPFR

SEQ ID NO: 3788 - protein, 7 aa, Artificial Sequence
  Synthetic
SVIGWAP

SEQ ID NO: 3789 - protein, 7 aa, Artificial Sequence
  Synthetic
SVSRPFI

SEQ ID NO: 3790 - protein, 7 aa, Artificial Sequence
  Synthetic
SSLGWAA

SEQ ID NO: 3791 - protein, 7 aa, Artificial Sequence
  Synthetic
KVNFGDF

SEQ ID NO: 3792 - protein, 7 aa, Artificial Sequence
  Synthetic
VGLAPPK

SEQ ID NO: 3793 - protein, 7 aa, Artificial Sequence
  Synthetic
TPRAPFY

SEQ ID NO: 3794 - protein, 7 aa, Artificial Sequence
  Synthetic
TLSRPLL

SEQ ID NO: 3795 - protein, 7 aa, Artificial Sequence
  Synthetic
TASTPWL

SEQ ID NO: 3796 - protein, 7 aa, Artificial Sequence
  Synthetic
RKTFENV

SEQ ID NO: 3797 - protein, 7 aa, Artificial Sequence
  Synthetic
FTLAAPK

SEQ ID NO: 3798 - protein, 7 aa, Artificial Sequence
  Synthetic
SRTFERV

SEQ ID NO: 3799 - protein, 7 aa, Artificial Sequence
  Synthetic
SIGAPFR

SEQ ID NO: 3800 - protein, 7 aa, Artificial Sequence
  Synthetic
VGFVPPM

SEQ ID NO: 3801 - protein, 7 aa, Artificial Sequence
  Synthetic
AFKFADV

SEQ ID NO: 3802 - protein, 7 aa, Artificial Sequence
  Synthetic
SEWTPPM

SEQ ID NO: 3803 - protein, 7 aa, Artificial Sequence
  Synthetic
SATRPFV

SEQ ID NO: 3804 - protein, 7 aa, Artificial Sequence
  Synthetic
LVFQEPR

SEQ ID NO: 3805 - protein, 7 aa, Artificial Sequence
  Synthetic
SLAVPFK

SEQ ID NO: 3806 - protein, 7 aa, Artificial Sequence
  Synthetic
VAALPFR

SEQ ID NO: 3807 - protein, 7 aa, Artificial Sequence
  Synthetic
SGSFCTA

SEQ ID NO: 3808 - protein, 7 aa, Artificial Sequence
  Synthetic
TNIGFAA

SEQ ID NO: 3809 - protein, 7 aa, Artificial Sequence
  Synthetic
LSTRPFI

SEQ ID NO: 3810 - protein, 7 aa, Artificial Sequence
  Synthetic
SSVGWLA

SEQ ID NO: 3811 - protein, 7 aa, Artificial Sequence
  Synthetic
VLGWYAE

SEQ ID NO: 3812 - protein, 7 aa, Artificial Sequence
  Synthetic
GLDKPFL

SEQ ID NO: 3813 - protein, 7 aa, Artificial Sequence
  Synthetic
AGQIWSP

SEQ ID NO: 3814 - protein, 7 aa, Artificial Sequence
  Synthetic
GHFTPPA

SEQ ID NO: 3815 - protein, 7 aa, Artificial Sequence
  Synthetic
VLGSARL

SEQ ID NO: 3816 - protein, 7 aa, Artificial Sequence
  Synthetic
KKAFSDI

SEQ ID NO: 3817 - protein, 7 aa, Artificial Sequence
  Synthetic
IQHNLSF

SEQ ID NO: 3818 - protein, 7 aa, Artificial Sequence
  Synthetic
PNHAISW

SEQ ID NO: 3819 - protein, 7 aa, Artificial Sequence
  Synthetic
EGVRLGY

SEQ ID NO: 3820 - protein, 7 aa, Artificial Sequence
  Synthetic
QVEFAHV

SEQ ID NO: 3821 - protein, 7 aa, Artificial Sequence
  Synthetic
YEGRPFV

SEQ ID NO: 3822 - protein, 7 aa, Artificial Sequence
  Synthetic
PTHTVSW

SEQ ID NO: 3823 - protein, 7 aa, Artificial Sequence
  Synthetic
AIARPFA

SEQ ID NO: 3824 - protein, 7 aa, Artificial Sequence
  Synthetic
TVLPQRM

SEQ ID NO: 3825 - protein, 7 aa, Artificial Sequence
  Synthetic
DVTRPWI

SEQ ID NO: 3826 - protein, 7 aa, Artificial Sequence
  Synthetic
VGFSPPA

SEQ ID NO: 3827 - protein, 7 aa, Artificial Sequence
  Synthetic
TLFREFG

SEQ ID NO: 3828 - protein, 7 aa, Artificial Sequence
  Synthetic
HVLTGWQ

SEQ ID NO: 3829 - protein, 7 aa, Artificial Sequence
  Synthetic
SVSRPFM

SEQ ID NO: 3830 - protein, 7 aa, Artificial Sequence
  Synthetic
TDERPFR

SEQ ID NO: 3831 - protein, 7 aa, Artificial Sequence
  Synthetic
YDFKSPR

SEQ ID NO: 3832 - protein, 7 aa, Artificial Sequence
  Synthetic
TTLTVSR

SEQ ID NO: 3833 - protein, 7 aa, Artificial Sequence
  Synthetic
WDLEYAR

SEQ ID NO: 3834 - protein, 7 aa, Artificial Sequence
  Synthetic
SVTNVFK

SEQ ID NO: 3835 - protein, 7 aa, Artificial Sequence
  Synthetic
YERHPFN

SEQ ID NO: 3836 - protein, 7 aa, Artificial Sequence
  Synthetic
STTSPFR

SEQ ID NO: 3837 - protein, 7 aa, Artificial Sequence
  Synthetic
LTLRSSV

SEQ ID NO: 3838 - protein, 7 aa, Artificial Sequence
  Synthetic
ANAGWVA

SEQ ID NO: 3839 - protein, 7 aa, Artificial Sequence
  Synthetic
FPMNRSV

SEQ ID NO: 3840 - protein, 7 aa, Artificial Sequence
  Synthetic
SLLAPFV

SEQ ID NO: 3841 - protein, 7 aa, Artificial Sequence
  Synthetic
QYRFADV

SEQ ID NO: 3842 - protein, 7 aa, Artificial Sequence
  Synthetic
SMLRPFE

SEQ ID NO: 3843 - protein, 7 aa, Artificial Sequence
  Synthetic
RVCGVVC

SEQ ID NO: 3844 - protein, 7 aa, Artificial Sequence
  Synthetic
SNRFEVV

SEQ ID NO: 3845 - protein, 7 aa, Artificial Sequence
  Synthetic
HTWLPPE

SEQ ID NO: 3846 - protein, 7 aa, Artificial Sequence
  Synthetic
KLGYEIL

SEQ ID NO: 3847 - protein, 7 aa, Artificial Sequence
  Synthetic
GTWAGGG

SEQ ID NO: 3848 - protein, 7 aa, Artificial Sequence
  Synthetic
WKNLGSV

SEQ ID NO: 3849 - protein, 7 aa, Artificial Sequence
  Synthetic
QVHFTKM

SEQ ID NO: 3850 - protein, 7 aa, Artificial Sequence
  Synthetic
LGLPYTY

SEQ ID NO: 3851 - protein, 7 aa, Artificial Sequence
  Synthetic
VGMSPPR

SEQ ID NO: 3852 - protein, 7 aa, Artificial Sequence
  Synthetic
GAWNPPN

SEQ ID NO: 3853 - protein, 7 aa, Artificial Sequence
  Synthetic
YNEHYFS

SEQ ID NO: 3854 - protein, 7 aa, Artificial Sequence
  Synthetic
GSWTPPS

SEQ ID NO: 3855 - protein, 7 aa, Artificial Sequence
  Synthetic
SVSQMFR

SEQ ID NO: 3856 - protein, 7 aa, Artificial Sequence
  Synthetic
GSFTPPA

SEQ ID NO: 3857 - protein, 7 aa, Artificial Sequence
  Synthetic
VDHQYFR

SEQ ID NO: 3858 - protein, 7 aa, Artificial Sequence
  Synthetic
LGVRIGF

SEQ ID NO: 3859 - protein, 7 aa, Artificial Sequence
  Synthetic
YDSNIFR

SEQ ID NO: 3860 - protein, 7 aa, Artificial Sequence
  Synthetic
SLDRVFL

SEQ ID NO: 3861 - protein, 7 aa, Artificial Sequence
  Synthetic
GEFAQPR

SEQ ID NO: 3862 - protein, 7 aa, Artificial Sequence
  Synthetic
GTIGWVA

SEQ ID NO: 3863 - protein, 7 aa, Artificial Sequence
  Synthetic
VGRPLGL

SEQ ID NO: 3864 - protein, 7 aa, Artificial Sequence
  Synthetic
SALGWSA

SEQ ID NO: 3865 - protein, 7 aa, Artificial Sequence
  Synthetic
KEKFSHV

SEQ ID NO: 3866 - protein, 7 aa, Artificial Sequence
  Synthetic
APSALSW

SEQ ID NO: 3867 - protein, 7 aa, Artificial Sequence
  Synthetic
TGTPWVA

SEQ ID NO: 3868 - protein, 7 aa, Artificial Sequence
  Synthetic
WDLNYPK

SEQ ID NO: 3869 - protein, 7 aa, Artificial Sequence
  Synthetic
FPSNISW

SEQ ID NO: 3870 - protein, 7 aa, Artificial Sequence
  Synthetic
ESFATLH

SEQ ID NO: 3871 - protein, 7 aa, Artificial Sequence
  Synthetic
EMARPFM

SEQ ID NO: 3872 - protein, 7 aa, Artificial Sequence
  Synthetic
TAGWGAP

SEQ ID NO: 3873 - protein, 7 aa, Artificial Sequence
  Synthetic
TGRFGDF

SEQ ID NO: 3874 - protein, 7 aa, Artificial Sequence
  Synthetic
ILRGYVS

SEQ ID NO: 3875 - protein, 7 aa, Artificial Sequence
  Synthetic
HEGAYFK

SEQ ID NO: 3876 - protein, 7 aa, Artificial Sequence
  Synthetic
TLLGFAP

SEQ ID NO: 3877 - protein, 7 aa, Artificial Sequence
  Synthetic
SGRPLGC

SEQ ID NO: 3878 - protein, 7 aa, Artificial Sequence
  Synthetic
SLDVPFR

SEQ ID NO: 3879 - protein, 7 aa, Artificial Sequence
  Synthetic
IGVMPFL

SEQ ID NO: 3880 - protein, 7 aa, Artificial Sequence
  Synthetic
EPIWKRE

SEQ ID NO: 3881 - protein, 7 aa, Artificial Sequence
  Synthetic
YGAAYFQ

SEQ ID NO: 3882 - protein, 7 aa, Artificial Sequence
  Synthetic
WDTAGPK

SEQ ID NO: 3883 - protein, 7 aa, Artificial Sequence
  Synthetic
QDRWKDF

SEQ ID NO: 3884 - protein, 7 aa, Artificial Sequence
  Synthetic
SPMNLTM

SEQ ID NO: 3885 - protein, 7 aa, Artificial Sequence
  Synthetic
ITTSTSI

SEQ ID NO: 3886 - protein, 7 aa, Artificial Sequence
  Synthetic
RDSWGQF

SEQ ID NO: 3887 - protein, 7 aa, Artificial Sequence
  Synthetic
KVSNTSW

SEQ ID NO: 3888 - protein, 7 aa, Artificial Sequence
  Synthetic
SVFCKTP

SEQ ID NO: 3889 - protein, 7 aa, Artificial Sequence
  Synthetic
ANSGWIA

SEQ ID NO: 3890 - protein, 7 aa, Artificial Sequence
  Synthetic
SARFAEV

SEQ ID NO: 3891 - protein, 7 aa, Artificial Sequence
  Synthetic
GVARPFV

SEQ ID NO: 3892 - protein, 7 aa, Artificial Sequence
  Synthetic
FDQAYPR

SEQ ID NO: 3893 - protein, 7 aa, Artificial Sequence
  Synthetic
GTWVPPP

SEQ ID NO: 3894 - protein, 7 aa, Artificial Sequence
  Synthetic
SVRFQQV

SEQ ID NO: 3895 - protein, 7 aa, Artificial Sequence
  Synthetic
LGILPFA

SEQ ID NO: 3896 - protein, 7 aa, Artificial Sequence
  Synthetic
TVWHAEG

SEQ ID NO: 3897 - protein, 7 aa, Artificial Sequence
  Synthetic
QVSFSRV

SEQ ID NO: 3898 - protein, 7 aa, Artificial Sequence
  Synthetic
LGAALGR

SEQ ID NO: 3899 - protein, 7 aa, Artificial Sequence
  Synthetic
VGVALGR

SEQ ID NO: 3900 - protein, 7 aa, Artificial Sequence
  Synthetic
SSVGWVG

SEQ ID NO: 3901 - protein, 7 aa, Artificial Sequence
  Synthetic
SKIFSEV

SEQ ID NO: 3902 - protein, 7 aa, Artificial Sequence
  Synthetic
DRLGFLP

SEQ ID NO: 3903 - protein, 7 aa, Artificial Sequence
  Synthetic
NVWSVHG

SEQ ID NO: 3904 - protein, 7 aa, Artificial Sequence
  Synthetic
SSQFCKA

SEQ ID NO: 3905 - protein, 7 aa, Artificial Sequence
  Synthetic
AFKFEQV

SEQ ID NO: 3906 - protein, 7 aa, Artificial Sequence
  Synthetic
DAVFRIA

SEQ ID NO: 3907 - protein, 7 aa, Artificial Sequence
  Synthetic
FTLSASV

SEQ ID NO: 3908 - protein, 7 aa, Artificial Sequence
  Synthetic
GRNSFFE

SEQ ID NO: 3909 - protein, 7 aa, Artificial Sequence
  Synthetic
TVSFERI

SEQ ID NO: 3910 - protein, 7 aa, Artificial Sequence
  Synthetic
TLLTPFA

SEQ ID NO: 3911 - protein, 7 aa, Artificial Sequence
  Synthetic
FWTGGSG

SEQ ID NO: 3912 - protein, 7 aa, Artificial Sequence
  Synthetic
SREFKCV

SEQ ID NO: 3913 - protein, 7 aa, Artificial Sequence
  Synthetic
IPGWYSE

SEQ ID NO: 3914 - protein, 7 aa, Artificial Sequence
  Synthetic
SPVGWSP

SEQ ID NO: 3915 - protein, 7 aa, Artificial Sequence
  Synthetic
TQNAPFR

SEQ ID NO: 3916 - protein, 7 aa, Artificial Sequence
  Synthetic
SKAFEKV

SEQ ID NO: 3917 - protein, 7 aa, Artificial Sequence
  Synthetic
LRVAGTD

SEQ ID NO: 3918 - protein, 7 aa, Artificial Sequence
  Synthetic
FGVGLAR

SEQ ID NO: 3919 - protein, 7 aa, Artificial Sequence
  Synthetic
YVERPFA

SEQ ID NO: 3920 - protein, 7 aa, Artificial Sequence
  Synthetic
SPENPFR

SEQ ID NO: 3921 - protein, 7 aa, Artificial Sequence
  Synthetic
TSASPWL

SEQ ID NO: 3922 - protein, 7 aa, Artificial Sequence
  Synthetic
YGEYFFA

SEQ ID NO: 3923 - protein, 7 aa, Artificial Sequence
  Synthetic
QVHFKTM

SEQ ID NO: 3924 - protein, 7 aa, Artificial Sequence
  Synthetic
SKLGFVA

SEQ ID NO: 3925 - protein, 7 aa, Artificial Sequence
  Synthetic
STGYGMF

SEQ ID NO: 3926 - protein, 7 aa, Artificial Sequence
  Synthetic
DMSRPFH

SEQ ID NO: 3927 - protein, 7 aa, Artificial Sequence
  Synthetic
NIARPFY

SEQ ID NO: 3928 - protein, 7 aa, Artificial Sequence
  Synthetic
SSVHWSP

SEQ ID NO: 3929 - protein, 7 aa, Artificial Sequence
  Synthetic
TWKGWEP

SEQ ID NO: 3930 - protein, 7 aa, Artificial Sequence
  Synthetic
HAQGWVP

SEQ ID NO: 3931 - protein, 7 aa, Artificial Sequence
  Synthetic
QRDQWSK

SEQ ID NO: 3932 - protein, 7 aa, Artificial Sequence
  Synthetic
DWRGELW

SEQ ID NO: 3933 - protein, 7 aa, Artificial Sequence
  Synthetic
AGVRLGL

SEQ ID NO: 3934 - protein, 7 aa, Artificial Sequence
  Synthetic
SSSRPFV

SEQ ID NO: 3935 - protein, 7 aa, Artificial Sequence
  Synthetic
LAEKPWL

SEQ ID NO: 3936 - protein, 7 aa, Artificial Sequence
  Synthetic
GGFVPPM

SEQ ID NO: 3937 - protein, 7 aa, Artificial Sequence
  Synthetic
TVWSASG

SEQ ID NO: 3938 - protein, 7 aa, Artificial Sequence
  Synthetic
IPGFIGR

SEQ ID NO: 3939 - protein, 7 aa, Artificial Sequence
  Synthetic
NGGWPGS

SEQ ID NO: 3940 - protein, 7 aa, Artificial Sequence
  Synthetic
VPDHLSW

SEQ ID NO: 3941 - protein, 7 aa, Artificial Sequence
  Synthetic
SRTFAAV

SEQ ID NO: 3942 - protein, 7 aa, Artificial Sequence
  Synthetic
TISRPLL

SEQ ID NO: 3943 - protein, 7 aa, Artificial Sequence
  Synthetic
GVFVPPQ

SEQ ID NO: 3944 - protein, 7 aa, Artificial Sequence
  Synthetic
QVNFLKV

SEQ ID NO: 3945 - protein, 7 aa, Artificial Sequence
  Synthetic
QLRFQDV

SEQ ID NO: 3946 - protein, 7 aa, Artificial Sequence
  Synthetic
WDLQYAK

SEQ ID NO: 3947 - protein, 7 aa, Artificial Sequence
  Synthetic
GTWDPPA

SEQ ID NO: 3948 - protein, 7 aa, Artificial Sequence
  Synthetic
LSEFCVI

SEQ ID NO: 3949 - protein, 7 aa, Artificial Sequence
  Synthetic
SILGFVA

SEQ ID NO: 3950 - protein, 7 aa, Artificial Sequence
  Synthetic
QVEFRSI

SEQ ID NO: 3951 - protein, 7 aa, Artificial Sequence
  Synthetic
LDNFCKN

SEQ ID NO: 3952 - protein, 7 aa, Artificial Sequence
  Synthetic
DPVFRIT

SEQ ID NO: 3953 - protein, 7 aa, Artificial Sequence
  Synthetic
WGSNIFL

SEQ ID NO: 3954 - protein, 7 aa, Artificial Sequence
  Synthetic
NVWHAQG

SEQ ID NO: 3955 - protein, 7 aa, Artificial Sequence
  Synthetic
AGVRLGL

SEQ ID NO: 3956 - protein, 7 aa, Artificial Sequence
  Synthetic
GRDRPFV

SEQ ID NO: 3957 - protein, 7 aa, Artificial Sequence
  Synthetic
GQWDSGG

SEQ ID NO: 3958 - protein, 7 aa, Artificial Sequence
  Synthetic
SANKPFL

SEQ ID NO: 3959 - protein, 7 aa, Artificial Sequence
  Synthetic
SVDNPFR

SEQ ID NO: 3960 - protein, 7 aa, Artificial Sequence
  Synthetic
FDTSGPR

SEQ ID NO: 3961 - protein, 7 aa, Artificial Sequence
  Synthetic
SADRPFQ

SEQ ID NO: 3962 - protein, 7 aa, Artificial Sequence
  Synthetic
GSERPFL

SEQ ID NO: 3963 - protein, 7 aa, Artificial Sequence
  Synthetic
SLTKPFN

SEQ ID NO: 3964 - protein, 7 aa, Artificial Sequence
  Synthetic
WDAQYPR

SEQ ID NO: 3965 - protein, 7 aa, Artificial Sequence
  Synthetic
GVWIVKP

SEQ ID NO: 3966 - protein, 7 aa, Artificial Sequence
  Synthetic
SARSPFL

SEQ ID NO: 3967 - protein, 7 aa, Artificial Sequence
  Synthetic
MPPGWLP

SEQ ID NO: 3968 - protein, 7 aa, Artificial Sequence
  Synthetic
VERWNFD

SEQ ID NO: 3969 - protein, 7 aa, Artificial Sequence
  Synthetic
WDLAGPK

SEQ ID NO: 3970 - protein, 7 aa, Artificial Sequence
  Synthetic
STRTPFL

SEQ ID NO: 3971 - protein, 7 aa, Artificial Sequence
  Synthetic
RDPGWVP

SEQ ID NO: 3972 - protein, 7 aa, Artificial Sequence
  Synthetic
YPTRPFN

SEQ ID NO: 3973 - protein, 7 aa, Artificial Sequence
  Synthetic
TLKFERI

SEQ ID NO: 3974 - protein, 7 aa, Artificial Sequence
  Synthetic
SSRFEAV

SEQ ID NO: 3975 - protein, 7 aa, Artificial Sequence
  Synthetic
SLKLPFM

SEQ ID NO: 3976 - protein, 7 aa, Artificial Sequence
  Synthetic
TVLRPLL

SEQ ID NO: 3977 - protein, 7 aa, Artificial Sequence
  Synthetic
TLNRIFI

SEQ ID NO: 3978 - protein, 7 aa, Artificial Sequence
  Synthetic
GQLGWIQ

SEQ ID NO: 3979 - protein, 7 aa, Artificial Sequence
  Synthetic
YPDMVFR

SEQ ID NO: 3980 - protein, 7 aa, Artificial Sequence
  Synthetic
GVTHLFK

SEQ ID NO: 3981 - protein, 7 aa, Artificial Sequence
  Synthetic
SVWRVEG

SEQ ID NO: 3982 - protein, 7 aa, Artificial Sequence
  Synthetic
LLTRPFA

SEQ ID NO: 3983 - protein, 7 aa, Artificial Sequence
  Synthetic
WTESYPR

SEQ ID NO: 3984 - protein, 7 aa, Artificial Sequence
  Synthetic
SASQPWL

SEQ ID NO: 3985 - protein, 7 aa, Artificial Sequence
  Synthetic
VGTPLGR

SEQ ID NO: 3986 - protein, 7 aa, Artificial Sequence
  Synthetic
RPPSISW

SEQ ID NO: 3987 - protein, 7 aa, Artificial Sequence
  Synthetic
TPWRHDG

SEQ ID NO: 3988 - protein, 7 aa, Artificial Sequence
  Synthetic
VGTRLGC

SEQ ID NO: 3989 - protein, 7 aa, Artificial Sequence
  Synthetic
DPIFRHM

SEQ ID NO: 3990 - protein, 7 aa, Artificial Sequence
  Synthetic
YTFAPPS

SEQ ID NO: 3991 - protein, 7 aa, Artificial Sequence
  Synthetic
GKFSPPQ

SEQ ID NO: 3992 - protein, 7 aa, Artificial Sequence
  Synthetic
GERGWVA

SEQ ID NO: 3993 - protein, 7 aa, Artificial Sequence
  Synthetic
GRDGWIA

SEQ ID NO: 3994 - protein, 7 aa, Artificial Sequence
  Synthetic
GVYLPPT

SEQ ID NO: 3995 - protein, 7 aa, Artificial Sequence
  Synthetic
SVRFEKV

SEQ ID NO: 3996 - protein, 7 aa, Artificial Sequence
  Synthetic
DDYGFHP

SEQ ID NO: 3997 - protein, 7 aa, Artificial Sequence
  Synthetic
WTFSPPQ

SEQ ID NO: 3998 - protein, 7 aa, Artificial Sequence
  Synthetic
TVASPWM

SEQ ID NO: 3999 - protein, 7 aa, Artificial Sequence
  Synthetic
IGVRLGL

SEQ ID NO: 4000 - protein, 7 aa, Artificial Sequence
  Synthetic
DYEWPGS

SEQ ID NO: 4001 - protein, 7 aa, Artificial Sequence
  Synthetic
EDMRTSW

SEQ ID NO: 4002 - protein, 7 aa, Artificial Sequence
  Synthetic
TVERPFS

SEQ ID NO: 4003 - protein, 7 aa, Artificial Sequence
  Synthetic
THTSPWH

SEQ ID NO: 4004 - protein, 7 aa, Artificial Sequence
  Synthetic
SVEFRLV

SEQ ID NO: 4005 - protein, 7 aa, Artificial Sequence
  Synthetic
GTMGWTA

SEQ ID NO: 4006 - protein, 7 aa, Artificial Sequence
  Synthetic
FTLEGPM

SEQ ID NO: 4007 - protein, 7 aa, Artificial Sequence
  Synthetic
QKVGWVA

SEQ ID NO: 4008 - protein, 7 aa, Artificial Sequence
  Synthetic
NTMAVSR

SEQ ID NO: 4009 - protein, 7 aa, Artificial Sequence
  Synthetic
QQEFCAV

SEQ ID NO: 4010 - protein, 7 aa, Artificial Sequence
  Synthetic
GAIGFIA

SEQ ID NO: 4011 - protein, 7 aa, Artificial Sequence
  Synthetic
DSNWPGS

SEQ ID NO: 4012 - protein, 7 aa, Artificial Sequence
  Synthetic
ASPGWVA

SEQ ID NO: 4013 - protein, 7 aa, Artificial Sequence
  Synthetic
QLKFAEV

SEQ ID NO: 4014 - protein, 7 aa, Artificial Sequence
  Synthetic
TPSRTSW

SEQ ID NO: 4015 - protein, 7 aa, Artificial Sequence
  Synthetic
WTSFSSV

SEQ ID NO: 4016 - protein, 7 aa, Artificial Sequence
  Synthetic
GPSRPFQ

SEQ ID NO: 4017 - protein, 7 aa, Artificial Sequence
  Synthetic
GKLGWVP

SEQ ID NO: 4018 - protein, 7 aa, Artificial Sequence
  Synthetic
SAVFKNV

SEQ ID NO: 4019 - protein, 7 aa, Artificial Sequence
  Synthetic
DSRWGEF

SEQ ID NO: 4020 - protein, 7 aa, Artificial Sequence
  Synthetic
EGTRLGY

SEQ ID NO: 4021 - protein, 7 aa, Artificial Sequence
  Synthetic
NLFGDRL

SEQ ID NO: 4022 - protein, 7 aa, Artificial Sequence
  Synthetic
LDYGFVP

SEQ ID NO: 4023 - protein, 7 aa, Artificial Sequence
  Synthetic
HVFLQDG

SEQ ID NO: 4024 - protein, 7 aa, Artificial Sequence
  Synthetic
EAPLPWR

SEQ ID NO: 4025 - protein, 7 aa, Artificial Sequence
  Synthetic
GISRPFQ

SEQ ID NO: 4026 - protein, 7 aa, Artificial Sequence
  Synthetic
DVFRIHG

SEQ ID NO: 4027 - protein, 7 aa, Artificial Sequence
  Synthetic
QVMSTSW

SEQ ID NO: 4028 - protein, 7 aa, Artificial Sequence
  Synthetic
PKTFSQI

SEQ ID NO: 4029 - protein, 7 aa, Artificial Sequence
  Synthetic
FGLKDIF

SEQ ID NO: 4030 - protein, 7 aa, Artificial Sequence
  Synthetic
SELGWSP

SEQ ID NO: 4031 - protein, 7 aa, Artificial Sequence
  Synthetic
VPHNLTW

SEQ ID NO: 4032 - protein, 7 aa, Artificial Sequence
  Synthetic
KSLPFLP

SEQ ID NO: 4033 - protein, 7 aa, Artificial Sequence
  Synthetic
QARFQEI

SEQ ID NO: 4034 - protein, 7 aa, Artificial Sequence
  Synthetic
APKHEWL

SEQ ID NO: 4035 - protein, 7 aa, Artificial Sequence
  Synthetic
SKNWPGS

SEQ ID NO: 4036 - protein, 7 aa, Artificial Sequence
  Synthetic
GVDRPFV

SEQ ID NO: 4037 - protein, 7 aa, Artificial Sequence
  Synthetic
DETRLFR

SEQ ID NO: 4038 - protein, 7 aa, Artificial Sequence
  Synthetic
HNWDPPS

SEQ ID NO: 4039 - protein, 7 aa, Artificial Sequence
  Synthetic
WDLHDPK

SEQ ID NO: 4040 - protein, 7 aa, Artificial Sequence
  Synthetic
SGGWGVP

SEQ ID NO: 4041 - protein, 7 aa, Artificial Sequence
  Synthetic
VNGNERV

SEQ ID NO: 4042 - protein, 7 aa, Artificial Sequence
  Synthetic
GSLGWSP

SEQ ID NO: 4043 - protein, 7 aa, Artificial Sequence
  Synthetic
KINFAHV

SEQ ID NO: 4044 - protein, 7 aa, Artificial Sequence
  Synthetic
YDTRPFT

SEQ ID NO: 4045 - protein, 7 aa, Artificial Sequence
  Synthetic
SLEQPFK

SEQ ID NO: 4046 - protein, 7 aa, Artificial Sequence
  Synthetic
RLCGLVC

SEQ ID NO: 4047 - protein, 7 aa, Artificial Sequence
  Synthetic
TVWSREG

SEQ ID NO: 4048 - protein, 7 aa, Artificial Sequence
  Synthetic
SHWFPNG

SEQ ID NO: 4049 - protein, 7 aa, Artificial Sequence
  Synthetic
WEAFERV

SEQ ID NO: 4050 - protein, 7 aa, Artificial Sequence
  Synthetic
LTLHTSV

SEQ ID NO: 4051 - protein, 7 aa, Artificial Sequence
  Synthetic
WDLQYPI

SEQ ID NO: 4052 - protein, 7 aa, Artificial Sequence
  Synthetic
MDWVPPK

SEQ ID NO: 4053 - protein, 7 aa, Artificial Sequence
  Synthetic
SLRAPFV

SEQ ID NO: 4054 - protein, 7 aa, Artificial Sequence
  Synthetic
PHHKQWD

SEQ ID NO: 4055 - protein, 7 aa, Artificial Sequence
  Synthetic
NVSRPFL

SEQ ID NO: 4056 - protein, 7 aa, Artificial Sequence
  Synthetic
ADTGWVA

SEQ ID NO: 4057 - protein, 7 aa, Artificial Sequence
  Synthetic
SPVICSG

SEQ ID NO: 4058 - protein, 7 aa, Artificial Sequence
  Synthetic
SFTFAEV

SEQ ID NO: 4059 - protein, 7 aa, Artificial Sequence
  Synthetic
SPERPFT

SEQ ID NO: 4060 - protein, 7 aa, Artificial Sequence
  Synthetic
IGRPLGS

SEQ ID NO: 4061 - protein, 7 aa, Artificial Sequence
  Synthetic
RIQFADI

SEQ ID NO: 4062 - protein, 7 aa, Artificial Sequence
  Synthetic
MDPMPFR

SEQ ID NO: 4063 - protein, 7 aa, Artificial Sequence
  Synthetic
WGAANAL

SEQ ID NO: 4064 - protein, 7 aa, Artificial Sequence
  Synthetic
QRQFNSV

SEQ ID NO: 4065 - protein, 7 aa, Artificial Sequence
  Synthetic
GVWMGGG

SEQ ID NO: 4066 - protein, 7 aa, Artificial Sequence
  Synthetic
TALPQRQ

SEQ ID NO: 4067 - protein, 7 aa, Artificial Sequence
  Synthetic
GVGKPFL

SEQ ID NO: 4068 - protein, 7 aa, Artificial Sequence
  Synthetic
APVPHWV

SEQ ID NO: 4069 - protein, 7 aa, Artificial Sequence
  Synthetic
VEVFGRF

SEQ ID NO: 4070 - protein, 7 aa, Artificial Sequence
  Synthetic
MLERPWN

SEQ ID NO: 4071 - protein, 7 aa, Artificial Sequence
  Synthetic
LASKPFL

SEQ ID NO: 4072 - protein, 7 aa, Artificial Sequence
  Synthetic
NKLGWSP

SEQ ID NO: 4073 - protein, 7 aa, Artificial Sequence
  Synthetic
SDWTKRV

SEQ ID NO: 4074 - protein, 7 aa, Artificial Sequence
  Synthetic
LLFGAKY

SEQ ID NO: 4075 - protein, 7 aa, Artificial Sequence
  Synthetic
YDAQYFK

SEQ ID NO: 4076 - protein, 7 aa, Artificial Sequence
  Synthetic
SSNLPFR

SEQ ID NO: 4077 - protein, 7 aa, Artificial Sequence
  Synthetic
TSTFCTP

SEQ ID NO: 4078 - protein, 7 aa, Artificial Sequence
  Synthetic
DVWRASG

SEQ ID NO: 4079 - protein, 7 aa, Artificial Sequence
  Synthetic
VDPMPFH

SEQ ID NO: 4080 - protein, 7 aa, Artificial Sequence
  Synthetic
TLGRPFS

SEQ ID NO: 4081 - protein, 7 aa, Artificial Sequence
  Synthetic
VTEFGRF

SEQ ID NO: 4082 - protein, 7 aa, Artificial Sequence
  Synthetic
SLNRPFV

SEQ ID NO: 4083 - protein, 7 aa, Artificial Sequence
  Synthetic
TEFCRIM

SEQ ID NO: 4084 - protein, 7 aa, Artificial Sequence
  Synthetic
YETLPFR

SEQ ID NO: 4085 - protein, 7 aa, Artificial Sequence
  Synthetic
GVGRVFL

SEQ ID NO: 4086 - protein, 7 aa, Artificial Sequence
  Synthetic
GATPWLP

SEQ ID NO: 4087 - protein, 7 aa, Artificial Sequence
  Synthetic
NTIGWAP

SEQ ID NO: 4088 - protein, 7 aa, Artificial Sequence
  Synthetic
LDPLPFK

SEQ ID NO: 4089 - protein, 7 aa, Artificial Sequence
  Synthetic
YLGKPFV

SEQ ID NO: 4090 - protein, 7 aa, Artificial Sequence
  Synthetic
FSEMYPR

SEQ ID NO: 4091 - protein, 7 aa, Artificial Sequence
  Synthetic
SRERPFY

SEQ ID NO: 4092 - protein, 7 aa, Artificial Sequence
  Synthetic
FTLSSSK

SEQ ID NO: 4093 - protein, 7 aa, Artificial Sequence
  Synthetic
NDVHWTP

SEQ ID NO: 4094 - protein, 7 aa, Artificial Sequence
  Synthetic
VRLPDLH

SEQ ID NO: 4095 - protein, 7 aa, Artificial Sequence
  Synthetic
AAMGWAA

SEQ ID NO: 4096 - protein, 7 aa, Artificial Sequence
  Synthetic
VPMSKTW

SEQ ID NO: 4097 - protein, 7 aa, Artificial Sequence
  Synthetic
YIRTQNQ

SEQ ID NO: 4098 - protein, 7 aa, Artificial Sequence
  Synthetic
HRDMGVW

SEQ ID NO: 4099 - protein, 7 aa, Artificial Sequence
  Synthetic
VGQALGR

SEQ ID NO: 4100 - protein, 7 aa, Artificial Sequence
  Synthetic
TLTQPWI

SEQ ID NO: 4101 - protein, 7 aa, Artificial Sequence
  Synthetic
SRKFELV

SEQ ID NO: 4102 - protein, 7 aa, Artificial Sequence
  Synthetic
TVWAMNG

SEQ ID NO: 4103 - protein, 7 aa, Artificial Sequence
  Synthetic
IPDNLSW

SEQ ID NO: 4104 - protein, 7 aa, Artificial Sequence
  Synthetic
SKVGWTA

SEQ ID NO: 4105 - protein, 7 aa, Artificial Sequence
  Synthetic
DPVFRLT

SEQ ID NO: 4106 - protein, 7 aa, Artificial Sequence
  Synthetic
GVNNPFR

SEQ ID NO: 4107 - protein, 7 aa, Artificial Sequence
  Synthetic
VDWSPPR

SEQ ID NO: 4108 - protein, 7 aa, Artificial Sequence
  Synthetic
DVARPFL

SEQ ID NO: 4109 - protein, 7 aa, Artificial Sequence
  Synthetic
AKEFARV

SEQ ID NO: 4110 - protein, 7 aa, Artificial Sequence
  Synthetic
SQSRPFN

SEQ ID NO: 4111 - protein, 7 aa, Artificial Sequence
  Synthetic
PSSASSW

SEQ ID NO: 4112 - protein, 7 aa, Artificial Sequence
  Synthetic
AFGHSDW

SEQ ID NO: 4113 - protein, 7 aa, Artificial Sequence
  Synthetic
TIWAVQG

SEQ ID NO: 4114 - protein, 7 aa, Artificial Sequence
  Synthetic
GLWNAGG

SEQ ID NO: 4115 - protein, 7 aa, Artificial Sequence
  Synthetic
GATIWAP

SEQ ID NO: 4116 - protein, 7 aa, Artificial Sequence
  Synthetic
TVSQIFK

SEQ ID NO: 4117 - protein, 7 aa, Artificial Sequence
  Synthetic
GSIGWTP

SEQ ID NO: 4118 - protein, 7 aa, Artificial Sequence
  Synthetic
NTLSSSK

SEQ ID NO: 4119 - protein, 7 aa, Artificial Sequence
  Synthetic
CIARLGC

SEQ ID NO: 4120 - protein, 7 aa, Artificial Sequence
  Synthetic
IGVALGL

SEQ ID NO: 4121 - protein, 7 aa, Artificial Sequence
  Synthetic
TSIRPFL

SEQ ID NO: 4122 - protein, 7 aa, Artificial Sequence
  Synthetic
SRVFEQV

SEQ ID NO: 4123 - protein, 7 aa, Artificial Sequence
  Synthetic
DPFRLSG

SEQ ID NO: 4124 - protein, 7 aa, Artificial Sequence
  Synthetic
CINETWC

SEQ ID NO: 4125 - protein, 7 aa, Artificial Sequence
  Synthetic
TIRSPFL

SEQ ID NO: 4126 - protein, 7 aa, Artificial Sequence
  Synthetic
DAWHRNG

SEQ ID NO: 4127 - protein, 7 aa, Artificial Sequence
  Synthetic
NRVGWVA

SEQ ID NO: 4128 - protein, 7 aa, Artificial Sequence
  Synthetic
LSSRPFL

SEQ ID NO: 4129 - protein, 7 aa, Artificial Sequence
  Synthetic
WTNLGSV

SEQ ID NO: 4130 - protein, 7 aa, Artificial Sequence
  Synthetic
KPTNTSW

SEQ ID NO: 4131 - protein, 7 aa, Artificial Sequence
  Synthetic
SAPFWVN

SEQ ID NO: 4132 - protein, 7 aa, Artificial Sequence
  Synthetic
STQRPFM

SEQ ID NO: 4133 - protein, 7 aa, Artificial Sequence
  Synthetic
QVKFITV

SEQ ID NO: 4134 - protein, 7 aa, Artificial Sequence
  Synthetic
SELKPFY

SEQ ID NO: 4135 - protein, 7 aa, Artificial Sequence
  Synthetic
TDVQFFK

SEQ ID NO: 4136 - protein, 7 aa, Artificial Sequence
  Synthetic
EGRPLGQ

SEQ ID NO: 4137 - protein, 7 aa, Artificial Sequence
  Synthetic
YVDQYFL

SEQ ID NO: 4138 - protein, 7 aa, Artificial Sequence
  Synthetic
HSAGWIA

SEQ ID NO: 4139 - protein, 7 aa, Artificial Sequence
  Synthetic
CGVRLGL

SEQ ID NO: 4140 - protein, 7 aa, Artificial Sequence
  Synthetic
GPGWPGS

SEQ ID NO: 4141 - protein, 7 aa, Artificial Sequence
  Synthetic
TPVTPFR

SEQ ID NO: 4142 - protein, 7 aa, Artificial Sequence
  Synthetic
PKSFECV

SEQ ID NO: 4143 - protein, 7 aa, Artificial Sequence
  Synthetic
HVLGWAA

SEQ ID NO: 4144 - protein, 7 aa, Artificial Sequence
  Synthetic
NVWRNDG

SEQ ID NO: 4145 - protein, 7 aa, Artificial Sequence
  Synthetic
TLFCKTP

SEQ ID NO: 4146 - protein, 7 aa, Artificial Sequence
  Synthetic
YSGAPFL

SEQ ID NO: 4147 - protein, 7 aa, Artificial Sequence
  Synthetic
SVDRPFV

SEQ ID NO: 4148 - protein, 7 aa, Artificial Sequence
  Synthetic
TARMPFS

SEQ ID NO: 4149 - protein, 7 aa, Artificial Sequence
  Synthetic
GLWMYPE

SEQ ID NO: 4150 - protein, 7 aa, Artificial Sequence
  Synthetic
HAAGWIA

SEQ ID NO: 4151 - protein, 7 aa, Artificial Sequence
  Synthetic
VAQFGQF

SEQ ID NO: 4152 - protein, 7 aa, Artificial Sequence
  Synthetic
HVFSPPT

SEQ ID NO: 4153 - protein, 7 aa, Artificial Sequence
  Synthetic
GPDRPFV

SEQ ID NO: 4154 - protein, 7 aa, Artificial Sequence
  Synthetic
ATARPFL

SEQ ID NO: 4155 - protein, 7 aa, Artificial Sequence
  Synthetic
SGVPLGR

SEQ ID NO: 4156 - protein, 7 aa, Artificial Sequence
  Synthetic
TADRPWH

SEQ ID NO: 4157 - protein, 7 aa, Artificial Sequence
  Synthetic
RKQFADI

SEQ ID NO: 4158 - protein, 7 aa, Artificial Sequence
  Synthetic
VSFKTLL

SEQ ID NO: 4159 - protein, 7 aa, Artificial Sequence
  Synthetic
IGANPFT

SEQ ID NO: 4160 - protein, 7 aa, Artificial Sequence
  Synthetic
ELVRPFL

SEQ ID NO: 4161 - protein, 7 aa, Artificial Sequence
  Synthetic
VLMNTSW

SEQ ID NO: 4162 - protein, 7 aa, Artificial Sequence
  Synthetic
MKMNPFG

SEQ ID NO: 4163 - protein, 7 aa, Artificial Sequence
  Synthetic
NPANTSW

SEQ ID NO: 4164 - protein, 7 aa, Artificial Sequence
  Synthetic
VGRALGM

SEQ ID NO: 4165 - protein, 7 aa, Artificial Sequence
  Synthetic
TAFAPPR

SEQ ID NO: 4166 - protein, 7 aa, Artificial Sequence
  Synthetic
SPLRPFT

SEQ ID NO: 4167 - protein, 7 aa, Artificial Sequence
  Synthetic
KQFNPPT

SEQ ID NO: 4168 - protein, 7 aa, Artificial Sequence
  Synthetic
TATNPFL

SEQ ID NO: 4169 - protein, 7 aa, Artificial Sequence
  Synthetic
SLVGWAA

SEQ ID NO: 4170 - protein, 7 aa, Artificial Sequence
  Synthetic
SYKNFND

SEQ ID NO: 4171 - protein, 7 aa, Artificial Sequence
  Synthetic
TTLSVSR

SEQ ID NO: 4172 - protein, 7 aa, Artificial Sequence
  Synthetic
RIGVQWA

SEQ ID NO: 4173 - protein, 7 aa, Artificial Sequence
  Synthetic
TYLGKFS

SEQ ID NO: 4174 - protein, 7 aa, Artificial Sequence
  Synthetic
LVPRWPP

SEQ ID NO: 4175 - protein, 7 aa, Artificial Sequence
  Synthetic
SHWYPGG

SEQ ID NO: 4176 - protein, 7 aa, Artificial Sequence
  Synthetic
TEKAPFL

SEQ ID NO: 4177 - protein, 7 aa, Artificial Sequence
  Synthetic
VVFESPR

SEQ ID NO: 4178 - protein, 7 aa, Artificial Sequence
  Synthetic
TVWFPQG

SEQ ID NO: 4179 - protein, 7 aa, Artificial Sequence
  Synthetic
LGQPWIA

SEQ ID NO: 4180 - protein, 7 aa, Artificial Sequence
  Synthetic
VGHLPFH

SEQ ID NO: 4181 - protein, 7 aa, Artificial Sequence
  Synthetic
SSERPFQ

SEQ ID NO: 4182 - protein, 7 aa, Artificial Sequence
  Synthetic
GNVGWVA

SEQ ID NO: 4183 - protein, 7 aa, Artificial Sequence
  Synthetic
GAFLPPT

SEQ ID NO: 4184 - protein, 7 aa, Artificial Sequence
  Synthetic
SHKFEVV

SEQ ID NO: 4185 - protein, 7 aa, Artificial Sequence
  Synthetic
LPEWGMF

SEQ ID NO: 4186 - protein, 7 aa, Artificial Sequence
  Synthetic
DMGATGR

SEQ ID NO: 4187 - protein, 7 aa, Artificial Sequence
  Synthetic
ESLRPFL

SEQ ID NO: 4188 - protein, 7 aa, Artificial Sequence
  Synthetic
NLFAPPK

SEQ ID NO: 4189 - protein, 7 aa, Artificial Sequence
  Synthetic
SEYGFLP

SEQ ID NO: 4190 - protein, 7 aa, Artificial Sequence
  Synthetic
GPVFKLP

SEQ ID NO: 4191 - protein, 7 aa, Artificial Sequence
  Synthetic
APTHEWL

SEQ ID NO: 4192 - protein, 7 aa, Artificial Sequence
  Synthetic
REGRFGT

SEQ ID NO: 4193 - protein, 7 aa, Artificial Sequence
  Synthetic
YQGAPFY

SEQ ID NO: 4194 - protein, 7 aa, Artificial Sequence
  Synthetic
RAVFAQV

SEQ ID NO: 4195 - protein, 7 aa, Artificial Sequence
  Synthetic
LGTALGR

SEQ ID NO: 4196 - protein, 7 aa, Artificial Sequence
  Synthetic
GLQRIFP

SEQ ID NO: 4197 - protein, 7 aa, Artificial Sequence
  Synthetic
TREFCNV

SEQ ID NO: 4198 - protein, 7 aa, Artificial Sequence
  Synthetic
STDHPFR

SEQ ID NO: 4199 - protein, 7 aa, Artificial Sequence
  Synthetic
TPDRPWH

SEQ ID NO: 4200 - protein, 7 aa, Artificial Sequence
  Synthetic
IPLFEKI

SEQ ID NO: 4201 - protein, 7 aa, Artificial Sequence
  Synthetic
SHNFASI

SEQ ID NO: 4202 - protein, 7 aa, Artificial Sequence
  Synthetic
LTLTTSV

SEQ ID NO: 4203 - protein, 7 aa, Artificial Sequence
  Synthetic
SHDIPFR

SEQ ID NO: 4204 - protein, 7 aa, Artificial Sequence
  Synthetic
KNSNWLD

SEQ ID NO: 4205 - protein, 7 aa, Artificial Sequence
  Synthetic
MVDRPWI

SEQ ID NO: 4206 - protein, 7 aa, Artificial Sequence
  Synthetic
DDRHWTP

SEQ ID NO: 4207 - protein, 7 aa, Artificial Sequence
  Synthetic
GDWVIPQ

SEQ ID NO: 4208 - protein, 7 aa, Artificial Sequence
  Synthetic
EALRPFM

SEQ ID NO: 4209 - protein, 7 aa, Artificial Sequence
  Synthetic
GSEWGKF

SEQ ID NO: 4210 - protein, 7 aa, Artificial Sequence
  Synthetic
GSFGFLP

SEQ ID NO: 4211 - protein, 7 aa, Artificial Sequence
  Synthetic
EEGYWSP

SEQ ID NO: 4212 - protein, 7 aa, Artificial Sequence
  Synthetic
SESGWVA

SEQ ID NO: 4213 - protein, 7 aa, Artificial Sequence
  Synthetic
LAMTTSW

SEQ ID NO: 4214 - protein, 7 aa, Artificial Sequence
  Synthetic
AVTFSNI

SEQ ID NO: 4215 - protein, 7 aa, Artificial Sequence
  Synthetic
WSVLETV

SEQ ID NO: 4216 - protein, 7 aa, Artificial Sequence
  Synthetic
VPMSRSF

SEQ ID NO: 4217 - protein, 7 aa, Artificial Sequence
  Synthetic
STQRPFT

SEQ ID NO: 4218 - protein, 7 aa, Artificial Sequence
  Synthetic
LNFATLT

SEQ ID NO: 4219 - protein, 7 aa, Artificial Sequence
  Synthetic
TDTQYFR

SEQ ID NO: 4220 - protein, 7 aa, Artificial Sequence
  Synthetic
WDSSGPR

SEQ ID NO: 4221 - protein, 7 aa, Artificial Sequence
  Synthetic
SVAVPFR

SEQ ID NO: 4222 - protein, 7 aa, Artificial Sequence
  Synthetic
IWEQPHG

SEQ ID NO: 4223 - protein, 7 aa, Artificial Sequence
  Synthetic
NSFSPPY

SEQ ID NO: 4224 - protein, 7 aa, Artificial Sequence
  Synthetic
VGVPLGY

SEQ ID NO: 4225 - protein, 7 aa, Artificial Sequence
  Synthetic
AASRPFM

SEQ ID NO: 4226 - protein, 7 aa, Artificial Sequence
  Synthetic
DIVHPFR

SEQ ID NO: 4227 - protein, 7 aa, Artificial Sequence
  Synthetic
ASVGWIG

SEQ ID NO: 4228 - protein, 7 aa, Artificial Sequence
  Synthetic
YSTNLFL

SEQ ID NO: 4229 - protein, 7 aa, Artificial Sequence
  Synthetic
GHWVPPE

SEQ ID NO: 4230 - protein, 7 aa, Artificial Sequence
  Synthetic
GETRPFL

SEQ ID NO: 4231 - protein, 7 aa, Artificial Sequence
  Synthetic
NQLPWVA

SEQ ID NO: 4232 - protein, 7 aa, Artificial Sequence
  Synthetic
SGTPWIG

SEQ ID NO: 4233 - protein, 7 aa, Artificial Sequence
  Synthetic
RLGWPLG

SEQ ID NO: 4234 - protein, 7 aa, Artificial Sequence
  Synthetic
LDLPFLP

SEQ ID NO: 4235 - protein, 7 aa, Artificial Sequence
  Synthetic
STIGWIA

SEQ ID NO: 4236 - protein, 7 aa, Artificial Sequence
  Synthetic
TVWREYG

SEQ ID NO: 4237 - protein, 7 aa, Artificial Sequence
  Synthetic
AEIGWAA

SEQ ID NO: 4238 - protein, 7 aa, Artificial Sequence
  Synthetic
GLTGKSG

SEQ ID NO: 4239 - protein, 7 aa, Artificial Sequence
  Synthetic
SVRAPFL

SEQ ID NO: 4240 - protein, 7 aa, Artificial Sequence
  Synthetic
AEWVPPM

SEQ ID NO: 4241 - protein, 7 aa, Artificial Sequence
  Synthetic
NGMRSVF

SEQ ID NO: 4242 - protein, 7 aa, Artificial Sequence
  Synthetic
GMFFEGM

SEQ ID NO: 4243 - protein, 7 aa, Artificial Sequence
  Synthetic
SPWGPNH

SEQ ID NO: 4244 - protein, 7 aa, Artificial Sequence
  Synthetic
GSWLIEA

SEQ ID NO: 4245 - protein, 7 aa, Artificial Sequence
  Synthetic
GEQFCAF

SEQ ID NO: 4246 - protein, 7 aa, Artificial Sequence
  Synthetic
ITKLCTV

SEQ ID NO: 4247 - protein, 7 aa, Artificial Sequence
  Synthetic
FGVLPFM

SEQ ID NO: 4248 - protein, 7 aa, Artificial Sequence
  Synthetic
FISGGPY

SEQ ID NO: 4249 - protein, 7 aa, Artificial Sequence
  Synthetic
DTLPFRY

SEQ ID NO: 4250 - protein, 7 aa, Artificial Sequence
  Synthetic
IWRPGTV

SEQ ID NO: 4251 - protein, 7 aa, Artificial Sequence
  Synthetic
KSSFASI

SEQ ID NO: 4252 - protein, 7 aa, Artificial Sequence
  Synthetic
SPMAPFL

SEQ ID NO: 4253 - protein, 7 aa, Artificial Sequence
  Synthetic
VPARPFL

SEQ ID NO: 4254 - protein, 7 aa, Artificial Sequence
  Synthetic
GQWIIEA

SEQ ID NO: 4255 - protein, 7 aa, Artificial Sequence
  Synthetic
TVWAERG

SEQ ID NO: 4256 - protein, 7 aa, Artificial Sequence
  Synthetic
TGGPVTW

SEQ ID NO: 4257 - protein, 7 aa, Artificial Sequence
  Synthetic
NDTYWTP

SEQ ID NO: 4258 - protein, 7 aa, Artificial Sequence
  Synthetic
TPLGWAA

SEQ ID NO: 4259 - protein, 7 aa, Artificial Sequence
  Synthetic
APSSISW

SEQ ID NO: 4260 - protein, 7 aa, Artificial Sequence
  Synthetic
NSWGPQH

SEQ ID NO: 4261 - protein, 7 aa, Artificial Sequence
  Synthetic
SAMGWVA

SEQ ID NO: 4262 - protein, 7 aa, Artificial Sequence
  Synthetic
SLERVFS

SEQ ID NO: 4263 - protein, 7 aa, Artificial Sequence
  Synthetic
WAENPFR

SEQ ID NO: 4264 - protein, 7 aa, Artificial Sequence
  Synthetic
IEFVPPR

SEQ ID NO: 4265 - protein, 7 aa, Artificial Sequence
  Synthetic
WEFNSPR

SEQ ID NO: 4266 - protein, 7 aa, Artificial Sequence
  Synthetic
AQSNYSW

SEQ ID NO: 4267 - protein, 7 aa, Artificial Sequence
  Synthetic
ISVIPYP

SEQ ID NO: 4268 - protein, 7 aa, Artificial Sequence
  Synthetic
YTIAGPR

SEQ ID NO: 4269 - protein, 7 aa, Artificial Sequence
  Synthetic
APAQPWH

SEQ ID NO: 4270 - protein, 7 aa, Artificial Sequence
  Synthetic
SLRAPFN

SEQ ID NO: 4271 - protein, 7 aa, Artificial Sequence
  Synthetic
SGELPWR

SEQ ID NO: 4272 - protein, 7 aa, Artificial Sequence
  Synthetic
DWRGDNW

SEQ ID NO: 4273 - protein, 7 aa, Artificial Sequence
  Synthetic
SRERPFT

SEQ ID NO: 4274 - protein, 7 aa, Artificial Sequence
  Synthetic
GLWFPQG

SEQ ID NO: 4275 - protein, 7 aa, Artificial Sequence
  Synthetic
KTSFASV

SEQ ID NO: 4276 - protein, 7 aa, Artificial Sequence
  Synthetic
SVVGWAA

SEQ ID NO: 4277 - protein, 7 aa, Artificial Sequence
  Synthetic
IGRALGY

SEQ ID NO: 4278 - protein, 7 aa, Artificial Sequence
  Synthetic
HAVGWVA

SEQ ID NO: 4279 - protein, 7 aa, Artificial Sequence
  Synthetic
VYDFGKF

SEQ ID NO: 4280 - protein, 7 aa, Artificial Sequence
  Synthetic
FTQSYPM

SEQ ID NO: 4281 - protein, 7 aa, Artificial Sequence
  Synthetic
GLSGWVA

SEQ ID NO: 4282 - protein, 7 aa, Artificial Sequence
  Synthetic
YGTHIFT

SEQ ID NO: 4283 - protein, 7 aa, Artificial Sequence
  Synthetic
EPMTISW

SEQ ID NO: 4284 - protein, 7 aa, Artificial Sequence
  Synthetic
YANRPFT

SEQ ID NO: 4285 - protein, 7 aa, Artificial Sequence
  Synthetic
VGARPLQ

SEQ ID NO: 4286 - protein, 7 aa, Artificial Sequence
  Synthetic
YVGWPFA

SEQ ID NO: 4287 - protein, 7 aa, Artificial Sequence
  Synthetic
LGHALGT

SEQ ID NO: 4288 - protein, 7 aa, Artificial Sequence
  Synthetic
DVFRLQG

SEQ ID NO: 4289 - protein, 7 aa, Artificial Sequence
  Synthetic
NGKFCQV

SEQ ID NO: 4290 - protein, 7 aa, Artificial Sequence
  Synthetic
GIWFPNG

SEQ ID NO: 4291 - protein, 7 aa, Artificial Sequence
  Synthetic
FSLHTSV

SEQ ID NO: 4292 - protein, 7 aa, Artificial Sequence
  Synthetic
DRQWPGS

SEQ ID NO: 4293 - protein, 7 aa, Artificial Sequence
  Synthetic
SAGWGAP

SEQ ID NO: 4294 - protein, 7 aa, Artificial Sequence
  Synthetic
GDFSPPM

SEQ ID NO: 4295 - protein, 7 aa, Artificial Sequence
  Synthetic
TAQAPFR

SEQ ID NO: 4296 - protein, 7 aa, Artificial Sequence
  Synthetic
AQSFANV

SEQ ID NO: 4297 - protein, 7 aa, Artificial Sequence
  Synthetic
VDTPWVA

SEQ ID NO: 4298 - protein, 7 aa, Artificial Sequence
  Synthetic
CLWAPSG

SEQ ID NO: 4299 - protein, 7 aa, Artificial Sequence
  Synthetic
QGKFCDI

SEQ ID NO: 4300 - protein, 7 aa, Artificial Sequence
  Synthetic
NTLQASR

SEQ ID NO: 4301 - protein, 7 aa, Artificial Sequence
  Synthetic
SPIGWSA

SEQ ID NO: 4302 - protein, 7 aa, Artificial Sequence
  Synthetic
LRPRDNG

SEQ ID NO: 4303 - protein, 7 aa, Artificial Sequence
  Synthetic
PVSFSKV

SEQ ID NO: 4304 - protein, 7 aa, Artificial Sequence
  Synthetic
GRLPVIP

SEQ ID NO: 4305 - protein, 7 aa, Artificial Sequence
  Synthetic
QVKLSMV

SEQ ID NO: 4306 - protein, 7 aa, Artificial Sequence
  Synthetic
SSTFCSP

SEQ ID NO: 4307 - protein, 7 aa, Artificial Sequence
  Synthetic
YPERLFA

SEQ ID NO: 4308 - protein, 7 aa, Artificial Sequence
  Synthetic
WLLGGSG

SEQ ID NO: 4309 - protein, 7 aa, Artificial Sequence
  Synthetic
PESRVSW

SEQ ID NO: 4310 - protein, 7 aa, Artificial Sequence
  Synthetic
QLNFSNI

SEQ ID NO: 4311 - protein, 7 aa, Artificial Sequence
  Synthetic
GKEGFIA

SEQ ID NO: 4312 - protein, 7 aa, Artificial Sequence
  Synthetic
GLSPWVA

SEQ ID NO: 4313 - protein, 7 aa, Artificial Sequence
  Synthetic
GYPQLGP

SEQ ID NO: 4314 - protein, 7 aa, Artificial Sequence
  Synthetic
WTEAWPR

SEQ ID NO: 4315 - protein, 7 aa, Artificial Sequence
  Synthetic
VLNGSNR

SEQ ID NO: 4316 - protein, 7 aa, Artificial Sequence
  Synthetic
SDRGWTA

SEQ ID NO: 4317 - protein, 7 aa, Artificial Sequence
  Synthetic
FTLASPR

SEQ ID NO: 4318 - protein, 7 aa, Artificial Sequence
  Synthetic
TPWMPFQ

SEQ ID NO: 4319 - protein, 7 aa, Artificial Sequence
  Synthetic
VVGGWIA

SEQ ID NO: 4320 - protein, 7 aa, Artificial Sequence
  Synthetic
SQVDWIK

SEQ ID NO: 4321 - protein, 7 aa, Artificial Sequence
  Synthetic
SVIVPFR

SEQ ID NO: 4322 - protein, 7 aa, Artificial Sequence
  Synthetic
GLWESGG

SEQ ID NO: 4323 - protein, 7 aa, Artificial Sequence
  Synthetic
QRRFEEV

SEQ ID NO: 4324 - protein, 7 aa, Artificial Sequence
  Synthetic
WVCWGCE

SEQ ID NO: 4325 - protein, 7 aa, Artificial Sequence
  Synthetic
LGRPLGI

SEQ ID NO: 4326 - protein, 7 aa, Artificial Sequence
  Synthetic
TLSRVFP

SEQ ID NO: 4327 - protein, 7 aa, Artificial Sequence
  Synthetic
FSLRYPL

SEQ ID NO: 4328 - protein, 7 aa, Artificial Sequence
  Synthetic
YAGVWFN

SEQ ID NO: 4329 - protein, 7 aa, Artificial Sequence
  Synthetic
TVWLKAG

SEQ ID NO: 4330 - protein, 7 aa, Artificial Sequence
  Synthetic
TGTRPFV

SEQ ID NO: 4331 - protein, 7 aa, Artificial Sequence
  Synthetic
VGVALGR

SEQ ID NO: 4332 - protein, 7 aa, Artificial Sequence
  Synthetic
GVSFCGA

SEQ ID NO: 4333 - protein, 7 aa, Artificial Sequence
  Synthetic
PVTRTSW

SEQ ID NO: 4334 - protein, 7 aa, Artificial Sequence
  Synthetic
KECGWVC

SEQ ID NO: 4335 - protein, 7 aa, Artificial Sequence
  Synthetic
TIRFENV

SEQ ID NO: 4336 - protein, 7 aa, Artificial Sequence
  Synthetic
LLVQLFG

SEQ ID NO: 4337 - protein, 7 aa, Artificial Sequence
  Synthetic
FDERLFR

SEQ ID NO: 4338 - protein, 7 aa, Artificial Sequence
  Synthetic
QPTSPWL

SEQ ID NO: 4339 - protein, 7 aa, Artificial Sequence
  Synthetic
SGVALGR

SEQ ID NO: 4340 - protein, 7 aa, Artificial Sequence
  Synthetic
QNRLAMV

SEQ ID NO: 4341 - protein, 7 aa, Artificial Sequence
  Synthetic
TVWRLEG

SEQ ID NO: 4342 - protein, 7 aa, Artificial Sequence
  Synthetic
CGRALGT

SEQ ID NO: 4343 - protein, 7 aa, Artificial Sequence
  Synthetic
DPFSERR

SEQ ID NO: 4344 - protein, 7 aa, Artificial Sequence
  Synthetic
KTEWPYP

SEQ ID NO: 4345 - protein, 7 aa, Artificial Sequence
  Synthetic
NAVGWLA

SEQ ID NO: 4346 - protein, 7 aa, Artificial Sequence
  Synthetic
ATFTPPR

SEQ ID NO: 4347 - protein, 7 aa, Artificial Sequence
  Synthetic
DLRWPGS

SEQ ID NO: 4348 - protein, 7 aa, Artificial Sequence
  Synthetic
DTTPWLP

SEQ ID NO: 4349 - protein, 7 aa, Artificial Sequence
  Synthetic
FLNPWPA

SEQ ID NO: 4350 - protein, 7 aa, Artificial Sequence
  Synthetic
YATQFFS

SEQ ID NO: 4351 - protein, 7 aa, Artificial Sequence
  Synthetic
NAIRPFI

SEQ ID NO: 4352 - protein, 7 aa, Artificial Sequence
  Synthetic
SAMGFIA

SEQ ID NO: 4353 - protein, 7 aa, Artificial Sequence
  Synthetic
YVGRIWE

SEQ ID NO: 4354 - protein, 7 aa, Artificial Sequence
  Synthetic
TCAKPFL

SEQ ID NO: 4355 - protein, 7 aa, Artificial Sequence
  Synthetic
YLSKPFV

SEQ ID NO: 4356 - protein, 7 aa, Artificial Sequence
  Synthetic
GLYGFVA

SEQ ID NO: 4357 - protein, 7 aa, Artificial Sequence
  Synthetic
VDGWYAP

SEQ ID NO: 4358 - protein, 7 aa, Artificial Sequence
  Synthetic
AGGPWIA

SEQ ID NO: 4359 - protein, 7 aa, Artificial Sequence
  Synthetic
GVYIPPA

SEQ ID NO: 4360 - protein, 7 aa, Artificial Sequence
  Synthetic
LMRVPPI

SEQ ID NO: 4361 - protein, 7 aa, Artificial Sequence
  Synthetic
LGVPFGR

SEQ ID NO: 4362 - protein, 7 aa, Artificial Sequence
  Synthetic
VGRALGV

SEQ ID NO: 4363 - protein, 7 aa, Artificial Sequence
  Synthetic
TRLGFLP

SEQ ID NO: 4364 - protein, 7 aa, Artificial Sequence
  Synthetic
FGVGLAV

SEQ ID NO: 4365 - protein, 7 aa, Artificial Sequence
  Synthetic
YPMSLSF

SEQ ID NO: 4366 - protein, 7 aa, Artificial Sequence
  Synthetic
SNHFANV

SEQ ID NO: 4367 - protein, 7 aa, Artificial Sequence
  Synthetic
DMSWGAF

SEQ ID NO: 4368 - protein, 7 aa, Artificial Sequence
  Synthetic
EKSWGAF

SEQ ID NO: 4369 - protein, 7 aa, Artificial Sequence
  Synthetic
TKELPFR

SEQ ID NO: 4370 - protein, 7 aa, Artificial Sequence
  Synthetic
HQFAPPA

SEQ ID NO: 4371 - protein, 7 aa, Artificial Sequence
  Synthetic
GYLTFVA

SEQ ID NO: 4372 - protein, 7 aa, Artificial Sequence
  Synthetic
EKSFCKE

SEQ ID NO: 4373 - protein, 7 aa, Artificial Sequence
  Synthetic
DGTPWLA

SEQ ID NO: 4374 - protein, 7 aa, Artificial Sequence
  Synthetic
KTSNAHS

SEQ ID NO: 4375 - protein, 7 aa, Artificial Sequence
  Synthetic
LGRPLGS

SEQ ID NO: 4376 - protein, 7 aa, Artificial Sequence
  Synthetic
VGRPIGM

SEQ ID NO: 4377 - protein, 7 aa, Artificial Sequence
  Synthetic
HKTGWVA

SEQ ID NO: 4378 - protein, 7 aa, Artificial Sequence
  Synthetic
ALPRDWL

SEQ ID NO: 4379 - protein, 7 aa, Artificial Sequence
  Synthetic
SYILPFH

SEQ ID NO: 4380 - protein, 7 aa, Artificial Sequence
  Synthetic
PRSGFNT

SEQ ID NO: 4381 - protein, 7 aa, Artificial Sequence
  Synthetic
NMWFPGG

SEQ ID NO: 4382 - protein, 7 aa, Artificial Sequence
  Synthetic
DLNRPFR

SEQ ID NO: 4383 - protein, 7 aa, Artificial Sequence
  Synthetic
SSRFAEV

SEQ ID NO: 4384 - protein, 7 aa, Artificial Sequence
  Synthetic
TIVMPFV

SEQ ID NO: 4385 - protein, 7 aa, Artificial Sequence
  Synthetic
TLEALFR

SEQ ID NO: 4386 - protein, 7 aa, Artificial Sequence
  Synthetic
IGVVPFH

SEQ ID NO: 4387 - protein, 7 aa, Artificial Sequence
  Synthetic
TEAAFFR

SEQ ID NO: 4388 - protein, 7 aa, Artificial Sequence
  Synthetic
DVFRLGS

SEQ ID NO: 4389 - protein, 7 aa, Artificial Sequence
  Synthetic
ETGWPGA

SEQ ID NO: 4390 - protein, 7 aa, Artificial Sequence
  Synthetic
LEWTPPR

SEQ ID NO: 4391 - protein, 7 aa, Artificial Sequence
  Synthetic
GTFLPPT

SEQ ID NO: 4392 - protein, 7 aa, Artificial Sequence
  Synthetic
IVPSPFR

SEQ ID NO: 4393 - protein, 7 aa, Artificial Sequence
  Synthetic
RTWEGGG

SEQ ID NO: 4394 - protein, 7 aa, Artificial Sequence
  Synthetic
VDFVPPR

SEQ ID NO: 4395 - protein, 7 aa, Artificial Sequence
  Synthetic
NPTTTWR

SEQ ID NO: 4396 - protein, 7 aa, Artificial Sequence
  Synthetic
GMVGWVP

SEQ ID NO: 4397 - protein, 7 aa, Artificial Sequence
  Synthetic
DVWRKEG

SEQ ID NO: 4398 - protein, 7 aa, Artificial Sequence
  Synthetic
YSDRMFL

SEQ ID NO: 4399 - protein, 7 aa, Artificial Sequence
  Synthetic
TGTPWLA

SEQ ID NO: 4400 - protein, 7 aa, Artificial Sequence
  Synthetic
LTISTSR

SEQ ID NO: 4401 - protein, 7 aa, Artificial Sequence
  Synthetic
VAEFCRV

SEQ ID NO: 4402 - protein, 7 aa, Artificial Sequence
  Synthetic
SEHRPFI

SEQ ID NO: 4403 - protein, 7 aa, Artificial Sequence
  Synthetic
GWLGFAA

SEQ ID NO: 4404 - protein, 7 aa, Artificial Sequence
  Synthetic
TVARLFV

SEQ ID NO: 4405 - protein, 7 aa, Artificial Sequence
  Synthetic
YGTSPFY

SEQ ID NO: 4406 - protein, 7 aa, Artificial Sequence
  Synthetic
SASWPFA

SEQ ID NO: 4407 - protein, 7 aa, Artificial Sequence
  Synthetic
HAVPWVA

SEQ ID NO: 4408 - protein, 7 aa, Artificial Sequence
  Synthetic
QVRFQSV

SEQ ID NO: 4409 - protein, 7 aa, Artificial Sequence
  Synthetic
WERFSHV

SEQ ID NO: 4410 - protein, 7 aa, Artificial Sequence
  Synthetic
SVRMPFN

SEQ ID NO: 4411 - protein, 7 aa, Artificial Sequence
  Synthetic
SGDRPFL

SEQ ID NO: 4412 - protein, 7 aa, Artificial Sequence
  Synthetic
YVDKFFL

SEQ ID NO: 4413 - protein, 7 aa, Artificial Sequence
  Synthetic
TQKLPWT

SEQ ID NO: 4414 - protein, 7 aa, Artificial Sequence
  Synthetic
PRIVNTY

SEQ ID NO: 4415 - protein, 7 aa, Artificial Sequence
  Synthetic
TPAAPFL

SEQ ID NO: 4416 - protein, 7 aa, Artificial Sequence
  Synthetic
FDERYWA

SEQ ID NO: 4417 - protein, 7 aa, Artificial Sequence
  Synthetic
GIFARPM

SEQ ID NO: 4418 - protein, 7 aa, Artificial Sequence
  Synthetic
LGFSPPH

SEQ ID NO: 4419 - protein, 7 aa, Artificial Sequence
  Synthetic
VGVALGH

SEQ ID NO: 4420 - protein, 7 aa, Artificial Sequence
  Synthetic
YDGYLFT

SEQ ID NO: 4421 - protein, 7 aa, Artificial Sequence
  Synthetic
YPSRPFV

SEQ ID NO: 4422 - protein, 7 aa, Artificial Sequence
  Synthetic
QPANTSW

SEQ ID NO: 4423 - protein, 7 aa, Artificial Sequence
  Synthetic
PEVKHWV

SEQ ID NO: 4424 - protein, 7 aa, Artificial Sequence
  Synthetic
APMGWAA

SEQ ID NO: 4425 - protein, 7 aa, Artificial Sequence
  Synthetic
TTMHTSK

SEQ ID NO: 4426 - protein, 7 aa, Artificial Sequence
  Synthetic
WKVFQDV

SEQ ID NO: 4427 - protein, 7 aa, Artificial Sequence
  Synthetic
DPIWKSS

SEQ ID NO: 4428 - protein, 7 aa, Artificial Sequence
  Synthetic
SKVGWAP

SEQ ID NO: 4429 - protein, 7 aa, Artificial Sequence
  Synthetic
LDFKSMH

SEQ ID NO: 4430 - protein, 7 aa, Artificial Sequence
  Synthetic
KDVFHLL

SEQ ID NO: 4431 - protein, 7 aa, Artificial Sequence
  Synthetic
EPVRGWL

SEQ ID NO: 4432 - protein, 7 aa, Artificial Sequence
  Synthetic
GGAVTRL

SEQ ID NO: 4433 - protein, 7 aa, Artificial Sequence
  Synthetic
SRTGWTA

SEQ ID NO: 4434 - protein, 7 aa, Artificial Sequence
  Synthetic
GVWVPPS

SEQ ID NO: 4435 - protein, 7 aa, Artificial Sequence
  Synthetic
SEMQPFR

SEQ ID NO: 4436 - protein, 7 aa, Artificial Sequence
  Synthetic
FDSSGPR

SEQ ID NO: 4437 - protein, 7 aa, Artificial Sequence
  Synthetic
NDLPYRY

SEQ ID NO: 4438 - protein, 7 aa, Artificial Sequence
  Synthetic
GGFIPPE

SEQ ID NO: 4439 - protein, 7 aa, Artificial Sequence
  Synthetic
TMGHLLR

SEQ ID NO: 4440 - protein, 7 aa, Artificial Sequence
  Synthetic
PISSSSW

SEQ ID NO: 4441 - protein, 7 aa, Artificial Sequence
  Synthetic
DDWGFVA

SEQ ID NO: 4442 - protein, 7 aa, Artificial Sequence
  Synthetic
TASMPFL

SEQ ID NO: 4443 - protein, 7 aa, Artificial Sequence
  Synthetic
GRFVPPQ

SEQ ID NO: 4444 - protein, 7 aa, Artificial Sequence
  Synthetic
AAVFHEI

SEQ ID NO: 4445 - protein, 7 aa, Artificial Sequence
  Synthetic
WDLVGPR

SEQ ID NO: 4446 - protein, 7 aa, Artificial Sequence
  Synthetic
DKDVASS

SEQ ID NO: 4447 - protein, 7 aa, Artificial Sequence
  Synthetic
SAVHWAP

SEQ ID NO: 4448 - protein, 7 aa, Artificial Sequence
  Synthetic
TLNYPFI

SEQ ID NO: 4449 - protein, 7 aa, Artificial Sequence
  Synthetic
SLIFKNV

SEQ ID NO: 4450 - protein, 7 aa, Artificial Sequence
  Synthetic
NELGWHP

SEQ ID NO: 4451 - protein, 7 aa, Artificial Sequence
  Synthetic
GVSYNPF

SEQ ID NO: 4452 - protein, 7 aa, Artificial Sequence
  Synthetic
SVEKPFW

SEQ ID NO: 4453 - protein, 7 aa, Artificial Sequence
  Synthetic
TEYFPFK

SEQ ID NO: 4454 - protein, 7 aa, Artificial Sequence
  Synthetic
DMTKPWL

SEQ ID NO: 4455 - protein, 7 aa, Artificial Sequence
  Synthetic
SLSKPFA

SEQ ID NO: 4456 - protein, 7 aa, Artificial Sequence
  Synthetic
EKHPHFL

SEQ ID NO: 4457 - protein, 7 aa, Artificial Sequence
  Synthetic
QVSFEVI

SEQ ID NO: 4458 - protein, 7 aa, Artificial Sequence
  Synthetic
GVSFCPV

SEQ ID NO: 4459 - protein, 7 aa, Artificial Sequence
  Synthetic
GALPIVP

SEQ ID NO: 4460 - protein, 7 aa, Artificial Sequence
  Synthetic
QVVFQYV

SEQ ID NO: 4461 - protein, 7 aa, Artificial Sequence
  Synthetic
EGNPWRA

SEQ ID NO: 4462 - protein, 7 aa, Artificial Sequence
  Synthetic
GITVPFR

SEQ ID NO: 4463 - protein, 7 aa, Artificial Sequence
  Synthetic
ITISTSK

SEQ ID NO: 4464 - protein, 7 aa, Artificial Sequence
  Synthetic
GKWSPPA

SEQ ID NO: 4465 - protein, 7 aa, Artificial Sequence
  Synthetic
ALQRFPL

SEQ ID NO: 4466 - protein, 7 aa, Artificial Sequence
  Synthetic
FDHAGPR

SEQ ID NO: 4467 - protein, 7 aa, Artificial Sequence
  Synthetic
GTSGWIA

SEQ ID NO: 4468 - protein, 7 aa, Artificial Sequence
  Synthetic
YPERVFV

SEQ ID NO: 4469 - protein, 7 aa, Artificial Sequence
  Synthetic
WGHAHER

SEQ ID NO: 4470 - protein, 7 aa, Artificial Sequence
  Synthetic
SVVFERV

SEQ ID NO: 4471 - protein, 7 aa, Artificial Sequence
  Synthetic
GSWIVEA

SEQ ID NO: 4472 - protein, 7 aa, Artificial Sequence
  Synthetic
NLANFAS

SEQ ID NO: 4473 - protein, 7 aa, Artificial Sequence
  Synthetic
ILKGAAV

SEQ ID NO: 4474 - protein, 7 aa, Artificial Sequence
  Synthetic
FTAVGPK

SEQ ID NO: 4475 - protein, 7 aa, Artificial Sequence
  Synthetic
STSKPFY

SEQ ID NO: 4476 - protein, 7 aa, Artificial Sequence
  Synthetic
GPIGFIP

SEQ ID NO: 4477 - protein, 7 aa, Artificial Sequence
  Synthetic
LQWSPPK

SEQ ID NO: 4478 - protein, 7 aa, Artificial Sequence
  Synthetic
WDEYPRP

SEQ ID NO: 4479 - protein, 7 aa, Artificial Sequence
  Synthetic
PLKFSNV

SEQ ID NO: 4480 - protein, 7 aa, Artificial Sequence
  Synthetic
YSERIFH

SEQ ID NO: 4481 - protein, 7 aa, Artificial Sequence
  Synthetic
AAGWGAA

SEQ ID NO: 4482 - protein, 7 aa, Artificial Sequence
  Synthetic
SVHGFYP

SEQ ID NO: 4483 - protein, 7 aa, Artificial Sequence
  Synthetic
GLGGWIA

SEQ ID NO: 4484 - protein, 7 aa, Artificial Sequence
  Synthetic
ENTVWVP

SEQ ID NO: 4485 - protein, 7 aa, Artificial Sequence
  Synthetic
NYDKPWI

SEQ ID NO: 4486 - protein, 7 aa, Artificial Sequence
  Synthetic
VGVPLGK

SEQ ID NO: 4487 - protein, 7 aa, Artificial Sequence
  Synthetic
SLSNPFT

SEQ ID NO: 4488 - protein, 7 aa, Artificial Sequence
  Synthetic
TRDVPWL

SEQ ID NO: 4489 - protein, 7 aa, Artificial Sequence
  Synthetic
GPQMPFK

SEQ ID NO: 4490 - protein, 7 aa, Artificial Sequence
  Synthetic
LYGHYGP

SEQ ID NO: 4491 - protein, 7 aa, Artificial Sequence
  Synthetic
ALWADVN

SEQ ID NO: 4492 - protein, 7 aa, Artificial Sequence
  Synthetic
HGQWPTG

SEQ ID NO: 4493 - protein, 7 aa, Artificial Sequence
  Synthetic
WAQPNTK

SEQ ID NO: 4494 - protein, 7 aa, Artificial Sequence
  Synthetic
DRTSSRT

SEQ ID NO: 4495 - protein, 7 aa, Artificial Sequence
  Synthetic
GQFLHPH

SEQ ID NO: 4496 - protein, 7 aa, Artificial Sequence
  Synthetic
QPTFCVA

SEQ ID NO: 4497 - protein, 7 aa, Artificial Sequence
  Synthetic
PQSFSNV

SEQ ID NO: 4498 - protein, 7 aa, Artificial Sequence
  Synthetic
LGAMPFL

SEQ ID NO: 4499 - protein, 7 aa, Artificial Sequence
  Synthetic
SVKWAEF

SEQ ID NO: 4500 - protein, 7 aa, Artificial Sequence
  Synthetic
VGVFPPK

SEQ ID NO: 4501 - protein, 7 aa, Artificial Sequence
  Synthetic
LNLGFHP

SEQ ID NO: 4502 - protein, 7 aa, Artificial Sequence
  Synthetic
YSQALFK

SEQ ID NO: 4503 - protein, 7 aa, Artificial Sequence
  Synthetic
FTLRSPL

SEQ ID NO: 4504 - protein, 7 aa, Artificial Sequence
  Synthetic
LGRPLGH

SEQ ID NO: 4505 - protein, 7 aa, Artificial Sequence
  Synthetic
SMRFEHI

SEQ ID NO: 4506 - protein, 7 aa, Artificial Sequence
  Synthetic
TVTRMFV

SEQ ID NO: 4507 - protein, 7 aa, Artificial Sequence
  Synthetic
NVEHVFR

SEQ ID NO: 4508 - protein, 7 aa, Artificial Sequence
  Synthetic
LTLTSSI

SEQ ID NO: 4509 - protein, 7 aa, Artificial Sequence
  Synthetic
WLERPFA

SEQ ID NO: 4510 - protein, 7 aa, Artificial Sequence
  Synthetic
LPTQIWQ

SEQ ID NO: 4511 - protein, 7 aa, Artificial Sequence
  Synthetic
TTLIPFH

SEQ ID NO: 4512 - protein, 7 aa, Artificial Sequence
  Synthetic
ARNDGRY

SEQ ID NO: 4513 - protein, 7 aa, Artificial Sequence
  Synthetic
GEVRQFC

SEQ ID NO: 4514 - protein, 7 aa, Artificial Sequence
  Synthetic
AAEGWVA

SEQ ID NO: 4515 - protein, 7 aa, Artificial Sequence
  Synthetic
GVFLPPM

SEQ ID NO: 4516 - protein, 7 aa, Artificial Sequence
  Synthetic
GGARRDS

SEQ ID NO: 4517 - protein, 7 aa, Artificial Sequence
  Synthetic
HYSAFND

SEQ ID NO: 4518 - protein, 7 aa, Artificial Sequence
  Synthetic
WGVSPFH

SEQ ID NO: 4519 - protein, 7 aa, Artificial Sequence
  Synthetic
ETDVFRR

SEQ ID NO: 4520 - protein, 7 aa, Artificial Sequence
  Synthetic
APVVPSL

SEQ ID NO: 4521 - protein, 7 aa, Artificial Sequence
  Synthetic
VGLAPPR

SEQ ID NO: 4522 - protein, 7 aa, Artificial Sequence
  Synthetic
WNRIGSV

SEQ ID NO: 4523 - protein, 7 aa, Artificial Sequence
  Synthetic
VFTQARM

SEQ ID NO: 4524 - protein, 7 aa, Artificial Sequence
  Synthetic
WEGGSRY

SEQ ID NO: 4525 - protein, 7 aa, Artificial Sequence
  Synthetic
TDTQYFR

SEQ ID NO: 4526 - protein, 7 aa, Artificial Sequence
  Synthetic
GRFDPPA

SEQ ID NO: 4527 - protein, 7 aa, Artificial Sequence
  Synthetic
LPSRVFL

SEQ ID NO: 4528 - protein, 7 aa, Artificial Sequence
  Synthetic
SQDRPFI

SEQ ID NO: 4529 - protein, 7 aa, Artificial Sequence
  Synthetic
SPQFCTS

SEQ ID NO: 4530 - protein, 7 aa, Artificial Sequence
  Synthetic
GHFAPPH

SEQ ID NO: 4531 - protein, 7 aa, Artificial Sequence
  Synthetic
NPWHPTG

SEQ ID NO: 4532 - protein, 7 aa, Artificial Sequence
  Synthetic
ASFNPPR

SEQ ID NO: 4533 - protein, 7 aa, Artificial Sequence
  Synthetic
QRSFAVQ

SEQ ID NO: 4534 - protein, 7 aa, Artificial Sequence
  Synthetic
SPEWGNF

SEQ ID NO: 4535 - protein, 7 aa, Artificial Sequence
  Synthetic
SLERPFI

SEQ ID NO: 4536 - protein, 7 aa, Artificial Sequence
  Synthetic
WTEFARV

SEQ ID NO: 4537 - protein, 7 aa, Artificial Sequence
  Synthetic
TVSAPFI

SEQ ID NO: 4538 - protein, 7 aa, Artificial Sequence
  Synthetic
IGIRLGY

SEQ ID NO: 4539 - protein, 7 aa, Artificial Sequence
  Synthetic
HRTGWAA

SEQ ID NO: 4540 - protein, 7 aa, Artificial Sequence
  Synthetic
VKGWYLE

SEQ ID NO: 4541 - protein, 7 aa, Artificial Sequence
  Synthetic
IEREWRT

SEQ ID NO: 4542 - protein, 7 aa, Artificial Sequence
  Synthetic
GLFTPPS

SEQ ID NO: 4543 - protein, 7 aa, Artificial Sequence
  Synthetic
VTFNTPR

SEQ ID NO: 4544 - protein, 7 aa, Artificial Sequence
  Synthetic
MGINSIF

SEQ ID NO: 4545 - protein, 7 aa, Artificial Sequence
  Synthetic
GSWTPPE

SEQ ID NO: 4546 - protein, 7 aa, Artificial Sequence
  Synthetic
AYPFFME

SEQ ID NO: 4547 - protein, 7 aa, Artificial Sequence
  Synthetic
FDSHGPR

SEQ ID NO: 4548 - protein, 7 aa, Artificial Sequence
  Synthetic
ITGVNNR

SEQ ID NO: 4549 - protein, 7 aa, Artificial Sequence
  Synthetic
TIKYGVF

SEQ ID NO: 4550 - protein, 7 aa, Artificial Sequence
  Synthetic
GDWVYKA

SEQ ID NO: 4551 - protein, 7 aa, Artificial Sequence
  Synthetic
SMSQLFK

SEQ ID NO: 4552 - protein, 7 aa, Artificial Sequence
  Synthetic
KVRFESV

SEQ ID NO: 4553 - protein, 7 aa, Artificial Sequence
  Synthetic
FDINGPR

SEQ ID NO: 4554 - protein, 7 aa, Artificial Sequence
  Synthetic
NDAAFFR

SEQ ID NO: 4555 - protein, 7 aa, Artificial Sequence
  Synthetic
LDSPFLP

SEQ ID NO: 4556 - protein, 7 aa, Artificial Sequence
  Synthetic
LRFDGHV

SEQ ID NO: 4557 - protein, 7 aa, Artificial Sequence
  Synthetic
QQPFFLS

SEQ ID NO: 4558 - protein, 7 aa, Artificial Sequence
  Synthetic
NAQFCTV

SEQ ID NO: 4559 - protein, 7 aa, Artificial Sequence
  Synthetic
SVTNPWV

SEQ ID NO: 4560 - protein, 7 aa, Artificial Sequence
  Synthetic
LQRVISP

SEQ ID NO: 4561 - protein, 7 aa, Artificial Sequence
  Synthetic
SKVFASV

SEQ ID NO: 4562 - protein, 7 aa, Artificial Sequence
  Synthetic
IPGWYTS

SEQ ID NO: 4563 - protein, 7 aa, Artificial Sequence
  Synthetic
TYWAVNG

SEQ ID NO: 4564 - protein, 7 aa, Artificial Sequence
  Synthetic
TIQSLFA

SEQ ID NO: 4565 - protein, 7 aa, Artificial Sequence
  Synthetic
EQRFGMF

SEQ ID NO: 4566 - protein, 7 aa, Artificial Sequence
  Synthetic
VAGRPFL

SEQ ID NO: 4567 - protein, 7 aa, Artificial Sequence
  Synthetic
AGRPLGT

SEQ ID NO: 4568 - protein, 7 aa, Artificial Sequence
  Synthetic
VVPKGWL

SEQ ID NO: 4569 - protein, 7 aa, Artificial Sequence
  Synthetic
LTLQTSV

SEQ ID NO: 4570 - protein, 7 aa, Artificial Sequence
  Synthetic
SREFKLV

SEQ ID NO: 4571 - protein, 7 aa, Artificial Sequence
  Synthetic
YADKPFL

SEQ ID NO: 4572 - protein, 7 aa, Artificial Sequence
  Synthetic
MPNWVVP

SEQ ID NO: 4573 - protein, 7 aa, Artificial Sequence
  Synthetic
GAWVISA

SEQ ID NO: 4574 - protein, 7 aa, Artificial Sequence
  Synthetic
DGLPFLR

SEQ ID NO: 4575 - protein, 7 aa, Artificial Sequence
  Synthetic
SIVRPFV

SEQ ID NO: 4576 - protein, 7 aa, Artificial Sequence
  Synthetic
QVSFTTI

SEQ ID NO: 4577 - protein, 7 aa, Artificial Sequence
  Synthetic
DAGWGKF

SEQ ID NO: 4578 - protein, 7 aa, Artificial Sequence
  Synthetic
GLDMPFR

SEQ ID NO: 4579 - protein, 7 aa, Artificial Sequence
  Synthetic
TPSAPWM

SEQ ID NO: 4580 - protein, 7 aa, Artificial Sequence
  Synthetic
LGRPFGH

SEQ ID NO: 4581 - protein, 7 aa, Artificial Sequence
  Synthetic
ALQGWAA

SEQ ID NO: 4582 - protein, 7 aa, Artificial Sequence
  Synthetic
QTFVPPA

SEQ ID NO: 4583 - protein, 7 aa, Artificial Sequence
  Synthetic
LGVRIGY

SEQ ID NO: 4584 - protein, 7 aa, Artificial Sequence
  Synthetic
FSKLTPS

SEQ ID NO: 4585 - protein, 7 aa, Artificial Sequence
  Synthetic
ISFLRPD

SEQ ID NO: 4586 - protein, 7 aa, Artificial Sequence
  Synthetic
NVWRSDG

SEQ ID NO: 4587 - protein, 7 aa, Artificial Sequence
  Synthetic
NVWHIAG

SEQ ID NO: 4588 - protein, 7 aa, Artificial Sequence
  Synthetic
SEGWPGS

SEQ ID NO: 4589 - protein, 7 aa, Artificial Sequence
  Synthetic
QVNFTRV

SEQ ID NO: 4590 - protein, 7 aa, Artificial Sequence
  Synthetic
GVPSKHT

SEQ ID NO: 4591 - protein, 7 aa, Artificial Sequence
  Synthetic
SIARPFT

SEQ ID NO: 4592 - protein, 7 aa, Artificial Sequence
  Synthetic
LLDRPWT

SEQ ID NO: 4593 - protein, 7 aa, Artificial Sequence
  Synthetic
EGSIVLR

SEQ ID NO: 4594 - protein, 7 aa, Artificial Sequence
  Synthetic
PAIANLL

SEQ ID NO: 4595 - protein, 7 aa, Artificial Sequence
  Synthetic
GYSHAGR

SEQ ID NO: 4596 - protein, 7 aa, Artificial Sequence
  Synthetic
YGSNPFY

SEQ ID NO: 4597 - protein, 7 aa, Artificial Sequence
  Synthetic
SDWRNLI

SEQ ID NO: 4598 - protein, 7 aa, Artificial Sequence
  Synthetic
VFPFFTD

SEQ ID NO: 4599 - protein, 7 aa, Artificial Sequence
  Synthetic
GTMGWTA

SEQ ID NO: 4600 - protein, 7 aa, Artificial Sequence
  Synthetic
RSWDGGG

SEQ ID NO: 4601 - protein, 7 aa, Artificial Sequence
  Synthetic
FSEFCKQ

SEQ ID NO: 4602 - protein, 7 aa, Artificial Sequence
  Synthetic
VVRFEQI

SEQ ID NO: 4603 - protein, 7 aa, Artificial Sequence
  Synthetic
AYVFKDV

SEQ ID NO: 4604 - protein, 7 aa, Artificial Sequence
  Synthetic
TVNAPWH

SEQ ID NO: 4605 - protein, 7 aa, Artificial Sequence
  Synthetic
GTWHDMV

SEQ ID NO: 4606 - protein, 7 aa, Artificial Sequence
  Synthetic
GRGNWTS

SEQ ID NO: 4607 - protein, 7 aa, Artificial Sequence
  Synthetic
SAAGWVH

SEQ ID NO: 4608 - protein, 7 aa, Artificial Sequence
  Synthetic
QVKFLAV

SEQ ID NO: 4609 - protein, 7 aa, Artificial Sequence
  Synthetic
NSAGWVA

SEQ ID NO: 4610 - protein, 7 aa, Artificial Sequence
  Synthetic
FTSKYPM

SEQ ID NO: 4611 - protein, 7 aa, Artificial Sequence
  Synthetic
LTLTTSK

SEQ ID NO: 4612 - protein, 7 aa, Artificial Sequence
  Synthetic
VGLFPPK

SEQ ID NO: 4613 - protein, 7 aa, Artificial Sequence
  Synthetic
EEFLLGR

SEQ ID NO: 4614 - protein, 7 aa, Artificial Sequence
  Synthetic
IGANPFT

SEQ ID NO: 4615 - protein, 7 aa, Artificial Sequence
  Synthetic
DAWTPPR

SEQ ID NO: 4616 - protein, 7 aa, Artificial Sequence
  Synthetic
GIQRLFS

SEQ ID NO: 4617 - protein, 7 aa, Artificial Sequence
  Synthetic
AQATPFR

SEQ ID NO: 4618 - protein, 7 aa, Artificial Sequence
  Synthetic
VRAFCEP

SEQ ID NO: 4619 - protein, 7 aa, Artificial Sequence
  Synthetic
SIVGWAA

SEQ ID NO: 4620 - protein, 7 aa, Artificial Sequence
  Synthetic
PFDRSTW

SEQ ID NO: 4621 - protein, 7 aa, Artificial Sequence
  Synthetic
TLSSLFK

SEQ ID NO: 4622 - protein, 7 aa, Artificial Sequence
  Synthetic
QKEFCAL

SEQ ID NO: 4623 - protein, 7 aa, Artificial Sequence
  Synthetic
SIHGWAP

SEQ ID NO: 4624 - protein, 7 aa, Artificial Sequence
  Synthetic
EYTRPFM

SEQ ID NO: 4625 - protein, 7 aa, Artificial Sequence
  Synthetic
GPEGFYP

SEQ ID NO: 4626 - protein, 7 aa, Artificial Sequence
  Synthetic
SGIGWTA

SEQ ID NO: 4627 - protein, 7 aa, Artificial Sequence
  Synthetic
NAVGWHA

SEQ ID NO: 4628 - protein, 7 aa, Artificial Sequence
  Synthetic
LMPKSWV

SEQ ID NO: 4629 - protein, 7 aa, Artificial Sequence
  Synthetic
WTLDSPR

SEQ ID NO: 4630 - protein, 7 aa, Artificial Sequence
  Synthetic
LPSFGSF

SEQ ID NO: 4631 - protein, 7 aa, Artificial Sequence
  Synthetic
SPWGVKF

SEQ ID NO: 4632 - protein, 7 aa, Artificial Sequence
  Synthetic
SRVFQEV

SEQ ID NO: 4633 - protein, 7 aa, Artificial Sequence
  Synthetic
IPQFVFG

SEQ ID NO: 4634 - protein, 7 aa, Artificial Sequence
  Synthetic
MGQFCQV

SEQ ID NO: 4635 - protein, 7 aa, Artificial Sequence
  Synthetic
TMSGWVA

SEQ ID NO: 4636 - protein, 7 aa, Artificial Sequence
  Synthetic
GREYLIP

SEQ ID NO: 4637 - protein, 7 aa, Artificial Sequence
  Synthetic
FTTSSSR

SEQ ID NO: 4638 - protein, 7 aa, Artificial Sequence
  Synthetic
STGWPGA

SEQ ID NO: 4639 - protein, 7 aa, Artificial Sequence
  Synthetic
ALDRPWV

SEQ ID NO: 4640 - protein, 7 aa, Artificial Sequence
  Synthetic
VDKFCLV

SEQ ID NO: 4641 - protein, 7 aa, Artificial Sequence
  Synthetic
AVFKEWV

SEQ ID NO: 4642 - protein, 7 aa, Artificial Sequence
  Synthetic
YAGRIFI

SEQ ID NO: 4643 - protein, 7 aa, Artificial Sequence
  Synthetic
CISGLGC

SEQ ID NO: 4644 - protein, 7 aa, Artificial Sequence
  Synthetic
SPRNPFI

SEQ ID NO: 4645 - protein, 7 aa, Artificial Sequence
  Synthetic
TLDKPFT

SEQ ID NO: 4646 - protein, 7 aa, Artificial Sequence
  Synthetic
DVVHWVA

SEQ ID NO: 4647 - protein, 7 aa, Artificial Sequence
  Synthetic
GNNFCNV

SEQ ID NO: 4648 - protein, 7 aa, Artificial Sequence
  Synthetic
LLGFCHS

SEQ ID NO: 4649 - protein, 7 aa, Artificial Sequence
  Synthetic
GMFMPPM

SEQ ID NO: 4650 - protein, 7 aa, Artificial Sequence
  Synthetic
PTSSYSW

SEQ ID NO: 4651 - protein, 7 aa, Artificial Sequence
  Synthetic
APDRPWL

SEQ ID NO: 4652 - protein, 7 aa, Artificial Sequence
  Synthetic
VGVQLGH

SEQ ID NO: 4653 - protein, 7 aa, Artificial Sequence
  Synthetic
ADTFCVK

SEQ ID NO: 4654 - protein, 7 aa, Artificial Sequence
  Synthetic
FWNGGSG

SEQ ID NO: 4655 - protein, 7 aa, Artificial Sequence
  Synthetic
QMQFDRI

SEQ ID NO: 4656 - protein, 7 aa, Artificial Sequence
  Synthetic
GKEGNTW

SEQ ID NO: 4657 - protein, 7 aa, Artificial Sequence
  Synthetic
WTKVPDI

SEQ ID NO: 4658 - protein, 7 aa, Artificial Sequence
  Synthetic
TKTSPFL

SEQ ID NO: 4659 - protein, 7 aa, Artificial Sequence
  Synthetic
REEWHYS

SEQ ID NO: 4660 - protein, 7 aa, Artificial Sequence
  Synthetic
WTLSQPR

SEQ ID NO: 4661 - protein, 7 aa, Artificial Sequence
  Synthetic
PAKFAII

SEQ ID NO: 4662 - protein, 7 aa, Artificial Sequence
  Synthetic
FTLEVPR

SEQ ID NO: 4663 - protein, 7 aa, Artificial Sequence
  Synthetic
GVWLPPN

SEQ ID NO: 4664 - protein, 7 aa, Artificial Sequence
  Synthetic
DYNWPGS

SEQ ID NO: 4665 - protein, 7 aa, Artificial Sequence
  Synthetic
TLEFPFR

SEQ ID NO: 4666 - protein, 7 aa, Artificial Sequence
  Synthetic
SSFVPPR

SEQ ID NO: 4667 - protein, 7 aa, Artificial Sequence
  Synthetic
LAKWPEF

SEQ ID NO: 4668 - protein, 7 aa, Artificial Sequence
  Synthetic
YAAMPFP

SEQ ID NO: 4669 - protein, 7 aa, Artificial Sequence
  Synthetic
YSENYFY

SEQ ID NO: 4670 - protein, 7 aa, Artificial Sequence
  Synthetic
QERFSVM

SEQ ID NO: 4671 - protein, 7 aa, Artificial Sequence
  Synthetic
VGPMPWV

SEQ ID NO: 4672 - protein, 7 aa, Artificial Sequence
  Synthetic
EEGYWTP

SEQ ID NO: 4673 - protein, 7 aa, Artificial Sequence
  Synthetic
MPFPMLG

SEQ ID NO: 4674 - protein, 7 aa, Artificial Sequence
  Synthetic
PPIASQF

SEQ ID NO: 4675 - protein, 7 aa, Artificial Sequence
  Synthetic
QRCGIVC

SEQ ID NO: 4676 - protein, 7 aa, Artificial Sequence
  Synthetic
SDGFGAG

SEQ ID NO: 4677 - protein, 7 aa, Artificial Sequence
  Synthetic
YGPLPFA

SEQ ID NO: 4678 - protein, 7 aa, Artificial Sequence
  Synthetic
RFDQPWI

SEQ ID NO: 4679 - protein, 7 aa, Artificial Sequence
  Synthetic
QGSNKTS

SEQ ID NO: 4680 - protein, 7 aa, Artificial Sequence
  Synthetic
TGFNPPR

SEQ ID NO: 4681 - protein, 7 aa, Artificial Sequence
  Synthetic
HVNGWIA

SEQ ID NO: 4682 - protein, 7 aa, Artificial Sequence
  Synthetic
GVSPTVK

SEQ ID NO: 4683 - protein, 7 aa, Artificial Sequence
  Synthetic
NATPWAP

SEQ ID NO: 4684 - protein, 7 aa, Artificial Sequence
  Synthetic
NAGPWIA

SEQ ID NO: 4685 - protein, 7 aa, Artificial Sequence
  Synthetic
MPHPSWQ

SEQ ID NO: 4686 - protein, 7 aa, Artificial Sequence
  Synthetic
DWRGEKF

SEQ ID NO: 4687 - protein, 7 aa, Artificial Sequence
  Synthetic
EILRPFM

SEQ ID NO: 4688 - protein, 7 aa, Artificial Sequence
  Synthetic
SMRFETV

SEQ ID NO: 4689 - protein, 7 aa, Artificial Sequence
  Synthetic
GTSPWVA

SEQ ID NO: 4690 - protein, 7 aa, Artificial Sequence
  Synthetic
SRERPFV

SEQ ID NO: 4691 - protein, 7 aa, Artificial Sequence
  Synthetic
RSEMGMW

SEQ ID NO: 4692 - protein, 7 aa, Artificial Sequence
  Synthetic
LGHALGR

SEQ ID NO: 4693 - protein, 7 aa, Artificial Sequence
  Synthetic
SYVSPFM

SEQ ID NO: 4694 - protein, 7 aa, Artificial Sequence
  Synthetic
DWRGLAY

SEQ ID NO: 4695 - protein, 7 aa, Artificial Sequence
  Synthetic
MPGRPFM

SEQ ID NO: 4696 - protein, 7 aa, Artificial Sequence
  Synthetic
ALKFENV

SEQ ID NO: 4697 - protein, 7 aa, Artificial Sequence
  Synthetic
NASGWLP

SEQ ID NO: 4698 - protein, 7 aa, Artificial Sequence
  Synthetic
SIEKPFV

SEQ ID NO: 4699 - protein, 7 aa, Artificial Sequence
  Synthetic
GTSRPTL

SEQ ID NO: 4700 - protein, 7 aa, Artificial Sequence
  Synthetic
TPHMPFH

SEQ ID NO: 4701 - protein, 7 aa, Artificial Sequence
  Synthetic
DLNRPFQ

SEQ ID NO: 4702 - protein, 7 aa, Artificial Sequence
  Synthetic
VFKFGDI

SEQ ID NO: 4703 - protein, 7 aa, Artificial Sequence
  Synthetic
VLSNVFG

SEQ ID NO: 4704 - protein, 7 aa, Artificial Sequence
  Synthetic
SLQGWVA

SEQ ID NO: 4705 - protein, 7 aa, Artificial Sequence
  Synthetic
GHFTPPS

SEQ ID NO: 4706 - protein, 7 aa, Artificial Sequence
  Synthetic
SDGRPFL

SEQ ID NO: 4707 - protein, 7 aa, Artificial Sequence
  Synthetic
NAWGTSH

SEQ ID NO: 4708 - protein, 7 aa, Artificial Sequence
  Synthetic
WTAHDPK

SEQ ID NO: 4709 - protein, 7 aa, Artificial Sequence
  Synthetic
PVRTPSL

SEQ ID NO: 4710 - protein, 7 aa, Artificial Sequence
  Synthetic
YGSSPFK

SEQ ID NO: 4711 - protein, 7 aa, Artificial Sequence
  Synthetic
VDGWGAF

SEQ ID NO: 4712 - protein, 7 aa, Artificial Sequence
  Synthetic
NGQLPFR

SEQ ID NO: 4713 - protein, 7 aa, Artificial Sequence
  Synthetic
SAQFHLV

SEQ ID NO: 4714 - protein, 7 aa, Artificial Sequence
  Synthetic
AADRPFL

SEQ ID NO: 4715 - protein, 7 aa, Artificial Sequence
  Synthetic
VEGLWHV

SEQ ID NO: 4716 - protein, 7 aa, Artificial Sequence
  Synthetic
DNRGFVA

SEQ ID NO: 4717 - protein, 7 aa, Artificial Sequence
  Synthetic
TERHPFL

SEQ ID NO: 4718 - protein, 7 aa, Artificial Sequence
  Synthetic
GSFAPPS

SEQ ID NO: 4719 - protein, 7 aa, Artificial Sequence
  Synthetic
LAMNSSW

SEQ ID NO: 4720 - protein, 7 aa, Artificial Sequence
  Synthetic
GYTNPFQ

SEQ ID NO: 4721 - protein, 7 aa, Artificial Sequence
  Synthetic
QVRFDSI

SEQ ID NO: 4722 - protein, 7 aa, Artificial Sequence
  Synthetic
DLNKPWL

SEQ ID NO: 4723 - protein, 7 aa, Artificial Sequence
  Synthetic
ERFTPPR

SEQ ID NO: 4724 - protein, 7 aa, Artificial Sequence
  Synthetic
TPLTPFK

SEQ ID NO: 4725 - protein, 7 aa, Artificial Sequence
  Synthetic
DLPRNWV

SEQ ID NO: 4726 - protein, 7 aa, Artificial Sequence
  Synthetic
IGVRLGM

SEQ ID NO: 4727 - protein, 7 aa, Artificial Sequence
  Synthetic
SQFVPPH

SEQ ID NO: 4728 - protein, 7 aa, Artificial Sequence
  Synthetic
SPSTISW

SEQ ID NO: 4729 - protein, 7 aa, Artificial Sequence
  Synthetic
TPHNLSW

SEQ ID NO: 4730 - protein, 7 aa, Artificial Sequence
  Synthetic
QIRFSGI

SEQ ID NO: 4731 - protein, 7 aa, Artificial Sequence
  Synthetic
HPVGWIA

SEQ ID NO: 4732 - protein, 7 aa, Artificial Sequence
  Synthetic
YDNLPFR

SEQ ID NO: 4733 - protein, 7 aa, Artificial Sequence
  Synthetic
LGAMPFR

SEQ ID NO: 4734 - protein, 7 aa, Artificial Sequence
  Synthetic
TKSMPFY

SEQ ID NO: 4735 - protein, 7 aa, Artificial Sequence
  Synthetic
DGYRPFI

SEQ ID NO: 4736 - protein, 7 aa, Artificial Sequence
  Synthetic
SNTGWAP

SEQ ID NO: 4737 - protein, 7 aa, Artificial Sequence
  Synthetic
PISTLSW

SEQ ID NO: 4738 - protein, 7 aa, Artificial Sequence
  Synthetic
VGHRLGC

SEQ ID NO: 4739 - protein, 7 aa, Artificial Sequence
  Synthetic
SSRFEHI

SEQ ID NO: 4740 - protein, 7 aa, Artificial Sequence
  Synthetic
ALMRPFP

SEQ ID NO: 4741 - protein, 7 aa, Artificial Sequence
  Synthetic
LMWDGGG

SEQ ID NO: 4742 - protein, 7 aa, Artificial Sequence
  Synthetic
LLQRPFL

SEQ ID NO: 4743 - protein, 7 aa, Artificial Sequence
  Synthetic
TLTMMFQ

SEQ ID NO: 4744 - protein, 7 aa, Artificial Sequence
  Synthetic
SVWRVEG

SEQ ID NO: 4745 - protein, 7 aa, Artificial Sequence
  Synthetic
VVRFGEF

SEQ ID NO: 4746 - protein, 7 aa, Artificial Sequence
  Synthetic
LPERPFV

SEQ ID NO: 4747 - protein, 7 aa, Artificial Sequence
  Synthetic
GRAGWIA

SEQ ID NO: 4748 - protein, 7 aa, Artificial Sequence
  Synthetic
TKNAPFL

SEQ ID NO: 4749 - protein, 7 aa, Artificial Sequence
  Synthetic
WSVFSEV

SEQ ID NO: 4750 - protein, 7 aa, Artificial Sequence
  Synthetic
GERGWVA

SEQ ID NO: 4751 - protein, 7 aa, Artificial Sequence
  Synthetic
VGVNPFQ

SEQ ID NO: 4752 - protein, 7 aa, Artificial Sequence
  Synthetic
YGVMPFV

SEQ ID NO: 4753 - protein, 7 aa, Artificial Sequence
  Synthetic
QSAFCVP

SEQ ID NO: 4754 - protein, 7 aa, Artificial Sequence
  Synthetic
TTGRALT

SEQ ID NO: 4755 - protein, 7 aa, Artificial Sequence
  Synthetic
TYRFESV

SEQ ID NO: 4756 - protein, 7 aa, Artificial Sequence
  Synthetic
VMTQTWH

SEQ ID NO: 4757 - protein, 7 aa, Artificial Sequence
  Synthetic
NWVNPEG

SEQ ID NO: 4758 - protein, 7 aa, Artificial Sequence
  Synthetic
SEFLLGR

SEQ ID NO: 4759 - protein, 7 aa, Artificial Sequence
  Synthetic
GVCGMVC

SEQ ID NO: 4760 - protein, 7 aa, Artificial Sequence
  Synthetic
VAHFCTS

SEQ ID NO: 4761 - protein, 7 aa, Artificial Sequence
  Synthetic
SALRPFT

SEQ ID NO: 4762 - protein, 7 aa, Artificial Sequence
  Synthetic
DYFSPTR

SEQ ID NO: 4763 - protein, 7 aa, Artificial Sequence
  Synthetic
SAWGPMS

SEQ ID NO: 4764 - protein, 7 aa, Artificial Sequence
  Synthetic
REFMMGA

SEQ ID NO: 4765 - protein, 7 aa, Artificial Sequence
  Synthetic
LLPQNWL

SEQ ID NO: 4766 - protein, 7 aa, Artificial Sequence
  Synthetic
GVSFYNE

SEQ ID NO: 4767 - protein, 7 aa, Artificial Sequence
  Synthetic
WLAKGTV

SEQ ID NO: 4768 - protein, 7 aa, Artificial Sequence
  Synthetic
SVAEWLR

SEQ ID NO: 4769 - protein, 7 aa, Artificial Sequence
  Synthetic
YVDRLFI

SEQ ID NO: 4770 - protein, 7 aa, Artificial Sequence
  Synthetic
AGGPWIS

SEQ ID NO: 4771 - protein, 7 aa, Artificial Sequence
  Synthetic
GVPPMSG

SEQ ID NO: 4772 - protein, 7 aa, Artificial Sequence
  Synthetic
YALKPFV

SEQ ID NO: 4773 - protein, 7 aa, Artificial Sequence
  Synthetic
FSLHTSK

SEQ ID NO: 4774 - protein, 7 aa, Artificial Sequence
  Synthetic
TGVALGY

SEQ ID NO: 4775 - protein, 7 aa, Artificial Sequence
  Synthetic
SVTTPFL

SEQ ID NO: 4776 - protein, 7 aa, Artificial Sequence
  Synthetic
QTRMLYP

SEQ ID NO: 4777 - protein, 7 aa, Artificial Sequence
  Synthetic
TVWREGG

SEQ ID NO: 4778 - protein, 7 aa, Artificial Sequence
  Synthetic
SIRVPFI

SEQ ID NO: 4779 - protein, 7 aa, Artificial Sequence
  Synthetic
LGAALGR

SEQ ID NO: 4780 - protein, 7 aa, Artificial Sequence
  Synthetic
LGRALGL

SEQ ID NO: 4781 - protein, 7 aa, Artificial Sequence
  Synthetic
VLLNVFG

SEQ ID NO: 4782 - protein, 7 aa, Artificial Sequence
  Synthetic
STIFKLP

SEQ ID NO: 4783 - protein, 7 aa, Artificial Sequence
  Synthetic
NRDFCAP

SEQ ID NO: 4784 - protein, 7 aa, Artificial Sequence
  Synthetic
GKMGWAA

SEQ ID NO: 4785 - protein, 7 aa, Artificial Sequence
  Synthetic
ATFIPPT

SEQ ID NO: 4786 - protein, 7 aa, Artificial Sequence
  Synthetic
TAWHSDG

SEQ ID NO: 4787 - protein, 7 aa, Artificial Sequence
  Synthetic
TTEFCRF

SEQ ID NO: 4788 - protein, 7 aa, Artificial Sequence
  Synthetic
GIFITPM

SEQ ID NO: 4789 - protein, 7 aa, Artificial Sequence
  Synthetic
GYNGWAG

SEQ ID NO: 4790 - protein, 7 aa, Artificial Sequence
  Synthetic
DTWAPPK

SEQ ID NO: 4791 - protein, 7 aa, Artificial Sequence
  Synthetic
SWARIGE

SEQ ID NO: 4792 - protein, 7 aa, Artificial Sequence
  Synthetic
AAMGWAA

SEQ ID NO: 4793 - protein, 7 aa, Artificial Sequence
  Synthetic
DDTHFFR

SEQ ID NO: 4794 - protein, 7 aa, Artificial Sequence
  Synthetic
GVTRPFQ

SEQ ID NO: 4795 - protein, 7 aa, Artificial Sequence
  Synthetic
FGLGLAK

SEQ ID NO: 4796 - protein, 7 aa, Artificial Sequence
  Synthetic
IEGWYRS

SEQ ID NO: 4797 - protein, 7 aa, Artificial Sequence
  Synthetic
VTLQTSR

SEQ ID NO: 4798 - protein, 7 aa, Artificial Sequence
  Synthetic
HRVHTSP

SEQ ID NO: 4799 - protein, 7 aa, Artificial Sequence
  Synthetic
NPEWGHF

SEQ ID NO: 4800 - protein, 7 aa, Artificial Sequence
  Synthetic
EPMHSSW

SEQ ID NO: 4801 - protein, 7 aa, Artificial Sequence
  Synthetic
SKAFHLV

SEQ ID NO: 4802 - protein, 7 aa, Artificial Sequence
  Synthetic
SNTWEKS

SEQ ID NO: 4803 - protein, 7 aa, Artificial Sequence
  Synthetic
QTDFTRQ

SEQ ID NO: 4804 - protein, 7 aa, Artificial Sequence
  Synthetic
RGLPEIW

SEQ ID NO: 4805 - protein, 7 aa, Artificial Sequence
  Synthetic
YPIAGWV

SEQ ID NO: 4806 - protein, 7 aa, Artificial Sequence
  Synthetic
WRSLGSV

SEQ ID NO: 4807 - protein, 7 aa, Artificial Sequence
  Synthetic
YAERIFI

SEQ ID NO: 4808 - protein, 7 aa, Artificial Sequence
  Synthetic
IPLKGWV

SEQ ID NO: 4809 - protein, 7 aa, Artificial Sequence
  Synthetic
TDQLFSR

SEQ ID NO: 4810 - protein, 7 aa, Artificial Sequence
  Synthetic
PRMNSSF

SEQ ID NO: 4811 - protein, 7 aa, Artificial Sequence
  Synthetic
VQFSQPK

SEQ ID NO: 4812 - protein, 7 aa, Artificial Sequence
  Synthetic
TPDSPWL

SEQ ID NO: 4813 - protein, 7 aa, Artificial Sequence
  Synthetic
GLWAGGG

SEQ ID NO: 4814 - protein, 7 aa, Artificial Sequence
  Synthetic
LGVRLGI

SEQ ID NO: 4815 - protein, 7 aa, Artificial Sequence
  Synthetic
HTEALVA

SEQ ID NO: 4816 - protein, 7 aa, Artificial Sequence
  Synthetic
SASSPFR

SEQ ID NO: 4817 - protein, 7 aa, Artificial Sequence
  Synthetic
TGRALGT

SEQ ID NO: 4818 - protein, 7 aa, Artificial Sequence
  Synthetic
GTWVPPN

SEQ ID NO: 4819 - protein, 7 aa, Artificial Sequence
  Synthetic
KPPFYLE

SEQ ID NO: 4820 - protein, 7 aa, Artificial Sequence
  Synthetic
SDAQYFR

SEQ ID NO: 4821 - protein, 7 aa, Artificial Sequence
  Synthetic
LKVSGFP

SEQ ID NO: 4822 - protein, 7 aa, Artificial Sequence
  Synthetic
YAEKYFL

SEQ ID NO: 4823 - protein, 7 aa, Artificial Sequence
  Synthetic
DGQLFLR

SEQ ID NO: 4824 - protein, 7 aa, Artificial Sequence
  Synthetic
SVSHPFK

SEQ ID NO: 4825 - protein, 7 aa, Artificial Sequence
  Synthetic
WDLLGAR

SEQ ID NO: 4826 - protein, 7 aa, Artificial Sequence
  Synthetic
WTLKDPL

SEQ ID NO: 4827 - protein, 7 aa, Artificial Sequence
  Synthetic
TPARPFT

SEQ ID NO: 4828 - protein, 7 aa, Artificial Sequence
  Synthetic
APADWLR

SEQ ID NO: 4829 - protein, 7 aa, Artificial Sequence
  Synthetic
ENVAFRN

SEQ ID NO: 4830 - protein, 7 aa, Artificial Sequence
  Synthetic
LICPKLC

SEQ ID NO: 4831 - protein, 7 aa, Artificial Sequence
  Synthetic
FDLSGPM

SEQ ID NO: 4832 - protein, 7 aa, Artificial Sequence
  Synthetic
TPIQIFK

SEQ ID NO: 4833 - protein, 7 aa, Artificial Sequence
  Synthetic
AKTFACV

SEQ ID NO: 4834 - protein, 7 aa, Artificial Sequence
  Synthetic
SKAGWAP

SEQ ID NO: 4835 - protein, 7 aa, Artificial Sequence
  Synthetic
NDTQFFR

SEQ ID NO: 4836 - protein, 7 aa, Artificial Sequence
  Synthetic
YQFTTPK

SEQ ID NO: 4837 - protein, 7 aa, Artificial Sequence
  Synthetic
SNTSPFR

SEQ ID NO: 4838 - protein, 7 aa, Artificial Sequence
  Synthetic
GNWSGGG

SEQ ID NO: 4839 - protein, 7 aa, Artificial Sequence
  Synthetic
SNLAPFR

SEQ ID NO: 4840 - protein, 7 aa, Artificial Sequence
  Synthetic
SGDRPWL

SEQ ID NO: 4841 - protein, 7 aa, Artificial Sequence
  Synthetic
IVPFWTA

SEQ ID NO: 4842 - protein, 7 aa, Artificial Sequence
  Synthetic
YAGQYFH

SEQ ID NO: 4843 - protein, 7 aa, Artificial Sequence
  Synthetic
RIFPYVD

SEQ ID NO: 4844 - protein, 7 aa, Artificial Sequence
  Synthetic
TAELPFR

SEQ ID NO: 4845 - protein, 7 aa, Artificial Sequence
  Synthetic
FAEMPFR

SEQ ID NO: 4846 - protein, 7 aa, Artificial Sequence
  Synthetic
TDKWGSF

SEQ ID NO: 4847 - protein, 7 aa, Artificial Sequence
  Synthetic
VVRFEAV

SEQ ID NO: 4848 - protein, 7 aa, Artificial Sequence
  Synthetic
GRDGWVP

SEQ ID NO: 4849 - protein, 7 aa, Artificial Sequence
  Synthetic
YDGRMFL

SEQ ID NO: 4850 - protein, 7 aa, Artificial Sequence
  Synthetic
GMALAVT

SEQ ID NO: 4851 - protein, 7 aa, Artificial Sequence
  Synthetic
FSVSASR

SEQ ID NO: 4852 - protein, 7 aa, Artificial Sequence
  Synthetic
SAPRPFA

SEQ ID NO: 4853 - protein, 7 aa, Artificial Sequence
  Synthetic
SVSFAHV

SEQ ID NO: 4854 - protein, 7 aa, Artificial Sequence
  Synthetic
MKADFMP

SEQ ID NO: 4855 - protein, 7 aa, Artificial Sequence
  Synthetic
SELGWIP

SEQ ID NO: 4856 - protein, 7 aa, Artificial Sequence
  Synthetic
QITFCPS

SEQ ID NO: 4857 - protein, 7 aa, Artificial Sequence
  Synthetic
YESFLFH

SEQ ID NO: 4858 - protein, 7 aa, Artificial Sequence
  Synthetic
VLGFIGV

SEQ ID NO: 4859 - protein, 7 aa, Artificial Sequence
  Synthetic
LANWPFP

SEQ ID NO: 4860 - protein, 7 aa, Artificial Sequence
  Synthetic
SGNGWVA

SEQ ID NO: 4861 - protein, 7 aa, Artificial Sequence
  Synthetic
DLFSPSR

SEQ ID NO: 4862 - protein, 7 aa, Artificial Sequence
  Synthetic
LSPFFLA

SEQ ID NO: 4863 - protein, 7 aa, Artificial Sequence
  Synthetic
YGQNLFV

SEQ ID NO: 4864 - protein, 7 aa, Artificial Sequence
  Synthetic
VTSLDHR

SEQ ID NO: 4865 - protein, 7 aa, Artificial Sequence
  Synthetic
YDSHLFQ

SEQ ID NO: 4866 - protein, 7 aa, Artificial Sequence
  Synthetic
WGAAAAL

SEQ ID NO: 4867 - protein, 7 aa, Artificial Sequence
  Synthetic
KTAFAHV

SEQ ID NO: 4868 - protein, 7 aa, Artificial Sequence
  Synthetic
LVNFCSA

SEQ ID NO: 4869 - protein, 7 aa, Artificial Sequence
  Synthetic
THWLTHG

SEQ ID NO: 4870 - protein, 7 aa, Artificial Sequence
  Synthetic
HRPEGRS

SEQ ID NO: 4871 - protein, 7 aa, Artificial Sequence
  Synthetic
RAHEKLQ

SEQ ID NO: 4872 - protein, 7 aa, Artificial Sequence
  Synthetic
KPDMGIW

SEQ ID NO: 4873 - protein, 7 aa, Artificial Sequence
  Synthetic
SLHGWAA

SEQ ID NO: 4874 - protein, 7 aa, Artificial Sequence
  Synthetic
CIARIGC

SEQ ID NO: 4875 - protein, 7 aa, Artificial Sequence
  Synthetic
SLFGFSP

SEQ ID NO: 4876 - protein, 7 aa, Artificial Sequence
  Synthetic
CVWSNTC

SEQ ID NO: 4877 - protein, 7 aa, Artificial Sequence
  Synthetic
SRAQPFL

SEQ ID NO: 4878 - protein, 7 aa, Artificial Sequence
  Synthetic
TDMPHVS

SEQ ID NO: 4879 - protein, 7 aa, Artificial Sequence
  Synthetic
IYVMGSV

SEQ ID NO: 4880 - protein, 7 aa, Artificial Sequence
  Synthetic
VGANPFV

SEQ ID NO: 4881 - protein, 7 aa, Artificial Sequence
  Synthetic
PEKTFRT

SEQ ID NO: 4882 - protein, 7 aa, Artificial Sequence
  Synthetic
NTISTSK

SEQ ID NO: 4883 - protein, 7 aa, Artificial Sequence
  Synthetic
QAGFCAL

SEQ ID NO: 4884 - protein, 7 aa, Artificial Sequence
  Synthetic
SQQFSQI

SEQ ID NO: 4885 - protein, 7 aa, Artificial Sequence
  Synthetic
SGYPVRG

SEQ ID NO: 4886 - protein, 7 aa, Artificial Sequence
  Synthetic
LAQLCTV

SEQ ID NO: 4887 - protein, 7 aa, Artificial Sequence
  Synthetic
SLNHMRS

SEQ ID NO: 4888 - protein, 7 aa, Artificial Sequence
  Synthetic
WDDWGPR

SEQ ID NO: 4889 - protein, 7 aa, Artificial Sequence
  Synthetic
TLLRVFP

SEQ ID NO: 4890 - protein, 7 aa, Artificial Sequence
  Synthetic
WESRPFI

SEQ ID NO: 4891 - protein, 7 aa, Artificial Sequence
  Synthetic
TPWRELG

SEQ ID NO: 4892 - protein, 7 aa, Artificial Sequence
  Synthetic
FGVRLAV

SEQ ID NO: 4893 - protein, 7 aa, Artificial Sequence
  Synthetic
QSKFESI

SEQ ID NO: 4894 - protein, 7 aa, Artificial Sequence
  Synthetic
LPDRQWL

SEQ ID NO: 4895 - protein, 7 aa, Artificial Sequence
  Synthetic
SAWGSHH

SEQ ID NO: 4896 - protein, 7 aa, Artificial Sequence
  Synthetic
TTAMPFR

SEQ ID NO: 4897 - protein, 7 aa, Artificial Sequence
  Synthetic
VPSSLSW

SEQ ID NO: 4898 - protein, 7 aa, Artificial Sequence
  Synthetic
VGTFCIS

SEQ ID NO: 4899 - protein, 7 aa, Artificial Sequence
  Synthetic
TVGRPFT

SEQ ID NO: 4900 - protein, 7 aa, Artificial Sequence
  Synthetic
SVLGWTA

SEQ ID NO: 4901 - protein, 7 aa, Artificial Sequence
  Synthetic
YAGQYFK

SEQ ID NO: 4902 - protein, 7 aa, Artificial Sequence
  Synthetic
PMHSTSW

SEQ ID NO: 4903 - protein, 7 aa, Artificial Sequence
  Synthetic
VGVALGR

SEQ ID NO: 4904 - protein, 7 aa, Artificial Sequence
  Synthetic
GAEMYLR

SEQ ID NO: 4905 - protein, 7 aa, Artificial Sequence
  Synthetic
VKPMGVW

SEQ ID NO: 4906 - protein, 7 aa, Artificial Sequence
  Synthetic
LSMRTSV

SEQ ID NO: 4907 - protein, 7 aa, Artificial Sequence
  Synthetic
VGPLKGW

SEQ ID NO: 4908 - protein, 7 aa, Artificial Sequence
  Synthetic
GTWVPPM

SEQ ID NO: 4909 - protein, 7 aa, Artificial Sequence
  Synthetic
QVTFEKV

SEQ ID NO: 4910 - protein, 7 aa, Artificial Sequence
  Synthetic
YQRMWFQ

SEQ ID NO: 4911 - protein, 7 aa, Artificial Sequence
  Synthetic
PRADWLA

SEQ ID NO: 4912 - protein, 7 aa, Artificial Sequence
  Synthetic
GPNLPFR

SEQ ID NO: 4913 - protein, 7 aa, Artificial Sequence
  Synthetic
SRIFGEF

SEQ ID NO: 4914 - protein, 7 aa, Artificial Sequence
  Synthetic
DRIFGLS

SEQ ID NO: 4915 - protein, 7 aa, Artificial Sequence
  Synthetic
GIWSGGG

SEQ ID NO: 4916 - protein, 7 aa, Artificial Sequence
  Synthetic
GGDGRGN

SEQ ID NO: 4917 - protein, 7 aa, Artificial Sequence
  Synthetic
VPGWYVA

SEQ ID NO: 4918 - protein, 7 aa, Artificial Sequence
  Synthetic
PIIGMRL

SEQ ID NO: 4919 - protein, 7 aa, Artificial Sequence
  Synthetic
PLIGTLL

SEQ ID NO: 4920 - protein, 7 aa, Artificial Sequence
  Synthetic
SVNNPFK

SEQ ID NO: 4921 - protein, 7 aa, Artificial Sequence
  Synthetic
WGQWPHG

SEQ ID NO: 4922 - protein, 7 aa, Artificial Sequence
  Synthetic
ISMSSRH

SEQ ID NO: 4923 - protein, 7 aa, Artificial Sequence
  Synthetic
YGDQMWK

SEQ ID NO: 4924 - protein, 7 aa, Artificial Sequence
  Synthetic
GNFVPPS

SEQ ID NO: 4925 - protein, 7 aa, Artificial Sequence
  Synthetic
AGLGWVA

SEQ ID NO: 4926 - protein, 7 aa, Artificial Sequence
  Synthetic
QIDRPFR

SEQ ID NO: 4927 - protein, 7 aa, Artificial Sequence
  Synthetic
NIRGWVA

SEQ ID NO: 4928 - protein, 7 aa, Artificial Sequence
  Synthetic
DPHNTSW

SEQ ID NO: 4929 - protein, 7 aa, Artificial Sequence
  Synthetic
KEWHGGG

SEQ ID NO: 4930 - protein, 7 aa, Artificial Sequence
  Synthetic
VSFSPPF

SEQ ID NO: 4931 - protein, 7 aa, Artificial Sequence
  Synthetic
TLVMPFH

SEQ ID NO: 4932 - protein, 7 aa, Artificial Sequence
  Synthetic
LLSRPFS

SEQ ID NO: 4933 - protein, 7 aa, Artificial Sequence
  Synthetic
SLTNPFY

SEQ ID NO: 4934 - protein, 7 aa, Artificial Sequence
  Synthetic
AMPYKNG

SEQ ID NO: 4935 - protein, 7 aa, Artificial Sequence
  Synthetic
AKEGWTA

SEQ ID NO: 4936 - protein, 7 aa, Artificial Sequence
  Synthetic
YGEFCMV

SEQ ID NO: 4937 - protein, 7 aa, Artificial Sequence
  Synthetic
IKGFCEL

SEQ ID NO: 4938 - protein, 7 aa, Artificial Sequence
  Synthetic
LPPHPWT

SEQ ID NO: 4939 - protein, 7 aa, Artificial Sequence
  Synthetic
FTPYYAM

SEQ ID NO: 4940 - protein, 7 aa, Artificial Sequence
  Synthetic
GSLPWVA

SEQ ID NO: 4941 - protein, 7 aa, Artificial Sequence
  Synthetic
YSAHIFR

SEQ ID NO: 4942 - protein, 7 aa, Artificial Sequence
  Synthetic
SLVGWAA

SEQ ID NO: 4943 - protein, 7 aa, Artificial Sequence
  Synthetic
SVVFASV

SEQ ID NO: 4944 - protein, 7 aa, Artificial Sequence
  Synthetic
DKLGWSA

SEQ ID NO: 4945 - protein, 7 aa, Artificial Sequence
  Synthetic
SSSRPFQ

SEQ ID NO: 4946 - protein, 7 aa, Artificial Sequence
  Synthetic
PRIASVL

SEQ ID NO: 4947 - protein, 7 aa, Artificial Sequence
  Synthetic
WEFSPPK

SEQ ID NO: 4948 - protein, 7 aa, Artificial Sequence
  Synthetic
VGLAPPR

SEQ ID NO: 4949 - protein, 7 aa, Artificial Sequence
  Synthetic
FVGGGPY

SEQ ID NO: 4950 - protein, 7 aa, Artificial Sequence
  Synthetic
NLFLEGM

SEQ ID NO: 4951 - protein, 7 aa, Artificial Sequence
  Synthetic
MVNFASV

SEQ ID NO: 4952 - protein, 7 aa, Artificial Sequence
  Synthetic
LTMNTSI

SEQ ID NO: 4953 - protein, 7 aa, Artificial Sequence
  Synthetic
TPWHDSG

SEQ ID NO: 4954 - protein, 7 aa, Artificial Sequence
  Synthetic
RVNHADY

SEQ ID NO: 4955 - protein, 7 aa, Artificial Sequence
  Synthetic
SVVRPFP

SEQ ID NO: 4956 - protein, 7 aa, Artificial Sequence
  Synthetic
SREFCSP

SEQ ID NO: 4957 - protein, 7 aa, Artificial Sequence
  Synthetic
YVGSIFL

SEQ ID NO: 4958 - protein, 7 aa, Artificial Sequence
  Synthetic
VGLPFAY

SEQ ID NO: 4959 - protein, 7 aa, Artificial Sequence
  Synthetic
WHSTDHR

SEQ ID NO: 4960 - protein, 7 aa, Artificial Sequence
  Synthetic
LLSRPFA

SEQ ID NO: 4961 - protein, 7 aa, Artificial Sequence
  Synthetic
VGALPWS

SEQ ID NO: 4962 - protein, 7 aa, Artificial Sequence
  Synthetic
GRFIPPT

SEQ ID NO: 4963 - protein, 7 aa, Artificial Sequence
  Synthetic
TVERVFL

SEQ ID NO: 4964 - protein, 7 aa, Artificial Sequence
  Synthetic
FTLSSSI

SEQ ID NO: 4965 - protein, 7 aa, Artificial Sequence
  Synthetic
SGQFCAI

SEQ ID NO: 4966 - protein, 7 aa, Artificial Sequence
  Synthetic
SASFCTA

SEQ ID NO: 4967 - protein, 7 aa, Artificial Sequence
  Synthetic
VGVALGL

SEQ ID NO: 4968 - protein, 7 aa, Artificial Sequence
  Synthetic
SAARPFM

SEQ ID NO: 4969 - protein, 7 aa, Artificial Sequence
  Synthetic
GELRPFL

SEQ ID NO: 4970 - protein, 7 aa, Artificial Sequence
  Synthetic
GSWSPPH

SEQ ID NO: 4971 - protein, 7 aa, Artificial Sequence
  Synthetic
VSWLSDL

SEQ ID NO: 4972 - protein, 7 aa, Artificial Sequence
  Synthetic
TSRLPFI

SEQ ID NO: 4973 - protein, 7 aa, Artificial Sequence
  Synthetic
SLYALTG

SEQ ID NO: 4974 - protein, 7 aa, Artificial Sequence
  Synthetic
FSLSTSV

SEQ ID NO: 4975 - protein, 7 aa, Artificial Sequence
  Synthetic
YLTGSHY

SEQ ID NO: 4976 - protein, 7 aa, Artificial Sequence
  Synthetic
AGIQLGK

SEQ ID NO: 4977 - protein, 7 aa, Artificial Sequence
  Synthetic
SLHLPFK

SEQ ID NO: 4978 - protein, 7 aa, Artificial Sequence
  Synthetic
YADRPFI

SEQ ID NO: 4979 - protein, 7 aa, Artificial Sequence
  Synthetic
AKEHPSR

SEQ ID NO: 4980 - protein, 7 aa, Artificial Sequence
  Synthetic
GNWVPPN

SEQ ID NO: 4981 - protein, 7 aa, Artificial Sequence
  Synthetic
RQVLRGD

SEQ ID NO: 4982 - protein, 7 aa, Artificial Sequence
  Synthetic
RELPFLH

SEQ ID NO: 4983 - protein, 7 aa, Artificial Sequence
  Synthetic
VAQWAQF

SEQ ID NO: 4984 - protein, 7 aa, Artificial Sequence
  Synthetic
MTKFLSV

SEQ ID NO: 4985 - protein, 7 aa, Artificial Sequence
  Synthetic
PLSTTSW

SEQ ID NO: 4986 - protein, 7 aa, Artificial Sequence
  Synthetic
PVDRVSW

SEQ ID NO: 4987 - protein, 7 aa, Artificial Sequence
  Synthetic
SLERPFF

SEQ ID NO: 4988 - protein, 7 aa, Artificial Sequence
  Synthetic
GISFCTE

SEQ ID NO: 4989 - protein, 7 aa, Artificial Sequence
  Synthetic
NDITIFR

SEQ ID NO: 4990 - protein, 7 aa, Artificial Sequence
  Synthetic
GIAVITS

SEQ ID NO: 4991 - protein, 7 aa, Artificial Sequence
  Synthetic
SVTYGVF

SEQ ID NO: 4992 - protein, 7 aa, Artificial Sequence
  Synthetic
NHRLREG

SEQ ID NO: 4993 - protein, 7 aa, Artificial Sequence
  Synthetic
TPSFCSV

SEQ ID NO: 4994 - protein, 7 aa, Artificial Sequence
  Synthetic
TVWSSNG

SEQ ID NO: 4995 - protein, 7 aa, Artificial Sequence
  Synthetic
GVWTPPA

SEQ ID NO: 4996 - protein, 7 aa, Artificial Sequence
  Synthetic
VGFINPK

SEQ ID NO: 4997 - protein, 7 aa, Artificial Sequence
  Synthetic
KFAQSAG

SEQ ID NO: 4998 - protein, 7 aa, Artificial Sequence
  Synthetic
TLANPFF

SEQ ID NO: 4999 - protein, 7 aa, Artificial Sequence
  Synthetic
SYVVPFH

SEQ ID NO: 5000 - protein, 7 aa, Artificial Sequence
  Synthetic
TLHRPFA

SEQ ID NO: 5001 - protein, 7 aa, Artificial Sequence
  Synthetic
YENFCRE

SEQ ID NO: 5002 - protein, 7 aa, Artificial Sequence
  Synthetic
VYVVSSV

SEQ ID NO: 5003 - protein, 7 aa, Artificial Sequence
  Synthetic
ATVPWAE

SEQ ID NO: 5004 - protein, 7 aa, Artificial Sequence
  Synthetic
MTSKFQV

SEQ ID NO: 5005 - protein, 7 aa, Artificial Sequence
  Synthetic
SVNFVNI

SEQ ID NO: 5006 - protein, 7 aa, Artificial Sequence
  Synthetic
SVWSAVG

SEQ ID NO: 5007 - protein, 7 aa, Artificial Sequence
  Synthetic
TPWSLTG

SEQ ID NO: 5008 - protein, 7 aa, Artificial Sequence
  Synthetic
GGLSSIW

SEQ ID NO: 5009 - protein, 7 aa, Artificial Sequence
  Synthetic
SLMGFIA

SEQ ID NO: 5010 - protein, 7 aa, Artificial Sequence
  Synthetic
DVWRRDG

SEQ ID NO: 5011 - protein, 7 aa, Artificial Sequence
  Synthetic
MTMSLYP

SEQ ID NO: 5012 - protein, 7 aa, Artificial Sequence
  Synthetic
LMRFEQV

SEQ ID NO: 5013 - protein, 7 aa, Artificial Sequence
  Synthetic
WGESPFR

SEQ ID NO: 5014 - protein, 7 aa, Artificial Sequence
  Synthetic
QREFINV

SEQ ID NO: 5015 - protein, 7 aa, Artificial Sequence
  Synthetic
RSQRPTM

SEQ ID NO: 5016 - protein, 7 aa, Artificial Sequence
  Synthetic
TFDKPFL

SEQ ID NO: 5017 - protein, 7 aa, Artificial Sequence
  Synthetic
GSLGWAA

SEQ ID NO: 5018 - protein, 7 aa, Artificial Sequence
  Synthetic
ILAYFDG

SEQ ID NO: 5019 - protein, 7 aa, Artificial Sequence
  Synthetic
EKSFCSH

SEQ ID NO: 5020 - protein, 7 aa, Artificial Sequence
  Synthetic
EVFVPPR

SEQ ID NO: 5021 - protein, 7 aa, Artificial Sequence
  Synthetic
DLFRMTG

SEQ ID NO: 5022 - protein, 7 aa, Artificial Sequence
  Synthetic
SLVGWAP

SEQ ID NO: 5023 - protein, 7 aa, Artificial Sequence
  Synthetic
MPMHTTW

SEQ ID NO: 5024 - protein, 7 aa, Artificial Sequence
  Synthetic
LDGPWVP

SEQ ID NO: 5025 - protein, 7 aa, Artificial Sequence
  Synthetic
ALIAMKL

SEQ ID NO: 5026 - protein, 7 aa, Artificial Sequence
  Synthetic
PINSLSW

SEQ ID NO: 5027 - protein, 7 aa, Artificial Sequence
  Synthetic
NDLQFFK

SEQ ID NO: 5028 - protein, 7 aa, Artificial Sequence
  Synthetic
IGLLPFS

SEQ ID NO: 5029 - protein, 7 aa, Artificial Sequence
  Synthetic
GDERYWD

SEQ ID NO: 5030 - protein, 7 aa, Artificial Sequence
  Synthetic
TATSPWI

SEQ ID NO: 5031 - protein, 7 aa, Artificial Sequence
  Synthetic
GQTRPFL

SEQ ID NO: 5032 - protein, 7 aa, Artificial Sequence
  Synthetic
LGMRLGF

SEQ ID NO: 5033 - protein, 7 aa, Artificial Sequence
  Synthetic
ASTVEWL

SEQ ID NO: 5034 - protein, 7 aa, Artificial Sequence
  Synthetic
EAPKLWL

SEQ ID NO: 5035 - protein, 7 aa, Artificial Sequence
  Synthetic
IVNFCSG

SEQ ID NO: 5036 - protein, 7 aa, Artificial Sequence
  Synthetic
SATGWVA

SEQ ID NO: 5037 - protein, 7 aa, Artificial Sequence
  Synthetic
GLSFCPI

SEQ ID NO: 5038 - protein, 7 aa, Artificial Sequence
  Synthetic
SGIQAIW

SEQ ID NO: 5039 - protein, 7 aa, Artificial Sequence
  Synthetic
TNNGWMA

SEQ ID NO: 5040 - protein, 7 aa, Artificial Sequence
  Synthetic
LPSWLEP

SEQ ID NO: 5041 - protein, 7 aa, Artificial Sequence
  Synthetic
SSWGERM

SEQ ID NO: 5042 - protein, 7 aa, Artificial Sequence
  Synthetic
QFKFDQV

SEQ ID NO: 5043 - protein, 7 aa, Artificial Sequence
  Synthetic
ASWAPPQ

SEQ ID NO: 5044 - protein, 7 aa, Artificial Sequence
  Synthetic
SRLIPFT

SEQ ID NO: 5045 - protein, 7 aa, Artificial Sequence
  Synthetic
QAEWGKY

SEQ ID NO: 5046 - protein, 7 aa, Artificial Sequence
  Synthetic
VDGWYSA

SEQ ID NO: 5047 - protein, 7 aa, Artificial Sequence
  Synthetic
NPFRESL

SEQ ID NO: 5048 - protein, 7 aa, Artificial Sequence
  Synthetic
SLLRQAV

SEQ ID NO: 5049 - protein, 7 aa, Artificial Sequence
  Synthetic
NLAMPFL

SEQ ID NO: 5050 - protein, 7 aa, Artificial Sequence
  Synthetic
SLQKLFS

SEQ ID NO: 5051 - protein, 7 aa, Artificial Sequence
  Synthetic
FDLEYPR

SEQ ID NO: 5052 - protein, 7 aa, Artificial Sequence
  Synthetic
ERCGFVC

SEQ ID NO: 5053 - protein, 7 aa, Artificial Sequence
  Synthetic
RSCGYVC

SEQ ID NO: 5054 - protein, 7 aa, Artificial Sequence
  Synthetic
FFGAAFH

SEQ ID NO: 5055 - protein, 7 aa, Artificial Sequence
  Synthetic
SPSSLSW

SEQ ID NO: 5056 - protein, 7 aa, Artificial Sequence
  Synthetic
SVKFSAV

SEQ ID NO: 5057 - protein, 7 aa, Artificial Sequence
  Synthetic
YSHHLFK

SEQ ID NO: 5058 - protein, 7 aa, Artificial Sequence
  Synthetic
TPNAPFL

SEQ ID NO: 5059 - protein, 7 aa, Artificial Sequence
  Synthetic
HPLGWVG

SEQ ID NO: 5060 - protein, 7 aa, Artificial Sequence
  Synthetic
SLEQLFR

SEQ ID NO: 5061 - protein, 7 aa, Artificial Sequence
  Synthetic
VGNRSSC

SEQ ID NO: 5062 - protein, 7 aa, Artificial Sequence
  Synthetic
SKEGWVS

SEQ ID NO: 5063 - protein, 7 aa, Artificial Sequence
  Synthetic
QKAFADV

SEQ ID NO: 5064 - protein, 7 aa, Artificial Sequence
  Synthetic
MDFSHPR

SEQ ID NO: 5065 - protein, 7 aa, Artificial Sequence
  Synthetic
VPVWGLF

SEQ ID NO: 5066 - protein, 7 aa, Artificial Sequence
  Synthetic
SVNRPFV

SEQ ID NO: 5067 - protein, 7 aa, Artificial Sequence
  Synthetic
TPAKPFW

SEQ ID NO: 5068 - protein, 7 aa, Artificial Sequence
  Synthetic
VGSLPFH

SEQ ID NO: 5069 - protein, 7 aa, Artificial Sequence
  Synthetic
EYNRPFM

SEQ ID NO: 5070 - protein, 7 aa, Artificial Sequence
  Synthetic
TSVHWVA

SEQ ID NO: 5071 - protein, 7 aa, Artificial Sequence
  Synthetic
VDFATMY

SEQ ID NO: 5072 - protein, 7 aa, Artificial Sequence
  Synthetic
WGAAEIM

SEQ ID NO: 5073 - protein, 7 aa, Artificial Sequence
  Synthetic
YSSHMFL

SEQ ID NO: 5074 - protein, 7 aa, Artificial Sequence
  Synthetic
VPNNLSW

SEQ ID NO: 5075 - protein, 7 aa, Artificial Sequence
  Synthetic
TSIGFVA

SEQ ID NO: 5076 - protein, 7 aa, Artificial Sequence
  Synthetic
SVFCRIE

SEQ ID NO: 5077 - protein, 7 aa, Artificial Sequence
  Synthetic
NIDKIWL

SEQ ID NO: 5078 - protein, 7 aa, Artificial Sequence
  Synthetic
NTLSVSR

SEQ ID NO: 5079 - protein, 7 aa, Artificial Sequence
  Synthetic
QIPGWAA

SEQ ID NO: 5080 - protein, 7 aa, Artificial Sequence
  Synthetic
NAWGEIH

SEQ ID NO: 5081 - protein, 7 aa, Artificial Sequence
  Synthetic
QIQFSNI

SEQ ID NO: 5082 - protein, 7 aa, Artificial Sequence
  Synthetic
EVRFGVF

SEQ ID NO: 5083 - protein, 7 aa, Artificial Sequence
  Synthetic
RSFHVGD

SEQ ID NO: 5084 - protein, 7 aa, Artificial Sequence
  Synthetic
TAGMPFL

SEQ ID NO: 5085 - protein, 7 aa, Artificial Sequence
  Synthetic
SARIPFV

SEQ ID NO: 5086 - protein, 7 aa, Artificial Sequence
  Synthetic
VLERPWV

SEQ ID NO: 5087 - protein, 7 aa, Artificial Sequence
  Synthetic
DMTRPFQ

SEQ ID NO: 5088 - protein, 7 aa, Artificial Sequence
  Synthetic
GPSRLFQ

SEQ ID NO: 5089 - protein, 7 aa, Artificial Sequence
  Synthetic
LMLPAWA

SEQ ID NO: 5090 - protein, 7 aa, Artificial Sequence
  Synthetic
FTVAYPK

SEQ ID NO: 5091 - protein, 7 aa, Artificial Sequence
  Synthetic
TAYYPIP

SEQ ID NO: 5092 - protein, 7 aa, Artificial Sequence
  Synthetic
SGGWGSP

SEQ ID NO: 5093 - protein, 7 aa, Artificial Sequence
  Synthetic
AGGPWVP

SEQ ID NO: 5094 - protein, 7 aa, Artificial Sequence
  Synthetic
ATFVPPQ

SEQ ID NO: 5095 - protein, 7 aa, Artificial Sequence
  Synthetic
IDTPWVA

SEQ ID NO: 5096 - protein, 7 aa, Artificial Sequence
  Synthetic
AAVGWMP

SEQ ID NO: 5097 - protein, 7 aa, Artificial Sequence
  Synthetic
LGQRLGF

SEQ ID NO: 5098 - protein, 7 aa, Artificial Sequence
  Synthetic
QIKFSTI

SEQ ID NO: 5099 - protein, 7 aa, Artificial Sequence
  Synthetic
PAHATSW

SEQ ID NO: 5100 - protein, 7 aa, Artificial Sequence
  Synthetic
NAWSKTG

SEQ ID NO: 5101 - protein, 7 aa, Artificial Sequence
  Synthetic
LYGCCLE

SEQ ID NO: 5102 - protein, 7 aa, Artificial Sequence
  Synthetic
LGPLLVK

SEQ ID NO: 5103 - protein, 7 aa, Artificial Sequence
  Synthetic
KEMSISW

SEQ ID NO: 5104 - protein, 7 aa, Artificial Sequence
  Synthetic
ALPKEWL

SEQ ID NO: 5105 - protein, 7 aa, Artificial Sequence
  Synthetic
SGLSAIW

SEQ ID NO: 5106 - protein, 7 aa, Artificial Sequence
  Synthetic
LSTDLKC

SEQ ID NO: 5107 - protein, 7 aa, Artificial Sequence
  Synthetic
VPMTLSF

SEQ ID NO: 5108 - protein, 7 aa, Artificial Sequence
  Synthetic
ASWSPPE

SEQ ID NO: 5109 - protein, 7 aa, Artificial Sequence
  Synthetic
DPIWPYP

SEQ ID NO: 5110 - protein, 7 aa, Artificial Sequence
  Synthetic
LLMNVFG

SEQ ID NO: 5111 - protein, 7 aa, Artificial Sequence
  Synthetic
MKEFCTL

SEQ ID NO: 5112 - protein, 7 aa, Artificial Sequence
  Synthetic
VYFGESY

SEQ ID NO: 5113 - protein, 7 aa, Artificial Sequence
  Synthetic
GHWGPHL

SEQ ID NO: 5114 - protein, 7 aa, Artificial Sequence
  Synthetic
AGAVFNW

SEQ ID NO: 5115 - protein, 7 aa, Artificial Sequence
  Synthetic
SVERPFH

SEQ ID NO: 5116 - protein, 7 aa, Artificial Sequence
  Synthetic
VGLLPFS

SEQ ID NO: 5117 - protein, 7 aa, Artificial Sequence
  Synthetic
VPMNRTF

SEQ ID NO: 5118 - protein, 7 aa, Artificial Sequence
  Synthetic
VEFVPPM

SEQ ID NO: 5119 - protein, 7 aa, Artificial Sequence
  Synthetic
TRLGFTA

SEQ ID NO: 5120 - protein, 7 aa, Artificial Sequence
  Synthetic
DKDHLFR

SEQ ID NO: 5121 - protein, 7 aa, Artificial Sequence
  Synthetic
SMLGFSP

SEQ ID NO: 5122 - protein, 7 aa, Artificial Sequence
  Synthetic
GLDKPFL

SEQ ID NO: 5123 - protein, 7 aa, Artificial Sequence
  Synthetic
VPVRGWV

SEQ ID NO: 5124 - protein, 7 aa, Artificial Sequence
  Synthetic
TIWLSNG

SEQ ID NO: 5125 - protein, 7 aa, Artificial Sequence
  Synthetic
DVRPLLR

SEQ ID NO: 5126 - protein, 7 aa, Artificial Sequence
  Synthetic
WDMVGAR

SEQ ID NO: 5127 - protein, 7 aa, Artificial Sequence
  Synthetic
LMGCPSC

SEQ ID NO: 5128 - protein, 7 aa, Artificial Sequence
  Synthetic
SRQFSDV

SEQ ID NO: 5129 - protein, 7 aa, Artificial Sequence
  Synthetic
WTEHFPR

SEQ ID NO: 5130 - protein, 7 aa, Artificial Sequence
  Synthetic
LETFCRA

SEQ ID NO: 5131 - protein, 7 aa, Artificial Sequence
  Synthetic
YRNPMVA

SEQ ID NO: 5132 - protein, 7 aa, Artificial Sequence
  Synthetic
RAAGAHL

SEQ ID NO: 5133 - protein, 7 aa, Artificial Sequence
  Synthetic
VISRPFA

SEQ ID NO: 5134 - protein, 7 aa, Artificial Sequence
  Synthetic
LSQFCTP

SEQ ID NO: 5135 - protein, 7 aa, Artificial Sequence
  Synthetic
SPVAPFR

SEQ ID NO: 5136 - protein, 7 aa, Artificial Sequence
  Synthetic
QRLFNVV

SEQ ID NO: 5137 - protein, 7 aa, Artificial Sequence
  Synthetic
HYDVKPK

SEQ ID NO: 5138 - protein, 7 aa, Artificial Sequence
  Synthetic
DPTHPFR

SEQ ID NO: 5139 - protein, 7 aa, Artificial Sequence
  Synthetic
SNEWGVF

SEQ ID NO: 5140 - protein, 7 aa, Artificial Sequence
  Synthetic
LFDCSNC

SEQ ID NO: 5141 - protein, 7 aa, Artificial Sequence
  Synthetic
TFERPWT

SEQ ID NO: 5142 - protein, 7 aa, Artificial Sequence
  Synthetic
LIERPFQ

SEQ ID NO: 5143 - protein, 7 aa, Artificial Sequence
  Synthetic
WITFAEV

SEQ ID NO: 5144 - protein, 7 aa, Artificial Sequence
  Synthetic
KQTNWVD

SEQ ID NO: 5145 - protein, 7 aa, Artificial Sequence
  Synthetic
GKLPIVP

SEQ ID NO: 5146 - protein, 7 aa, Artificial Sequence
  Synthetic
MLTRPFS

SEQ ID NO: 5147 - protein, 7 aa, Artificial Sequence
  Synthetic
IDFFRPL

SEQ ID NO: 5148 - protein, 7 aa, Artificial Sequence
  Synthetic
TVTYPIP

SEQ ID NO: 5149 - protein, 7 aa, Artificial Sequence
  Synthetic
TAVALFK

SEQ ID NO: 5150 - protein, 7 aa, Artificial Sequence
  Synthetic
EITKPFW

SEQ ID NO: 5151 - protein, 7 aa, Artificial Sequence
  Synthetic
YQMKWFE

SEQ ID NO: 5152 - protein, 7 aa, Artificial Sequence
  Synthetic
DVRGWVP

SEQ ID NO: 5153 - protein, 7 aa, Artificial Sequence
  Synthetic
VSSFGQY

SEQ ID NO: 5154 - protein, 7 aa, Artificial Sequence
  Synthetic
YSGRPFL

SEQ ID NO: 5155 - protein, 7 aa, Artificial Sequence
  Synthetic
ENIKYTH

SEQ ID NO: 5156 - protein, 7 aa, Artificial Sequence
  Synthetic
DPWRPVG

SEQ ID NO: 5157 - protein, 7 aa, Artificial Sequence
  Synthetic
YVAGPPR

SEQ ID NO: 5158 - protein, 7 aa, Artificial Sequence
  Synthetic
LPESPFR

SEQ ID NO: 5159 - protein, 7 aa, Artificial Sequence
  Synthetic
TVWMPGG

SEQ ID NO: 5160 - protein, 7 aa, Artificial Sequence
  Synthetic
RHVNHAG

SEQ ID NO: 5161 - protein, 7 aa, Artificial Sequence
  Synthetic
SALGFVP

SEQ ID NO: 5162 - protein, 7 aa, Artificial Sequence
  Synthetic
STKFSAI

SEQ ID NO: 5163 - protein, 7 aa, Artificial Sequence
  Synthetic
VKERLFQ

SEQ ID NO: 5164 - protein, 7 aa, Artificial Sequence
  Synthetic
GQTWGAF

SEQ ID NO: 5165 - protein, 7 aa, Artificial Sequence
  Synthetic
SLMKLFP

SEQ ID NO: 5166 - protein, 7 aa, Artificial Sequence
  Synthetic
DVWRDDG

SEQ ID NO: 5167 - protein, 7 aa, Artificial Sequence
  Synthetic
VLGHTFL

SEQ ID NO: 5168 - protein, 7 aa, Artificial Sequence
  Synthetic
GIYGFAS

SEQ ID NO: 5169 - protein, 7 aa, Artificial Sequence
  Synthetic
REARHIG

SEQ ID NO: 5170 - protein, 7 aa, Artificial Sequence
  Synthetic
YSERPWP

SEQ ID NO: 5171 - protein, 7 aa, Artificial Sequence
  Synthetic
RVAQEGR

SEQ ID NO: 5172 - protein, 7 aa, Artificial Sequence
  Synthetic
YQEMFFS

SEQ ID NO: 5173 - protein, 7 aa, Artificial Sequence
  Synthetic
LREFIFG

SEQ ID NO: 5174 - protein, 7 aa, Artificial Sequence
  Synthetic
QYNHRAN

SEQ ID NO: 5175 - protein, 7 aa, Artificial Sequence
  Synthetic
AGVQLGC

SEQ ID NO: 5176 - protein, 7 aa, Artificial Sequence
  Synthetic
RNRFEDI

SEQ ID NO: 5177 - protein, 7 aa, Artificial Sequence
  Synthetic
SSLGWAA

SEQ ID NO: 5178 - protein, 7 aa, Artificial Sequence
  Synthetic
PNQQYHL

SEQ ID NO: 5179 - protein, 7 aa, Artificial Sequence
  Synthetic
IHARGLV

SEQ ID NO: 5180 - protein, 7 aa, Artificial Sequence
  Synthetic
TLKLPFM

SEQ ID NO: 5181 - protein, 7 aa, Artificial Sequence
  Synthetic
ASWTPPV

SEQ ID NO: 5182 - protein, 7 aa, Artificial Sequence
  Synthetic
AKVPWQA

SEQ ID NO: 5183 - protein, 7 aa, Artificial Sequence
  Synthetic
NERHPFL

SEQ ID NO: 5184 - protein, 7 aa, Artificial Sequence
  Synthetic
GDSPWVA

SEQ ID NO: 5185 - protein, 7 aa, Artificial Sequence
  Synthetic
WGAAERL

SEQ ID NO: 5186 - protein, 7 aa, Artificial Sequence
  Synthetic
TVWNPPS

SEQ ID NO: 5187 - protein, 7 aa, Artificial Sequence
  Synthetic
HEGRPWV

SEQ ID NO: 5188 - protein, 7 aa, Artificial Sequence
  Synthetic
QTNFAHI

SEQ ID NO: 5189 - protein, 7 aa, Artificial Sequence
  Synthetic
WWPGAWE

SEQ ID NO: 5190 - protein, 7 aa, Artificial Sequence
  Synthetic
SFRTPFI

SEQ ID NO: 5191 - protein, 7 aa, Artificial Sequence
  Synthetic
QAKFQDI

SEQ ID NO: 5192 - protein, 7 aa, Artificial Sequence
  Synthetic
VLKFGTY

SEQ ID NO: 5193 - protein, 7 aa, Artificial Sequence
  Synthetic
AVRFDCV

SEQ ID NO: 5194 - protein, 7 aa, Artificial Sequence
  Synthetic
RAPFFLS

SEQ ID NO: 5195 - protein, 7 aa, Artificial Sequence
  Synthetic
SLKFSSV

SEQ ID NO: 5196 - protein, 7 aa, Artificial Sequence
  Synthetic
WNVNCSV

SEQ ID NO: 5197 - protein, 7 aa, Artificial Sequence
  Synthetic
WCKAAKD

SEQ ID NO: 5198 - protein, 7 aa, Artificial Sequence
  Synthetic
SIEIPFQ

SEQ ID NO: 5199 - protein, 7 aa, Artificial Sequence
  Synthetic
TLERVFI

SEQ ID NO: 5200 - protein, 7 aa, Artificial Sequence
  Synthetic
QVRFALQ

SEQ ID NO: 5201 - protein, 7 aa, Artificial Sequence
  Synthetic
RAEVGAR

SEQ ID NO: 5202 - protein, 7 aa, Artificial Sequence
  Synthetic
TTQKPFV

SEQ ID NO: 5203 - protein, 7 aa, Artificial Sequence
  Synthetic
AETFCRG

SEQ ID NO: 5204 - protein, 7 aa, Artificial Sequence
  Synthetic
GFERPFL

SEQ ID NO: 5205 - protein, 7 aa, Artificial Sequence
  Synthetic
GNWRPPA

SEQ ID NO: 5206 - protein, 7 aa, Artificial Sequence
  Synthetic
ILGWSDL

SEQ ID NO: 5207 - protein, 7 aa, Artificial Sequence
  Synthetic
SYEFSRV

SEQ ID NO: 5208 - protein, 7 aa, Artificial Sequence
  Synthetic
FTMSGPK

SEQ ID NO: 5209 - protein, 7 aa, Artificial Sequence
  Synthetic
WEEFKRV

SEQ ID NO: 5210 - protein, 7 aa, Artificial Sequence
  Synthetic
SLINPFS

SEQ ID NO: 5211 - protein, 7 aa, Artificial Sequence
  Synthetic
GGNSGMR

SEQ ID NO: 5212 - protein, 7 aa, Artificial Sequence
  Synthetic
MPKGSGW

SEQ ID NO: 5213 - protein, 7 aa, Artificial Sequence
  Synthetic
ALWSDVS

SEQ ID NO: 5214 - protein, 7 aa, Artificial Sequence
  Synthetic
TFQNPFL

SEQ ID NO: 5215 - protein, 7 aa, Artificial Sequence
  Synthetic
TEIHWSP

SEQ ID NO: 5216 - protein, 7 aa, Artificial Sequence
  Synthetic
YPGMLFY

SEQ ID NO: 5217 - protein, 7 aa, Artificial Sequence
  Synthetic
PLLFQNV

SEQ ID NO: 5218 - protein, 7 aa, Artificial Sequence
  Synthetic
IQFNNPR

SEQ ID NO: 5219 - protein, 7 aa, Artificial Sequence
  Synthetic
TVWSLSG

SEQ ID NO: 5220 - protein, 7 aa, Artificial Sequence
  Synthetic
SPTLPFL

SEQ ID NO: 5221 - protein, 7 aa, Artificial Sequence
  Synthetic
AAEGWIA

SEQ ID NO: 5222 - protein, 7 aa, Artificial Sequence
  Synthetic
GTFHPPR

SEQ ID NO: 5223 - protein, 7 aa, Artificial Sequence
  Synthetic
LGIQSIF

SEQ ID NO: 5224 - protein, 7 aa, Artificial Sequence
  Synthetic
MPEWGKF

SEQ ID NO: 5225 - protein, 7 aa, Artificial Sequence
  Synthetic
IPSNTSW

SEQ ID NO: 5226 - protein, 7 aa, Artificial Sequence
  Synthetic
YAGYFFA

SEQ ID NO: 5227 - protein, 7 aa, Artificial Sequence
  Synthetic
EVFRPHL

SEQ ID NO: 5228 - protein, 7 aa, Artificial Sequence
  Synthetic
QLRFESI

SEQ ID NO: 5229 - protein, 7 aa, Artificial Sequence
  Synthetic
LPSWLDP

SEQ ID NO: 5230 - protein, 7 aa, Artificial Sequence
  Synthetic
RTSFATI

SEQ ID NO: 5231 - protein, 7 aa, Artificial Sequence
  Synthetic
SEVGWAA

SEQ ID NO: 5232 - protein, 7 aa, Artificial Sequence
  Synthetic
SVWGAVH

SEQ ID NO: 5233 - protein, 7 aa, Artificial Sequence
  Synthetic
WTMIGSV

SEQ ID NO: 5234 - protein, 7 aa, Artificial Sequence
  Synthetic
RNNNPGL

SEQ ID NO: 5235 - protein, 7 aa, Artificial Sequence
  Synthetic
SSPGWVA

SEQ ID NO: 5236 - protein, 7 aa, Artificial Sequence
  Synthetic
HVIGWTQ

SEQ ID NO: 5237 - protein, 7 aa, Artificial Sequence
  Synthetic
VRHNLNG

SEQ ID NO: 5238 - protein, 7 aa, Artificial Sequence
  Synthetic
GVPRTHV

SEQ ID NO: 5239 - protein, 7 aa, Artificial Sequence
  Synthetic
HEAARPR

SEQ ID NO: 5240 - protein, 7 aa, Artificial Sequence
  Synthetic
MPMNISY

SEQ ID NO: 5241 - protein, 7 aa, Artificial Sequence
  Synthetic
TPWRVEG

SEQ ID NO: 5242 - protein, 7 aa, Artificial Sequence
  Synthetic
GSVGWVA

SEQ ID NO: 5243 - protein, 7 aa, Artificial Sequence
  Synthetic
MSFATHL

SEQ ID NO: 5244 - protein, 7 aa, Artificial Sequence
  Synthetic
LMQLCTV

SEQ ID NO: 5245 - protein, 7 aa, Artificial Sequence
  Synthetic
CAVSARY

SEQ ID NO: 5246 - protein, 7 aa, Artificial Sequence
  Synthetic
SYTSPFM

SEQ ID NO: 5247 - protein, 7 aa, Artificial Sequence
  Synthetic
NSWGEAK

SEQ ID NO: 5248 - protein, 7 aa, Artificial Sequence
  Synthetic
DVWRSSG

SEQ ID NO: 5249 - protein, 7 aa, Artificial Sequence
  Synthetic
QYRFEDV

SEQ ID NO: 5250 - protein, 7 aa, Artificial Sequence
  Synthetic
VAGWSQY

SEQ ID NO: 5251 - protein, 7 aa, Artificial Sequence
  Synthetic
LLPEHWL

SEQ ID NO: 5252 - protein, 7 aa, Artificial Sequence
  Synthetic
TVTMLFA

SEQ ID NO: 5253 - protein, 7 aa, Artificial Sequence
  Synthetic
IPPGFYP

SEQ ID NO: 5254 - protein, 7 aa, Artificial Sequence
  Synthetic
SPTHIFQ

SEQ ID NO: 5255 - protein, 7 aa, Artificial Sequence
  Synthetic
VGVKLGC

SEQ ID NO: 5256 - protein, 7 aa, Artificial Sequence
  Synthetic
LSDRPWV

SEQ ID NO: 5257 - protein, 7 aa, Artificial Sequence
  Synthetic
TLATPFT

SEQ ID NO: 5258 - protein, 7 aa, Artificial Sequence
  Synthetic
GAFAFFE

SEQ ID NO: 5259 - protein, 7 aa, Artificial Sequence
  Synthetic
LQRGLER

SEQ ID NO: 5260 - protein, 7 aa, Artificial Sequence
  Synthetic
CILGLGC

SEQ ID NO: 5261 - protein, 7 aa, Artificial Sequence
  Synthetic
GAWGFVA

SEQ ID NO: 5262 - protein, 7 aa, Artificial Sequence
  Synthetic
WGFEGPR

SEQ ID NO: 5263 - protein, 7 aa, Artificial Sequence
  Synthetic
ALRFSAV

SEQ ID NO: 5264 - protein, 7 aa, Artificial Sequence
  Synthetic
GVFNPPE

SEQ ID NO: 5265 - protein, 7 aa, Artificial Sequence
  Synthetic
SREFCEV

SEQ ID NO: 5266 - protein, 7 aa, Artificial Sequence
  Synthetic
EPHWHDS

SEQ ID NO: 5267 - protein, 7 aa, Artificial Sequence
  Synthetic
VEGWYLA

SEQ ID NO: 5268 - protein, 7 aa, Artificial Sequence
  Synthetic
SPSQPFW

SEQ ID NO: 5269 - protein, 7 aa, Artificial Sequence
  Synthetic
DPLFRIA

SEQ ID NO: 5270 - protein, 7 aa, Artificial Sequence
  Synthetic
TGVALGR

SEQ ID NO: 5271 - protein, 7 aa, Artificial Sequence
  Synthetic
QTRFSEF

SEQ ID NO: 5272 - protein, 7 aa, Artificial Sequence
  Synthetic
DCRIKNP

SEQ ID NO: 5273 - protein, 7 aa, Artificial Sequence
  Synthetic
VGVPWLA

SEQ ID NO: 5274 - protein, 7 aa, Artificial Sequence
  Synthetic
GGWIYEA

SEQ ID NO: 5275 - protein, 7 aa, Artificial Sequence
  Synthetic
RELDRQR

SEQ ID NO: 5276 - protein, 7 aa, Artificial Sequence
  Synthetic
QRQEEDW

SEQ ID NO: 5277 - protein, 7 aa, Artificial Sequence
  Synthetic
GHFTPPV

SEQ ID NO: 5278 - protein, 7 aa, Artificial Sequence
  Synthetic
YGMRLGV

SEQ ID NO: 5279 - protein, 7 aa, Artificial Sequence
  Synthetic
SNAWGEY

SEQ ID NO: 5280 - protein, 7 aa, Artificial Sequence
  Synthetic
STHRTAC

SEQ ID NO: 5281 - protein, 7 aa, Artificial Sequence
  Synthetic
LKGIPIV

SEQ ID NO: 5282 - protein, 7 aa, Artificial Sequence
  Synthetic
FRLNPSV

SEQ ID NO: 5283 - protein, 7 aa, Artificial Sequence
  Synthetic
SVEFCTM

SEQ ID NO: 5284 - protein, 7 aa, Artificial Sequence
  Synthetic
GHPNQRL

SEQ ID NO: 5285 - protein, 7 aa, Artificial Sequence
  Synthetic
VSGWYVE

SEQ ID NO: 5286 - protein, 7 aa, Artificial Sequence
  Synthetic
GSSGWVA

SEQ ID NO: 5287 - protein, 7 aa, Artificial Sequence
  Synthetic
LPIQTWL

SEQ ID NO: 5288 - protein, 7 aa, Artificial Sequence
  Synthetic
TVFGTVY

SEQ ID NO: 5289 - protein, 7 aa, Artificial Sequence
  Synthetic
VGTMPFT

SEQ ID NO: 5290 - protein, 7 aa, Artificial Sequence
  Synthetic
FMDKPWY

SEQ ID NO: 5291 - protein, 7 aa, Artificial Sequence
  Synthetic
SDPHWVR

SEQ ID NO: 5292 - protein, 7 aa, Artificial Sequence
  Synthetic
VDKPWVP

SEQ ID NO: 5293 - protein, 7 aa, Artificial Sequence
  Synthetic
TQVQLFK

SEQ ID NO: 5294 - protein, 7 aa, Artificial Sequence
  Synthetic
FDLSSPR

SEQ ID NO: 5295 - protein, 7 aa, Artificial Sequence
  Synthetic
TESPSEH

SEQ ID NO: 5296 - protein, 7 aa, Artificial Sequence
  Synthetic
QIDHPWL

SEQ ID NO: 5297 - protein, 7 aa, Artificial Sequence
  Synthetic
DISRPFM

SEQ ID NO: 5298 - protein, 7 aa, Artificial Sequence
  Synthetic
GSYGFVP

SEQ ID NO: 5299 - protein, 7 aa, Artificial Sequence
  Synthetic
FNSWPMP

SEQ ID NO: 5300 - protein, 7 aa, Artificial Sequence
  Synthetic
VRDMGLW

SEQ ID NO: 5301 - protein, 7 aa, Artificial Sequence
  Synthetic
EPIRGWI

SEQ ID NO: 5302 - protein, 7 aa, Artificial Sequence
  Synthetic
TKEFAMI

SEQ ID NO: 5303 - protein, 7 aa, Artificial Sequence
  Synthetic
VHPFWQA

SEQ ID NO: 5304 - protein, 7 aa, Artificial Sequence
  Synthetic
YTGAPFH

SEQ ID NO: 5305 - protein, 7 aa, Artificial Sequence
  Synthetic
QVVFANV

SEQ ID NO: 5306 - protein, 7 aa, Artificial Sequence
  Synthetic
STENPFR

SEQ ID NO: 5307 - protein, 7 aa, Artificial Sequence
  Synthetic
MLPRWPP

SEQ ID NO: 5308 - protein, 7 aa, Artificial Sequence
  Synthetic
GLFGFVA

SEQ ID NO: 5309 - protein, 7 aa, Artificial Sequence
  Synthetic
FMQSTKN

SEQ ID NO: 5310 - protein, 7 aa, Artificial Sequence
  Synthetic
LFAKEWL

SEQ ID NO: 5311 - protein, 7 aa, Artificial Sequence
  Synthetic
QGAFCNP

SEQ ID NO: 5312 - protein, 7 aa, Artificial Sequence
  Synthetic
WVFDGGG

SEQ ID NO: 5313 - protein, 7 aa, Artificial Sequence
  Synthetic
SKEFCEI

SEQ ID NO: 5314 - protein, 7 aa, Artificial Sequence
  Synthetic
RPASTSW

SEQ ID NO: 5315 - protein, 7 aa, Artificial Sequence
  Synthetic
KERVNTH

SEQ ID NO: 5316 - protein, 7 aa, Artificial Sequence
  Synthetic
VVADWTK

SEQ ID NO: 5317 - protein, 7 aa, Artificial Sequence
  Synthetic
NKDGGRA

SEQ ID NO: 5318 - protein, 7 aa, Artificial Sequence
  Synthetic
VTGWYGE

SEQ ID NO: 5319 - protein, 7 aa, Artificial Sequence
  Synthetic
RWEENSY

SEQ ID NO: 5320 - protein, 7 aa, Artificial Sequence
  Synthetic
SREAQSK

SEQ ID NO: 5321 - protein, 7 aa, Artificial Sequence
  Synthetic
QGVKLGC

SEQ ID NO: 5322 - protein, 7 aa, Artificial Sequence
  Synthetic
AMHNIVA

SEQ ID NO: 5323 - protein, 7 aa, Artificial Sequence
  Synthetic
GILGNRG

SEQ ID NO: 5324 - protein, 7 aa, Artificial Sequence
  Synthetic
MGASFCP

SEQ ID NO: 5325 - protein, 7 aa, Artificial Sequence
  Synthetic
TSNNPWL

SEQ ID NO: 5326 - protein, 7 aa, Artificial Sequence
  Synthetic
TTLRPFV

SEQ ID NO: 5327 - protein, 7 aa, Artificial Sequence
  Synthetic
NLFGEHL

SEQ ID NO: 5328 - protein, 7 aa, Artificial Sequence
  Synthetic
VIVSMRP

SEQ ID NO: 5329 - protein, 7 aa, Artificial Sequence
  Synthetic
TNFCELI

SEQ ID NO: 5330 - protein, 7 aa, Artificial Sequence
  Synthetic
TVWASQG

SEQ ID NO: 5331 - protein, 7 aa, Artificial Sequence
  Synthetic
IGSLPWM

SEQ ID NO: 5332 - protein, 7 aa, Artificial Sequence
  Synthetic
QIRFEQV

SEQ ID NO: 5333 - protein, 7 aa, Artificial Sequence
  Synthetic
YHDHPFV

SEQ ID NO: 5334 - protein, 7 aa, Artificial Sequence
  Synthetic
VSPFYIN

SEQ ID NO: 5335 - protein, 7 aa, Artificial Sequence
  Synthetic
TLQLPFI

SEQ ID NO: 5336 - protein, 7 aa, Artificial Sequence
  Synthetic
VGGVPFR

SEQ ID NO: 5337 - protein, 7 aa, Artificial Sequence
  Synthetic
QVRLIDV

SEQ ID NO: 5338 - protein, 7 aa, Artificial Sequence
  Synthetic
VLANPFR

SEQ ID NO: 5339 - protein, 7 aa, Artificial Sequence
  Synthetic
TMSLPFL

SEQ ID NO: 5340 - protein, 7 aa, Artificial Sequence
  Synthetic
GMWESGG

SEQ ID NO: 5341 - protein, 7 aa, Artificial Sequence
  Synthetic
YDLVGPR

SEQ ID NO: 5342 - protein, 7 aa, Artificial Sequence
  Synthetic
LPELPFR

SEQ ID NO: 5343 - protein, 7 aa, Artificial Sequence
  Synthetic
TVGRMFV

SEQ ID NO: 5344 - protein, 7 aa, Artificial Sequence
  Synthetic
ITINTSR

SEQ ID NO: 5345 - protein, 7 aa, Artificial Sequence
  Synthetic
SSANPFK

SEQ ID NO: 5346 - protein, 7 aa, Artificial Sequence
  Synthetic
LDPIPFS

SEQ ID NO: 5347 - protein, 7 aa, Artificial Sequence
  Synthetic
YIGRLFA

SEQ ID NO: 5348 - protein, 7 aa, Artificial Sequence
  Synthetic
SVKFSAI

SEQ ID NO: 5349 - protein, 7 aa, Artificial Sequence
  Synthetic
VMDPMLF

SEQ ID NO: 5350 - protein, 7 aa, Artificial Sequence
  Synthetic
IGVVVSL

SEQ ID NO: 5351 - protein, 7 aa, Artificial Sequence
  Synthetic
PMMTTAW

SEQ ID NO: 5352 - protein, 7 aa, Artificial Sequence
  Synthetic
GKSALKA

SEQ ID NO: 5353 - protein, 7 aa, Artificial Sequence
  Synthetic
RVGGTES

SEQ ID NO: 5354 - protein, 7 aa, Artificial Sequence
  Synthetic
VSSQLHR

SEQ ID NO: 5355 - protein, 7 aa, Artificial Sequence
  Synthetic
STQFCAL

SEQ ID NO: 5356 - protein, 7 aa, Artificial Sequence
  Synthetic
EYTTLFR

SEQ ID NO: 5357 - protein, 7 aa, Artificial Sequence
  Synthetic
FLDRPFP

SEQ ID NO: 5358 - protein, 7 aa, Artificial Sequence
  Synthetic
VRFEMPQ

SEQ ID NO: 5359 - protein, 7 aa, Artificial Sequence
  Synthetic
SYQTPAR

SEQ ID NO: 5360 - protein, 7 aa, Artificial Sequence
  Synthetic
DWRGNNH

SEQ ID NO: 5361 - protein, 7 aa, Artificial Sequence
  Synthetic
SKSFVSI

SEQ ID NO: 5362 - protein, 7 aa, Artificial Sequence
  Synthetic
ALARPFP

SEQ ID NO: 5363 - protein, 7 aa, Artificial Sequence
  Synthetic
TVPGWAA

SEQ ID NO: 5364 - protein, 7 aa, Artificial Sequence
  Synthetic
VPAKPFL

SEQ ID NO: 5365 - protein, 7 aa, Artificial Sequence
  Synthetic
SVWRTEG

SEQ ID NO: 5366 - protein, 7 aa, Artificial Sequence
  Synthetic
GSGRGRE

SEQ ID NO: 5367 - protein, 7 aa, Artificial Sequence
  Synthetic
YRERLFS

SEQ ID NO: 5368 - protein, 7 aa, Artificial Sequence
  Synthetic
PDIARLW

SEQ ID NO: 5369 - protein, 7 aa, Artificial Sequence
  Synthetic
YDHRPFQ

SEQ ID NO: 5370 - protein, 7 aa, Artificial Sequence
  Synthetic
HGTGARM

SEQ ID NO: 5371 - protein, 7 aa, Artificial Sequence
  Synthetic
NTMSSSR

SEQ ID NO: 5372 - protein, 7 aa, Artificial Sequence
  Synthetic
DLFLSGR

SEQ ID NO: 5373 - protein, 7 aa, Artificial Sequence
  Synthetic
LRREWIG

SEQ ID NO: 5374 - protein, 7 aa, Artificial Sequence
  Synthetic
GIRSTER

SEQ ID NO: 5375 - protein, 7 aa, Artificial Sequence
  Synthetic
LGERPWL

SEQ ID NO: 5376 - protein, 7 aa, Artificial Sequence
  Synthetic
RAEGGRN

SEQ ID NO: 5377 - protein, 7 aa, Artificial Sequence
  Synthetic
GEFYQPR

SEQ ID NO: 5378 - protein, 7 aa, Artificial Sequence
  Synthetic
QKHFTLQ

SEQ ID NO: 5379 - protein, 7 aa, Artificial Sequence
  Synthetic
GVWGRSV

SEQ ID NO: 5380 - protein, 7 aa, Artificial Sequence
  Synthetic
VKANVFG

SEQ ID NO: 5381 - protein, 7 aa, Artificial Sequence
  Synthetic
HVWDPPT

SEQ ID NO: 5382 - protein, 7 aa, Artificial Sequence
  Synthetic
VGHVPFT

SEQ ID NO: 5383 - protein, 7 aa, Artificial Sequence
  Synthetic
HVMGAGR

SEQ ID NO: 5384 - protein, 7 aa, Artificial Sequence
  Synthetic
TTSFCPD

SEQ ID NO: 5385 - protein, 7 aa, Artificial Sequence
  Synthetic
QVRFASV

SEQ ID NO: 5386 - protein, 7 aa, Artificial Sequence
  Synthetic
QTSLCAV

SEQ ID NO: 5387 - protein, 7 aa, Artificial Sequence
  Synthetic
LEFASPK

SEQ ID NO: 5388 - protein, 7 aa, Artificial Sequence
  Synthetic
LGMGFVP

SEQ ID NO: 5389 - protein, 7 aa, Artificial Sequence
  Synthetic
LKHRPEG

SEQ ID NO: 5390 - protein, 7 aa, Artificial Sequence
  Synthetic
VLSHLFA

SEQ ID NO: 5391 - protein, 7 aa, Artificial Sequence
  Synthetic
SRAFKDV

SEQ ID NO: 5392 - protein, 7 aa, Artificial Sequence
  Synthetic
TANLPFI

SEQ ID NO: 5393 - protein, 7 aa, Artificial Sequence
  Synthetic
TIWLDHG

SEQ ID NO: 5394 - protein, 7 aa, Artificial Sequence
  Synthetic
WGAAARL

SEQ ID NO: 5395 - protein, 7 aa, Artificial Sequence
  Synthetic
WSSKPQL

SEQ ID NO: 5396 - protein, 7 aa, Artificial Sequence
  Synthetic
NGRREGH

SEQ ID NO: 5397 - protein, 7 aa, Artificial Sequence
  Synthetic
GSGPWVA

SEQ ID NO: 5398 - protein, 7 aa, Artificial Sequence
  Synthetic
SKNFSVI

SEQ ID NO: 5399 - protein, 7 aa, Artificial Sequence
  Synthetic
DMRLVNS

SEQ ID NO: 5400 - protein, 7 aa, Artificial Sequence
  Synthetic
RLQVGHA

SEQ ID NO: 5401 - protein, 7 aa, Artificial Sequence
  Synthetic
SVARPFM

SEQ ID NO: 5402 - protein, 7 aa, Artificial Sequence
  Synthetic
SISMPFS

SEQ ID NO: 5403 - protein, 7 aa, Artificial Sequence
  Synthetic
SIASPFI

SEQ ID NO: 5404 - protein, 7 aa, Artificial Sequence
  Synthetic
GGGRAGN

SEQ ID NO: 5405 - protein, 7 aa, Artificial Sequence
  Synthetic
ITVTTSK

SEQ ID NO: 5406 - protein, 7 aa, Artificial Sequence
  Synthetic
YRDRLFA

SEQ ID NO: 5407 - protein, 7 aa, Artificial Sequence
  Synthetic
TKMLATA

SEQ ID NO: 5408 - protein, 7 aa, Artificial Sequence
  Synthetic
VDRQYFH

SEQ ID NO: 5409 - protein, 7 aa, Artificial Sequence
  Synthetic
SAIFRDV

SEQ ID NO: 5410 - protein, 7 aa, Artificial Sequence
  Synthetic
KLAHGLV

SEQ ID NO: 5411 - protein, 7 aa, Artificial Sequence
  Synthetic
REFRANC

SEQ ID NO: 5412 - protein, 7 aa, Artificial Sequence
  Synthetic
WDQLGPK

SEQ ID NO: 5413 - protein, 7 aa, Artificial Sequence
  Synthetic
TSSGWVA

SEQ ID NO: 5414 - protein, 7 aa, Artificial Sequence
  Synthetic
IRHPSHM

SEQ ID NO: 5415 - protein, 7 aa, Artificial Sequence
  Synthetic
GVWVPPN

SEQ ID NO: 5416 - protein, 7 aa, Artificial Sequence
  Synthetic
FTLGSAR

SEQ ID NO: 5417 - protein, 7 aa, Artificial Sequence
  Synthetic
TASWPFS

SEQ ID NO: 5418 - protein, 7 aa, Artificial Sequence
  Synthetic
SAMRPFV

SEQ ID NO: 5419 - protein, 7 aa, Artificial Sequence
  Synthetic
IFVMGSV

SEQ ID NO: 5420 - protein, 7 aa, Artificial Sequence
  Synthetic
LRKNWLD

SEQ ID NO: 5421 - protein, 7 aa, Artificial Sequence
  Synthetic
HIGHLFV

SEQ ID NO: 5422 - protein, 7 aa, Artificial Sequence
  Synthetic
YSNHLFR

SEQ ID NO: 5423 - protein, 7 aa, Artificial Sequence
  Synthetic
GYMGWVA

SEQ ID NO: 5424 - protein, 7 aa, Artificial Sequence
  Synthetic
LLPDYWL

SEQ ID NO: 5425 - protein, 7 aa, Artificial Sequence
  Synthetic
SVYVPFV

SEQ ID NO: 5426 - protein, 7 aa, Artificial Sequence
  Synthetic
VPSSVSW

SEQ ID NO: 5427 - protein, 7 aa, Artificial Sequence
  Synthetic
EVSLGHR

SEQ ID NO: 5428 - protein, 7 aa, Artificial Sequence
  Synthetic
SSSKPFV

SEQ ID NO: 5429 - protein, 7 aa, Artificial Sequence
  Synthetic
GHVGWTP

SEQ ID NO: 5430 - protein, 7 aa, Artificial Sequence
  Synthetic
MRSENRS

SEQ ID NO: 5431 - protein, 7 aa, Artificial Sequence
  Synthetic
RAEWAAF

SEQ ID NO: 5432 - protein, 7 aa, Artificial Sequence
  Synthetic
VQTKPFL

SEQ ID NO: 5433 - protein, 7 aa, Artificial Sequence
  Synthetic
LAFVPPH

SEQ ID NO: 5434 - protein, 7 aa, Artificial Sequence
  Synthetic
RGNLLDK

SEQ ID NO: 5435 - protein, 7 aa, Artificial Sequence
  Synthetic
WGSYESY

SEQ ID NO: 5436 - protein, 7 aa, Artificial Sequence
  Synthetic
RNLTRDG

SEQ ID NO: 5437 - protein, 7 aa, Artificial Sequence
  Synthetic
PLEFRHV

SEQ ID NO: 5438 - protein, 7 aa, Artificial Sequence
  Synthetic
PQSNSSW

SEQ ID NO: 5439 - protein, 7 aa, Artificial Sequence
  Synthetic
PSSSSTW

SEQ ID NO: 5440 - protein, 7 aa, Artificial Sequence
  Synthetic
SVLRPFM

SEQ ID NO: 5441 - protein, 7 aa, Artificial Sequence
  Synthetic
VRAASER

SEQ ID NO: 5442 - protein, 7 aa, Artificial Sequence
  Synthetic
EVWGKGH

SEQ ID NO: 5443 - protein, 7 aa, Artificial Sequence
  Synthetic
NRDLSNR

SEQ ID NO: 5444 - protein, 7 aa, Artificial Sequence
  Synthetic
SMSKPFT

SEQ ID NO: 5445 - protein, 7 aa, Artificial Sequence
  Synthetic
QLRFEVM

SEQ ID NO: 5446 - protein, 7 aa, Artificial Sequence
  Synthetic
IATFCPV

SEQ ID NO: 5447 - protein, 7 aa, Artificial Sequence
  Synthetic
KKSFEVI

SEQ ID NO: 5448 - protein, 7 aa, Artificial Sequence
  Synthetic
DLTRPFL

SEQ ID NO: 5449 - protein, 7 aa, Artificial Sequence
  Synthetic
RGHPLTQ

SEQ ID NO: 5450 - protein, 7 aa, Artificial Sequence
  Synthetic
GPWFHTE

SEQ ID NO: 5451 - protein, 7 aa, Artificial Sequence
  Synthetic
WQKLGEV

SEQ ID NO: 5452 - protein, 7 aa, Artificial Sequence
  Synthetic
SSHGWIA

SEQ ID NO: 5453 - protein, 7 aa, Artificial Sequence
  Synthetic
GPQTYSA

SEQ ID NO: 5454 - protein, 7 aa, Artificial Sequence
  Synthetic
VGTIPFQ

SEQ ID NO: 5455 - protein, 7 aa, Artificial Sequence
  Synthetic
TRDFGLF

SEQ ID NO: 5456 - protein, 7 aa, Artificial Sequence
  Synthetic
MRHVVVP

SEQ ID NO: 5457 - protein, 7 aa, Artificial Sequence
  Synthetic
CVWNQNC

SEQ ID NO: 5458 - protein, 7 aa, Artificial Sequence
  Synthetic
SESMPFR

SEQ ID NO: 5459 - protein, 7 aa, Artificial Sequence
  Synthetic
QVSRPFM

SEQ ID NO: 5460 - protein, 7 aa, Artificial Sequence
  Synthetic
NLFGDRL

SEQ ID NO: 5461 - protein, 7 aa, Artificial Sequence
  Synthetic
ASLPRDR

SEQ ID NO: 5462 - protein, 7 aa, Artificial Sequence
  Synthetic
ITSTTSR

SEQ ID NO: 5463 - protein, 7 aa, Artificial Sequence
  Synthetic
IEFNSPR

SEQ ID NO: 5464 - protein, 7 aa, Artificial Sequence
  Synthetic
ILVNSGQ

SEQ ID NO: 5465 - protein, 7 aa, Artificial Sequence
  Synthetic
RNPGWIA

SEQ ID NO: 5466 - protein, 7 aa, Artificial Sequence
  Synthetic
FRNCVSD

SEQ ID NO: 5467 - protein, 7 aa, Artificial Sequence
  Synthetic
ANTGWAP

SEQ ID NO: 5468 - protein, 7 aa, Artificial Sequence
  Synthetic
PSHPNRG

SEQ ID NO: 5469 - protein, 7 aa, Artificial Sequence
  Synthetic
LLVSTRV

SEQ ID NO: 5470 - protein, 7 aa, Artificial Sequence
  Synthetic
SPGFSVD

SEQ ID NO: 5471 - protein, 7 aa, Artificial Sequence
  Synthetic
KYMDGGT

SEQ ID NO: 5472 - protein, 7 aa, Artificial Sequence
  Synthetic
APWYPTG

SEQ ID NO: 5473 - protein, 7 aa, Artificial Sequence
  Synthetic
VIGNILN

SEQ ID NO: 5474 - protein, 7 aa, Artificial Sequence
  Synthetic
YESRPFT

SEQ ID NO: 5475 - protein, 7 aa, Artificial Sequence
  Synthetic
QSVMVAV

SEQ ID NO: 5476 - protein, 7 aa, Artificial Sequence
  Synthetic
RPPFFLD

SEQ ID NO: 5477 - protein, 7 aa, Artificial Sequence
  Synthetic
SIRFGFQ

SEQ ID NO: 5478 - protein, 7 aa, Artificial Sequence
  Synthetic
SIMQPFM

SEQ ID NO: 5479 - protein, 7 aa, Artificial Sequence
  Synthetic
LRSVAHC

SEQ ID NO: 5480 - protein, 7 aa, Artificial Sequence
  Synthetic
SGPGWVA

SEQ ID NO: 5481 - protein, 7 aa, Artificial Sequence
  Synthetic
GTRAALY

SEQ ID NO: 5482 - protein, 7 aa, Artificial Sequence
  Synthetic
MSFASMH

SEQ ID NO: 5483 - protein, 7 aa, Artificial Sequence
  Synthetic
WLKFAEV

SEQ ID NO: 5484 - protein, 7 aa, Artificial Sequence
  Synthetic
SVKFKEV

SEQ ID NO: 5485 - protein, 7 aa, Artificial Sequence
  Synthetic
VMRFEQI

SEQ ID NO: 5486 - protein, 7 aa, Artificial Sequence
  Synthetic
WFKFPEV

SEQ ID NO: 5487 - protein, 7 aa, Artificial Sequence
  Synthetic
AHVGWVA

SEQ ID NO: 5488 - protein, 7 aa, Artificial Sequence
  Synthetic
TDTGWVA

SEQ ID NO: 5489 - protein, 7 aa, Artificial Sequence
  Synthetic
SEAVPFR

SEQ ID NO: 5490 - protein, 7 aa, Artificial Sequence
  Synthetic
QTNFRNV

SEQ ID NO: 5491 - protein, 7 aa, Artificial Sequence
  Synthetic
SHWYPQG

SEQ ID NO: 5492 - protein, 7 aa, Artificial Sequence
  Synthetic
LTGSRYV

SEQ ID NO: 5493 - protein, 7 aa, Artificial Sequence
  Synthetic
LPERPFR

SEQ ID NO: 5494 - protein, 7 aa, Artificial Sequence
  Synthetic
IGTLPFM

SEQ ID NO: 5495 - protein, 7 aa, Artificial Sequence
  Synthetic
FDANYPK

SEQ ID NO: 5496 - protein, 7 aa, Artificial Sequence
  Synthetic
VDQVYFR

SEQ ID NO: 5497 - protein, 7 aa, Artificial Sequence
  Synthetic
SRLGDLR

SEQ ID NO: 5498 - protein, 7 aa, Artificial Sequence
  Synthetic
QPMNLSR

SEQ ID NO: 5499 - protein, 7 aa, Artificial Sequence
  Synthetic
KGSEGLR

SEQ ID NO: 5500 - protein, 7 aa, Artificial Sequence
  Synthetic
TGQAPWI

SEQ ID NO: 5501 - protein, 7 aa, Artificial Sequence
  Synthetic
LGSIPFQ

SEQ ID NO: 5502 - protein, 7 aa, Artificial Sequence
  Synthetic
LDWPRSV

SEQ ID NO: 5503 - protein, 7 aa, Artificial Sequence
  Synthetic
SPKGRES

SEQ ID NO: 5504 - protein, 7 aa, Artificial Sequence
  Synthetic
TITGWAA

SEQ ID NO: 5505 - protein, 7 aa, Artificial Sequence
  Synthetic
KAQWANV

SEQ ID NO: 5506 - protein, 7 aa, Artificial Sequence
  Synthetic
YRIRLLD

SEQ ID NO: 5507 - protein, 7 aa, Artificial Sequence
  Synthetic
FTLTTSK

SEQ ID NO: 5508 - protein, 7 aa, Artificial Sequence
  Synthetic
RSHPDSK

SEQ ID NO: 5509 - protein, 7 aa, Artificial Sequence
  Synthetic
HGVRVAD

SEQ ID NO: 5510 - protein, 7 aa, Artificial Sequence
  Synthetic
VNRVLER

SEQ ID NO: 5511 - protein, 7 aa, Artificial Sequence
  Synthetic
FGVGLAI

SEQ ID NO: 5512 - protein, 7 aa, Artificial Sequence
  Synthetic
SRLGFSP

SEQ ID NO: 5513 - protein, 7 aa, Artificial Sequence
  Synthetic
TRAKSEG

SEQ ID NO: 5514 - protein, 7 aa, Artificial Sequence
  Synthetic
DKHRPFL

SEQ ID NO: 5515 - protein, 7 aa, Artificial Sequence
  Synthetic
KHSVLPH

SEQ ID NO: 5516 - protein, 7 aa, Artificial Sequence
  Synthetic
WGAARDL

SEQ ID NO: 5517 - protein, 7 aa, Artificial Sequence
  Synthetic
CGRDMRG

SEQ ID NO: 5518 - protein, 7 aa, Artificial Sequence
  Synthetic
HATNPFG

SEQ ID NO: 5519 - protein, 7 aa, Artificial Sequence
  Synthetic
EPVASMA

SEQ ID NO: 5520 - protein, 7 aa, Artificial Sequence
  Synthetic
PGSERVR

SEQ ID NO: 5521 - protein, 7 aa, Artificial Sequence
  Synthetic
DRSHGHW

SEQ ID NO: 5522 - protein, 7 aa, Artificial Sequence
  Synthetic
LVALATR

SEQ ID NO: 5523 - protein, 7 aa, Artificial Sequence
  Synthetic
GIKLFTH

SEQ ID NO: 5524 - protein, 7 aa, Artificial Sequence
  Synthetic
SGFVGTK

SEQ ID NO: 5525 - protein, 7 aa, Artificial Sequence
  Synthetic
SRIGHIN

SEQ ID NO: 5526 - protein, 7 aa, Artificial Sequence
  Synthetic
SGPKQLH

SEQ ID NO: 5527 - protein, 7 aa, Artificial Sequence
  Synthetic
KKWENHV

SEQ ID NO: 5528 - protein, 7 aa, Artificial Sequence
  Synthetic
NTMTMSR

SEQ ID NO: 5529 - protein, 7 aa, Artificial Sequence
  Synthetic
SFINVFA

SEQ ID NO: 5530 - protein, 7 aa, Artificial Sequence
  Synthetic
SEMRHHT

SEQ ID NO: 5531 - protein, 7 aa, Artificial Sequence
  Synthetic
LGMALGM

SEQ ID NO: 5532 - protein, 7 aa, Artificial Sequence
  Synthetic
LGERALR

SEQ ID NO: 5533 - protein, 7 aa, Artificial Sequence
  Synthetic
KSGAEAR

SEQ ID NO: 5534 - protein, 7 aa, Artificial Sequence
  Synthetic
TPWHVDG

SEQ ID NO: 5535 - protein, 7 aa, Artificial Sequence
  Synthetic
GRFVPPQ

SEQ ID NO: 5536 - protein, 7 aa, Artificial Sequence
  Synthetic
TNLAFNR

SEQ ID NO: 5537 - protein, 7 aa, Artificial Sequence
  Synthetic
MGHHSSW

SEQ ID NO: 5538 - protein, 7 aa, Artificial Sequence
  Synthetic
WFTVGRD

SEQ ID NO: 5539 - protein, 7 aa, Artificial Sequence
  Synthetic
ALGWPGS

SEQ ID NO: 5540 - protein, 7 aa, Artificial Sequence
  Synthetic
THRFHEI

SEQ ID NO: 5541 - protein, 7 aa, Artificial Sequence
  Synthetic
LQGFCTP

SEQ ID NO: 5542 - protein, 7 aa, Artificial Sequence
  Synthetic
KSEWAHF

SEQ ID NO: 5543 - protein, 7 aa, Artificial Sequence
  Synthetic
YNAVPFR

SEQ ID NO: 5544 - protein, 7 aa, Artificial Sequence
  Synthetic
KTWEPPS

SEQ ID NO: 5545 - protein, 7 aa, Artificial Sequence
  Synthetic
SLPQGWV

SEQ ID NO: 5546 - protein, 7 aa, Artificial Sequence
  Synthetic
HLQTAGR

SEQ ID NO: 5547 - protein, 7 aa, Artificial Sequence
  Synthetic
VWNNKLV

SEQ ID NO: 5548 - protein, 7 aa, Artificial Sequence
  Synthetic
STRFSAI

SEQ ID NO: 5549 - protein, 7 aa, Artificial Sequence
  Synthetic
WGAASDL

SEQ ID NO: 5550 - protein, 7 aa, Artificial Sequence
  Synthetic
GGNISFC

SEQ ID NO: 5551 - protein, 7 aa, Artificial Sequence
  Synthetic
FGGDKGR

SEQ ID NO: 5552 - protein, 7 aa, Artificial Sequence
  Synthetic
VRDFGSY

SEQ ID NO: 5553 - protein, 7 aa, Artificial Sequence
  Synthetic
GVFSRPM

SEQ ID NO: 5554 - protein, 7 aa, Artificial Sequence
  Synthetic
KGNGHER

SEQ ID NO: 5555 - protein, 7 aa, Artificial Sequence
  Synthetic
RVQKSDW

SEQ ID NO: 5556 - protein, 7 aa, Artificial Sequence
  Synthetic
KVKGEGQ

SEQ ID NO: 5557 - protein, 7 aa, Artificial Sequence
  Synthetic
VRGIPVT

SEQ ID NO: 5558 - protein, 7 aa, Artificial Sequence
  Synthetic
TLRGYVT

SEQ ID NO: 5559 - protein, 7 aa, Artificial Sequence
  Synthetic
CAARGTH

SEQ ID NO: 5560 - protein, 7 aa, Artificial Sequence
  Synthetic
ARNHQGQ

SEQ ID NO: 5561 - protein, 7 aa, Artificial Sequence
  Synthetic
QVRTADA

SEQ ID NO: 5562 - protein, 7 aa, Artificial Sequence
  Synthetic
IRSELVR

SEQ ID NO: 5563 - protein, 7 aa, Artificial Sequence
  Synthetic
HLEFARV

SEQ ID NO: 5564 - protein, 7 aa, Artificial Sequence
  Synthetic
HQTGWAP

SEQ ID NO: 5565 - protein, 7 aa, Artificial Sequence
  Synthetic
YLTRPFA

SEQ ID NO: 5566 - protein, 7 aa, Artificial Sequence
  Synthetic
LDVHVRV

SEQ ID NO: 5567 - protein, 7 aa, Artificial Sequence
  Synthetic
GFGTGRA

SEQ ID NO: 5568 - protein, 7 aa, Artificial Sequence
  Synthetic
LVQNLSR

SEQ ID NO: 5569 - protein, 7 aa, Artificial Sequence
  Synthetic
TVHGLGT

SEQ ID NO: 5570 - protein, 7 aa, Artificial Sequence
  Synthetic
SSSGISV

SEQ ID NO: 5571 - protein, 7 aa, Artificial Sequence
  Synthetic
THTGGNR

SEQ ID NO: 5572 - protein, 7 aa, Artificial Sequence
  Synthetic
GKLPPSQ

SEQ ID NO: 5573 - protein, 7 aa, Artificial Sequence
  Synthetic
NRGPSQV

SEQ ID NO: 5574 - protein, 7 aa, Artificial Sequence
  Synthetic
GSSGNLR

SEQ ID NO: 5575 - protein, 7 aa, Artificial Sequence
  Synthetic
NPWGIER

SEQ ID NO: 5576 - protein, 7 aa, Artificial Sequence
  Synthetic
VSFRTLH

SEQ ID NO: 5577 - protein, 7 aa, Artificial Sequence
  Synthetic
NHWYPQG

SEQ ID NO: 5578 - protein, 7 aa, Artificial Sequence
  Synthetic
LGVRIGM

SEQ ID NO: 5579 - protein, 7 aa, Artificial Sequence
  Synthetic
YGSMLWH

SEQ ID NO: 5580 - protein, 7 aa, Artificial Sequence
  Synthetic
PTVFGDM

SEQ ID NO: 5581 - protein, 7 aa, Artificial Sequence
  Synthetic
PLANPNK

SEQ ID NO: 5582 - protein, 7 aa, Artificial Sequence
  Synthetic
FGSEAWS

SEQ ID NO: 5583 - protein, 7 aa, Artificial Sequence
  Synthetic
TPAVPFR

SEQ ID NO: 5584 - protein, 7 aa, Artificial Sequence
  Synthetic
TNSQFLR

SEQ ID NO: 5585 - protein, 7 aa, Artificial Sequence
  Synthetic
RIGLDVR

SEQ ID NO: 5586 - protein, 7 aa, Artificial Sequence
  Synthetic
RNDNNGK

SEQ ID NO: 5587 - protein, 7 aa, Artificial Sequence
  Synthetic
GVSERRH

SEQ ID NO: 5588 - protein, 7 aa, Artificial Sequence
  Synthetic
WGPGWAS

SEQ ID NO: 5589 - protein, 7 aa, Artificial Sequence
  Synthetic
AGRGMTA

SEQ ID NO: 5590 - protein, 7 aa, Artificial Sequence
  Synthetic
RGDGPRQ

SEQ ID NO: 5591 - protein, 7 aa, Artificial Sequence
  Synthetic
FRSGTGN

SEQ ID NO: 5592 - protein, 7 aa, Artificial Sequence
  Synthetic
LSRMMPV

SEQ ID NO: 5593 - protein, 7 aa, Artificial Sequence
  Synthetic
SLHSQNR

SEQ ID NO: 5594 - protein, 7 aa, Artificial Sequence
  Synthetic
GASRPFQ

SEQ ID NO: 5595 - protein, 7 aa, Artificial Sequence
  Synthetic
VLGLAEL

SEQ ID NO: 5596 - protein, 7 aa, Artificial Sequence
  Synthetic
TRSRMEG

SEQ ID NO: 5597 - protein, 7 aa, Artificial Sequence
  Synthetic
MWEGGHR

SEQ ID NO: 5598 - protein, 7 aa, Artificial Sequence
  Synthetic
SDSGWVA

SEQ ID NO: 5599 - protein, 7 aa, Artificial Sequence
  Synthetic
RLNPHHA

SEQ ID NO: 5600 - protein, 7 aa, Artificial Sequence
  Synthetic
GSWVLTA

SEQ ID NO: 5601 - protein, 7 aa, Artificial Sequence
  Synthetic
NVWSTQG

SEQ ID NO: 5602 - protein, 7 aa, Artificial Sequence
  Synthetic
VRDFGLF

SEQ ID NO: 5603 - protein, 7 aa, Artificial Sequence
  Synthetic
GGLRDNR

SEQ ID NO: 5604 - protein, 7 aa, Artificial Sequence
  Synthetic
SRSGLDR

SEQ ID NO: 5605 - protein, 7 aa, Artificial Sequence
  Synthetic
WVTKHTG

SEQ ID NO: 5606 - protein, 7 aa, Artificial Sequence
  Synthetic
LGHMSGK

SEQ ID NO: 5607 - protein, 7 aa, Artificial Sequence
  Synthetic
SRQIHPP

SEQ ID NO: 5608 - protein, 7 aa, Artificial Sequence
  Synthetic
FGEARQM

SEQ ID NO: 5609 - protein, 7 aa, Artificial Sequence
  Synthetic
EGQIWAR

SEQ ID NO: 5610 - protein, 7 aa, Artificial Sequence
  Synthetic
LDRSGDK

SEQ ID NO: 5611 - protein, 7 aa, Artificial Sequence
  Synthetic
DVNKPWY

SEQ ID NO: 5612 - protein, 7 aa, Artificial Sequence
  Synthetic
LHGYFGP

SEQ ID NO: 5613 - protein, 7 aa, Artificial Sequence
  Synthetic
DLYWGKE

SEQ ID NO: 5614 - protein, 7 aa, Artificial Sequence
  Synthetic
WRGEGKL

SEQ ID NO: 5615 - protein, 7 aa, Artificial Sequence
  Synthetic
HRASGGA

SEQ ID NO: 5616 - protein, 7 aa, Artificial Sequence
  Synthetic
WGAASSF

SEQ ID NO: 5617 - protein, 7 aa, Artificial Sequence
  Synthetic
LKHASAN

SEQ ID NO: 5618 - protein, 7 aa, Artificial Sequence
  Synthetic
RAESSMR

SEQ ID NO: 5619 - protein, 7 aa, Artificial Sequence
  Synthetic
TTLSPPR

SEQ ID NO: 5620 - protein, 7 aa, Artificial Sequence
  Synthetic
PVIATKL

SEQ ID NO: 5621 - protein, 7 aa, Artificial Sequence
  Synthetic
EWRKGEW

SEQ ID NO: 5622 - protein, 7 aa, Artificial Sequence
  Synthetic
SHFGASH

SEQ ID NO: 5623 - protein, 7 aa, Artificial Sequence
  Synthetic
SAHSPFR

SEQ ID NO: 5624 - protein, 7 aa, Artificial Sequence
  Synthetic
GSLGWMA

SEQ ID NO: 5625 - protein, 7 aa, Artificial Sequence
  Synthetic
PMIANLI

SEQ ID NO: 5626 - protein, 7 aa, Artificial Sequence
  Synthetic
TTSFANV

SEQ ID NO: 5627 - protein, 7 aa, Artificial Sequence
  Synthetic
MSHSNRN

SEQ ID NO: 5628 - protein, 7 aa, Artificial Sequence
  Synthetic
VTATDFM

SEQ ID NO: 5629 - protein, 7 aa, Artificial Sequence
  Synthetic
SKSDKSW

SEQ ID NO: 5630 - protein, 7 aa, Artificial Sequence
  Synthetic
KGSEWTK

SEQ ID NO: 5631 - protein, 7 aa, Artificial Sequence
  Synthetic
HVRMADC

SEQ ID NO: 5632 - protein, 7 aa, Artificial Sequence
  Synthetic
KGGAWGQ

SEQ ID NO: 5633 - protein, 7 aa, Artificial Sequence
  Synthetic
TYATVSQ

SEQ ID NO: 5634 - protein, 7 aa, Artificial Sequence
  Synthetic
KCRDMVA

SEQ ID NO: 5635 - protein, 7 aa, Artificial Sequence
  Synthetic
DWFHADG

SEQ ID NO: 5636 - protein, 7 aa, Artificial Sequence
  Synthetic
HGLGTRP

SEQ ID NO: 5637 - protein, 7 aa, Artificial Sequence
  Synthetic
CFQSNRS

SEQ ID NO: 5638 - protein, 7 aa, Artificial Sequence
  Synthetic
RAGAHVT

SEQ ID NO: 5639 - protein, 7 aa, Artificial Sequence
  Synthetic
HAATNTR

SEQ ID NO: 5640 - protein, 7 aa, Artificial Sequence
  Synthetic
DGRHADR

SEQ ID NO: 5641 - protein, 7 aa, Artificial Sequence
  Synthetic
SSKVTQM

SEQ ID NO: 5642 - protein, 7 aa, Artificial Sequence
  Synthetic
DMERPFH

SEQ ID NO: 5643 - protein, 7 aa, Artificial Sequence
  Synthetic
CPSMSRG

SEQ ID NO: 5644 - protein, 7 aa, Artificial Sequence
  Synthetic
SGGARGF

SEQ ID NO: 5645 - protein, 7 aa, Artificial Sequence
  Synthetic
QGGPALR

SEQ ID NO: 5646 - protein, 7 aa, Artificial Sequence
  Synthetic
MRLREGP

SEQ ID NO: 5647 - protein, 7 aa, Artificial Sequence
  Synthetic
INARVLL

SEQ ID NO: 5648 - protein, 7 aa, Artificial Sequence
  Synthetic
RGTSYAM

SEQ ID NO: 5649 - protein, 7 aa, Artificial Sequence
  Synthetic
KPHSINS

SEQ ID NO: 5650 - protein, 7 aa, Artificial Sequence
  Synthetic
DFKEIRR

SEQ ID NO: 5651 - protein, 7 aa, Artificial Sequence
  Synthetic
GFDRLFV

SEQ ID NO: 5652 - protein, 7 aa, Artificial Sequence
  Synthetic
CIDGVGC

SEQ ID NO: 5653 - protein, 7 aa, Artificial Sequence
  Synthetic
YETRAFL

SEQ ID NO: 5654 - protein, 7 aa, Artificial Sequence
  Synthetic
RAGAVAW

SEQ ID NO: 5655 - protein, 7 aa, Artificial Sequence
  Synthetic
VGDLPFR

SEQ ID NO: 5656 - protein, 7 aa, Artificial Sequence
  Synthetic
RMHLLSA

SEQ ID NO: 5657 - protein, 7 aa, Artificial Sequence
  Synthetic
RLEVRAL

SEQ ID NO: 5658 - protein, 7 aa, Artificial Sequence
  Synthetic
GRASAGV

SEQ ID NO: 5659 - protein, 7 aa, Artificial Sequence
  Synthetic
TTLAVSR

SEQ ID NO: 5660 - protein, 7 aa, Artificial Sequence
  Synthetic
AHDPIRK

SEQ ID NO: 5661 - protein, 7 aa, Artificial Sequence
  Synthetic
MARVVER

SEQ ID NO: 5662 - protein, 7 aa, Artificial Sequence
  Synthetic
ALHFANI

SEQ ID NO: 5663 - protein, 7 aa, Artificial Sequence
  Synthetic
RSDNGLR

SEQ ID NO: 5664 - protein, 7 aa, Artificial Sequence
  Synthetic
VLRSENL

SEQ ID NO: 5665 - protein, 7 aa, Artificial Sequence
  Synthetic
TAGIVVD

SEQ ID NO: 5666 - protein, 7 aa, Artificial Sequence
  Synthetic
RGANERL

SEQ ID NO: 5667 - protein, 7 aa, Artificial Sequence
  Synthetic
RSNVLDR

SEQ ID NO: 5668 - protein, 7 aa, Artificial Sequence
  Synthetic
GAREAAR

SEQ ID NO: 5669 - protein, 7 aa, Artificial Sequence
  Synthetic
NDRPVAR

SEQ ID NO: 5670 - protein, 7 aa, Artificial Sequence
  Synthetic
MSAHFQV

SEQ ID NO: 5671 - protein, 7 aa, Artificial Sequence
  Synthetic
LTFERGT

SEQ ID NO: 5672 - protein, 7 aa, Artificial Sequence
  Synthetic
DWRGVHF

SEQ ID NO: 5673 - protein, 7 aa, Artificial Sequence
  Synthetic
ERKIPAM

SEQ ID NO: 5674 - protein, 7 aa, Artificial Sequence
  Synthetic
GRGISVA

SEQ ID NO: 5675 - protein, 7 aa, Artificial Sequence
  Synthetic
WVREPVR

SEQ ID NO: 5676 - protein, 7 aa, Artificial Sequence
  Synthetic
VKHIRME

SEQ ID NO: 5677 - protein, 7 aa, Artificial Sequence
  Synthetic
RPFGFAA

SEQ ID NO: 5678 - protein, 7 aa, Artificial Sequence
  Synthetic
SKVFMEV

SEQ ID NO: 5679 - protein, 7 aa, Artificial Sequence
  Synthetic
MPPFWSN

SEQ ID NO: 5680 - protein, 7 aa, Artificial Sequence
  Synthetic
WGGRGAG

SEQ ID NO: 5681 - protein, 7 aa, Artificial Sequence
  Synthetic
KLPMRVG

SEQ ID NO: 5682 - protein, 7 aa, Artificial Sequence
  Synthetic
SAWGTQS

SEQ ID NO: 5683 - protein, 7 aa, Artificial Sequence
  Synthetic
LNFSTSL

SEQ ID NO: 5684 - protein, 7 aa, Artificial Sequence
  Synthetic
RIPDTNR

SEQ ID NO: 5685 - protein, 7 aa, Artificial Sequence
  Synthetic
ITPLERW

SEQ ID NO: 5686 - protein, 7 aa, Artificial Sequence
  Synthetic
RADKVWN

SEQ ID NO: 5687 - protein, 7 aa, Artificial Sequence
  Synthetic
RPDHTVR

SEQ ID NO: 5688 - protein, 7 aa, Artificial Sequence
  Synthetic
MGMRENR

SEQ ID NO: 5689 - protein, 7 aa, Artificial Sequence
  Synthetic
RLGVDAK

SEQ ID NO: 5690 - protein, 7 aa, Artificial Sequence
  Synthetic
RWSAVGD

SEQ ID NO: 5691 - protein, 7 aa, Artificial Sequence
  Synthetic
KTNAGHH

SEQ ID NO: 5692 - protein, 7 aa, Artificial Sequence
  Synthetic
KGSLEAR

SEQ ID NO: 5693 - protein, 7 aa, Artificial Sequence
  Synthetic
RYNGGSA

SEQ ID NO: 5694 - protein, 7 aa, Artificial Sequence
  Synthetic
QRGDKLF

SEQ ID NO: 5695 - protein, 7 aa, Artificial Sequence
  Synthetic
NGRVESR

SEQ ID NO: 5696 - protein, 7 aa, Artificial Sequence
  Synthetic
CKGLGEV

SEQ ID NO: 5697 - protein, 7 aa, Artificial Sequence
  Synthetic
DPWHAGG

SEQ ID NO: 5698 - protein, 7 aa, Artificial Sequence
  Synthetic
LDNLPFR

SEQ ID NO: 5699 - protein, 7 aa, Artificial Sequence
  Synthetic
SFPGWSA

SEQ ID NO: 5700 - protein, 7 aa, Artificial Sequence
  Synthetic
RERVDLR

SEQ ID NO: 5701 - protein, 7 aa, Artificial Sequence
  Synthetic
MPRQSSG

SEQ ID NO: 5702 - protein, 7 aa, Artificial Sequence
  Synthetic
DVLRPFH

SEQ ID NO: 5703 - protein, 7 aa, Artificial Sequence
  Synthetic
GAIFGMW

SEQ ID NO: 5704 - protein, 7 aa, Artificial Sequence
  Synthetic
SPWGLAA

SEQ ID NO: 5705 - protein, 7 aa, Artificial Sequence
  Synthetic
FTNSEGR

SEQ ID NO: 5706 - protein, 7 aa, Artificial Sequence
  Synthetic
GARPADR

SEQ ID NO: 5707 - protein, 7 aa, Artificial Sequence
  Synthetic
IVAVTRA

SEQ ID NO: 5708 - protein, 7 aa, Artificial Sequence
  Synthetic
YKRLVGD

SEQ ID NO: 5709 - protein, 7 aa, Artificial Sequence
  Synthetic
HRVNAGN

SEQ ID NO: 5710 - protein, 7 aa, Artificial Sequence
  Synthetic
SISGWAP

SEQ ID NO: 5711 - protein, 7 aa, Artificial Sequence
  Synthetic
HPAREGR

SEQ ID NO: 5712 - protein, 7 aa, Artificial Sequence
  Synthetic
GAFGFSP

SEQ ID NO: 5713 - protein, 7 aa, Artificial Sequence
  Synthetic
AKSHGRE

SEQ ID NO: 5714 - protein, 7 aa, Artificial Sequence
  Synthetic
FTTFCKE

SEQ ID NO: 5715 - protein, 7 aa, Artificial Sequence
  Synthetic
GEWGFTP

SEQ ID NO: 5716 - protein, 7 aa, Artificial Sequence
  Synthetic
LHSKPER

SEQ ID NO: 5717 - protein, 7 aa, Artificial Sequence
  Synthetic
CWPSSTA

SEQ ID NO: 5718 - protein, 7 aa, Artificial Sequence
  Synthetic
VRGTVSA

SEQ ID NO: 5719 - protein, 7 aa, Artificial Sequence
  Synthetic
SNRGPGH

SEQ ID NO: 5720 - protein, 7 aa, Artificial Sequence
  Synthetic
TSKFANV

SEQ ID NO: 5721 - protein, 7 aa, Artificial Sequence
  Synthetic
YGDVIHR

SEQ ID NO: 5722 - protein, 7 aa, Artificial Sequence
  Synthetic
GSPALGT

SEQ ID NO: 5723 - protein, 7 aa, Artificial Sequence
  Synthetic
CYATDVL

SEQ ID NO: 5724 - protein, 7 aa, Artificial Sequence
  Synthetic
GVDRIFK

SEQ ID NO: 5725 - protein, 7 aa, Artificial Sequence
  Synthetic
GRLGVGS

SEQ ID NO: 5726 - protein, 7 aa, Artificial Sequence
  Synthetic
RKTEGSH

SEQ ID NO: 5727 - protein, 7 aa, Artificial Sequence
  Synthetic
SFSMGGL

SEQ ID NO: 5728 - protein, 7 aa, Artificial Sequence
  Synthetic
VRGTLHG

SEQ ID NO: 5729 - protein, 7 aa, Artificial Sequence
  Synthetic
ERNARFP

SEQ ID NO: 5730 - protein, 7 aa, Artificial Sequence
  Synthetic
DRRVVGA

SEQ ID NO: 5731 - protein, 7 aa, Artificial Sequence
  Synthetic
MRLASDR

SEQ ID NO: 5732 - protein, 7 aa, Artificial Sequence
  Synthetic
SRPDQYK

SEQ ID NO: 5733 - protein, 7 aa, Artificial Sequence
  Synthetic
TSNQWRD

SEQ ID NO: 5734 - protein, 7 aa, Artificial Sequence
  Synthetic
HIHGRIG

SEQ ID NO: 5735 - protein, 7 aa, Artificial Sequence
  Synthetic
RMAGPNH

SEQ ID NO: 5736 - protein, 7 aa, Artificial Sequence
  Synthetic
RGELVNR

SEQ ID NO: 5737 - protein, 7 aa, Artificial Sequence
  Synthetic
GRLHQGG

SEQ ID NO: 5738 - protein, 7 aa, Artificial Sequence
  Synthetic
MNLHVKL

SEQ ID NO: 5739 - protein, 7 aa, Artificial Sequence
  Synthetic
ARTQDIR

SEQ ID NO: 5740 - protein, 7 aa, Artificial Sequence
  Synthetic
GNAASLR

SEQ ID NO: 5741 - protein, 7 aa, Artificial Sequence
  Synthetic
RRDPLMD

SEQ ID NO: 5742 - protein, 7 aa, Artificial Sequence
  Synthetic
VMSLYAK

SEQ ID NO: 5743 - protein, 7 aa, Artificial Sequence
  Synthetic
AGHHMGH

SEQ ID NO: 5744 - protein, 7 aa, Artificial Sequence
  Synthetic
HRPAMTT

SEQ ID NO: 5745 - protein, 7 aa, Artificial Sequence
  Synthetic
VPMTQAM

SEQ ID NO: 5746 - protein, 7 aa, Artificial Sequence
  Synthetic
LSFKSIL

SEQ ID NO: 5747 - protein, 7 aa, Artificial Sequence
  Synthetic
LSGGGQR

SEQ ID NO: 5748 - protein, 7 aa, Artificial Sequence
  Synthetic
VPRMEAR

SEQ ID NO: 5749 - protein, 7 aa, Artificial Sequence
  Synthetic
HMMRNNI

SEQ ID NO: 5750 - protein, 7 aa, Artificial Sequence
  Synthetic
SVHAPFI

SEQ ID NO: 5751 - protein, 7 aa, Artificial Sequence
  Synthetic
YLDMKEL

SEQ ID NO: 5752 - protein, 7 aa, Artificial Sequence
  Synthetic
HDRGWVA

SEQ ID NO: 5753 - protein, 7 aa, Artificial Sequence
  Synthetic
CHLGLSK

SEQ ID NO: 5754 - protein, 7 aa, Artificial Sequence
  Synthetic
RSEDHRW

SEQ ID NO: 5755 - protein, 7 aa, Artificial Sequence
  Synthetic
ISLRSQY

SEQ ID NO: 5756 - protein, 7 aa, Artificial Sequence
  Synthetic
SDWTNRT

SEQ ID NO: 5757 - protein, 7 aa, Artificial Sequence
  Synthetic
RHSVEVG

SEQ ID NO: 5758 - protein, 7 aa, Artificial Sequence
  Synthetic
PPIARTL

SEQ ID NO: 5759 - protein, 7 aa, Artificial Sequence
  Synthetic
PDTFRLV

SEQ ID NO: 5760 - protein, 7 aa, Artificial Sequence
  Synthetic
SRVQPFL

SEQ ID NO: 5761 - protein, 7 aa, Artificial Sequence
  Synthetic
RAAEGLR

SEQ ID NO: 5762 - protein, 7 aa, Artificial Sequence
  Synthetic
VGKALGH

SEQ ID NO: 5763 - protein, 7 aa, Artificial Sequence
  Synthetic
GRGGEAN

SEQ ID NO: 5764 - protein, 7 aa, Artificial Sequence
  Synthetic
FTSSYPY

SEQ ID NO: 5765 - protein, 7 aa, Artificial Sequence
  Synthetic
TDDRFFK

SEQ ID NO: 5766 - protein, 7 aa, Artificial Sequence
  Synthetic
STDVQRG

SEQ ID NO: 5767 - protein, 7 aa, Artificial Sequence
  Synthetic
WGNLSLT

SEQ ID NO: 5768 - protein, 7 aa, Artificial Sequence
  Synthetic
MNQQNSR

SEQ ID NO: 5769 - protein, 7 aa, Artificial Sequence
  Synthetic
YTKSDSL

SEQ ID NO: 5770 - protein, 7 aa, Artificial Sequence
  Synthetic
GNGMWIS

SEQ ID NO: 5771 - protein, 7 aa, Artificial Sequence
  Synthetic
TQNPSLW

SEQ ID NO: 5772 - protein, 7 aa, Artificial Sequence
  Synthetic
GAFRSVP

SEQ ID NO: 5773 - protein, 7 aa, Artificial Sequence
  Synthetic
WRTLGSV

SEQ ID NO: 5774 - protein, 7 aa, Artificial Sequence
  Synthetic
LSVHNVM

SEQ ID NO: 5775 - protein, 7 aa, Artificial Sequence
  Synthetic
NNRAYQG

SEQ ID NO: 5776 - protein, 7 aa, Artificial Sequence
  Synthetic
HGVRMTA

SEQ ID NO: 5777 - protein, 7 aa, Artificial Sequence
  Synthetic
FSLQGSR

SEQ ID NO: 5778 - protein, 7 aa, Artificial Sequence
  Synthetic
TKWVGKE

SEQ ID NO: 5779 - protein, 7 aa, Artificial Sequence
  Synthetic
GVAMISM

SEQ ID NO: 5780 - protein, 7 aa, Artificial Sequence
  Synthetic
WAEFHRV

SEQ ID NO: 5781 - protein, 7 aa, Artificial Sequence
  Synthetic
GEKHDRF

SEQ ID NO: 5782 - protein, 7 aa, Artificial Sequence
  Synthetic
HGPQGRI

SEQ ID NO: 5783 - protein, 7 aa, Artificial Sequence
  Synthetic
RWGDDGR

SEQ ID NO: 5784 - protein, 7 aa, Artificial Sequence
  Synthetic
QHGHVRD

SEQ ID NO: 5785 - protein, 7 aa, Artificial Sequence
  Synthetic
RAEVVRH

SEQ ID NO: 5786 - protein, 7 aa, Artificial Sequence
  Synthetic
KNHPLRE

SEQ ID NO: 5787 - protein, 7 aa, Artificial Sequence
  Synthetic
PNREVMR

SEQ ID NO: 5788 - protein, 7 aa, Artificial Sequence
  Synthetic
RNDTSTR

SEQ ID NO: 5789 - protein, 7 aa, Artificial Sequence
  Synthetic
MVAREGR

SEQ ID NO: 5790 - protein, 7 aa, Artificial Sequence
  Synthetic
LAKWHDA

SEQ ID NO: 5791 - protein, 7 aa, Artificial Sequence
  Synthetic
WIEKPFI

SEQ ID NO: 5792 - protein, 7 aa, Artificial Sequence
  Synthetic
SHAGSGV

SEQ ID NO: 5793 - protein, 7 aa, Artificial Sequence
  Synthetic
FGGRHAT

SEQ ID NO: 5794 - protein, 7 aa, Artificial Sequence
  Synthetic
PHHASTH

SEQ ID NO: 5795 - protein, 7 aa, Artificial Sequence
  Synthetic
WRVNEFE

SEQ ID NO: 5796 - protein, 7 aa, Artificial Sequence
  Synthetic
RWEHGGQ

SEQ ID NO: 5797 - protein, 7 aa, Artificial Sequence
  Synthetic
VRAAFGV

SEQ ID NO: 5798 - protein, 7 aa, Artificial Sequence
  Synthetic
GMRRESQ

SEQ ID NO: 5799 - protein, 7 aa, Artificial Sequence
  Synthetic
AWGNAQH

SEQ ID NO: 5800 - protein, 7 aa, Artificial Sequence
  Synthetic
MRHSIAS

SEQ ID NO: 5801 - protein, 7 aa, Artificial Sequence
  Synthetic
MRGHLGP

SEQ ID NO: 5802 - protein, 7 aa, Artificial Sequence
  Synthetic
ARDVRPH

SEQ ID NO: 5803 - protein, 7 aa, Artificial Sequence
  Synthetic
SDLGWHP

SEQ ID NO: 5804 - protein, 7 aa, Artificial Sequence
  Synthetic
REVHVGA

SEQ ID NO: 5805 - protein, 7 aa, Artificial Sequence
  Synthetic
WTAHDPK

SEQ ID NO: 5806 - protein, 7 aa, Artificial Sequence
  Synthetic
HSRTHDL

SEQ ID NO: 5807 - protein, 7 aa, Artificial Sequence
  Synthetic
WMKVTHV

SEQ ID NO: 5808 - protein, 7 aa, Artificial Sequence
  Synthetic
SKDQPFR

SEQ ID NO: 5809 - protein, 7 aa, Artificial Sequence
  Synthetic
TAWRSDG

SEQ ID NO: 5810 - protein, 7 aa, Artificial Sequence
  Synthetic
HPNVLAR

SEQ ID NO: 5811 - protein, 7 aa, Artificial Sequence
  Synthetic
STHGWAA

SEQ ID NO: 5812 - protein, 7 aa, Artificial Sequence
  Synthetic
VKAFEQR

SEQ ID NO: 5813 - protein, 7 aa, Artificial Sequence
  Synthetic
AGRALGL

SEQ ID NO: 5814 - protein, 7 aa, Artificial Sequence
  Synthetic
RMMNSTF

SEQ ID NO: 5815 - protein, 7 aa, Artificial Sequence
  Synthetic
DRDRGLR

SEQ ID NO: 5816 - protein, 7 aa, Artificial Sequence
  Synthetic
LGQKEGR

SEQ ID NO: 5817 - protein, 7 aa, Artificial Sequence
  Synthetic
SDHMSKR

SEQ ID NO: 5818 - protein, 7 aa, Artificial Sequence
  Synthetic
YDANARR

SEQ ID NO: 5819 - protein, 7 aa, Artificial Sequence
  Synthetic
TQAHMMG

SEQ ID NO: 5820 - protein, 7 aa, Artificial Sequence
  Synthetic
LNGYGSR

SEQ ID NO: 5821 - protein, 7 aa, Artificial Sequence
  Synthetic
VPRVNHT

SEQ ID NO: 5822 - protein, 7 aa, Artificial Sequence
  Synthetic
HRQGSLL

SEQ ID NO: 5823 - protein, 7 aa, Artificial Sequence
  Synthetic
HVRQVAL

SEQ ID NO: 5824 - protein, 7 aa, Artificial Sequence
  Synthetic
HLGGRGS

SEQ ID NO: 5825 - protein, 7 aa, Artificial Sequence
  Synthetic
LGKPHSQ

SEQ ID NO: 5826 - protein, 7 aa, Artificial Sequence
  Synthetic
RVDSQRI

SEQ ID NO: 5827 - protein, 7 aa, Artificial Sequence
  Synthetic
SNKSHQH

SEQ ID NO: 5828 - protein, 7 aa, Artificial Sequence
  Synthetic
ERGGRHD

SEQ ID NO: 5829 - protein, 7 aa, Artificial Sequence
  Synthetic
RTVLLER

SEQ ID NO: 5830 - protein, 7 aa, Artificial Sequence
  Synthetic
DPMWNRA

SEQ ID NO: 5831 - protein, 7 aa, Artificial Sequence
  Synthetic
PIMFSEV

SEQ ID NO: 5832 - protein, 7 aa, Artificial Sequence
  Synthetic
ARLHVID

SEQ ID NO: 5833 - protein, 7 aa, Artificial Sequence
  Synthetic
RLARPEM

SEQ ID NO: 5834 - protein, 7 aa, Artificial Sequence
  Synthetic
SLSSFKQ

SEQ ID NO: 5835 - protein, 7 aa, Artificial Sequence
  Synthetic
SRDGSRN

SEQ ID NO: 5836 - protein, 7 aa, Artificial Sequence
  Synthetic
NRADLAR

SEQ ID NO: 5837 - protein, 7 aa, Artificial Sequence
  Synthetic
PEVRNCV

SEQ ID NO: 5838 - protein, 7 aa, Artificial Sequence
  Synthetic
SMRATPF

SEQ ID NO: 5839 - protein, 7 aa, Artificial Sequence
  Synthetic
LVGALAM

SEQ ID NO: 5840 - protein, 7 aa, Artificial Sequence
  Synthetic
RTTDVVM

SEQ ID NO: 5841 - protein, 7 aa, Artificial Sequence
  Synthetic
SLVAPFK

SEQ ID NO: 5842 - protein, 7 aa, Artificial Sequence
  Synthetic
LSGHMIL

SEQ ID NO: 5843 - protein, 7 aa, Artificial Sequence
  Synthetic
GAREKMV

SEQ ID NO: 5844 - protein, 7 aa, Artificial Sequence
  Synthetic
PRFSPQA

SEQ ID NO: 5845 - protein, 7 aa, Artificial Sequence
  Synthetic
DADLGAW

SEQ ID NO: 5846 - protein, 7 aa, Artificial Sequence
  Synthetic
STRPLDH

SEQ ID NO: 5847 - protein, 7 aa, Artificial Sequence
  Synthetic
SRIAQHE

SEQ ID NO: 5848 - protein, 7 aa, Artificial Sequence
  Synthetic
ILAGSRN

SEQ ID NO: 5849 - protein, 7 aa, Artificial Sequence
  Synthetic
EPKMLLV

SEQ ID NO: 5850 - protein, 7 aa, Artificial Sequence
  Synthetic
LGLVIQS

SEQ ID NO: 5851 - protein, 7 aa, Artificial Sequence
  Synthetic
PNNLQHR

SEQ ID NO: 5852 - protein, 7 aa, Artificial Sequence
  Synthetic
GNAGTAK

SEQ ID NO: 5853 - protein, 7 aa, Artificial Sequence
  Synthetic
RGAHPPL

SEQ ID NO: 5854 - protein, 7 aa, Artificial Sequence
  Synthetic
TGPEGRK

SEQ ID NO: 5855 - protein, 7 aa, Artificial Sequence
  Synthetic
RGERLNS

SEQ ID NO: 5856 - protein, 7 aa, Artificial Sequence
  Synthetic
KPWNELT

SEQ ID NO: 5857 - protein, 7 aa, Artificial Sequence
  Synthetic
SGGIVSG

SEQ ID NO: 5858 - protein, 7 aa, Artificial Sequence
  Synthetic
GRVIGRE

SEQ ID NO: 5859 - protein, 7 aa, Artificial Sequence
  Synthetic
ARLERHL

SEQ ID NO: 5860 - protein, 7 aa, Artificial Sequence
  Synthetic
LNALHTR

SEQ ID NO: 5861 - protein, 7 aa, Artificial Sequence
  Synthetic
RTMDAFR

SEQ ID NO: 5862 - protein, 7 aa, Artificial Sequence
  Synthetic
SHIGFSA

SEQ ID NO: 5863 - protein, 7 aa, Artificial Sequence
  Synthetic
DGLSRVL

SEQ ID NO: 5864 - protein, 7 aa, Artificial Sequence
  Synthetic
RTSELHR

SEQ ID NO: 5865 - protein, 7 aa, Artificial Sequence
  Synthetic
NTRVIDR

SEQ ID NO: 5866 - protein, 7 aa, Artificial Sequence
  Synthetic
VSTRERL

SEQ ID NO: 5867 - protein, 7 aa, Artificial Sequence
  Synthetic
GIVVRLH

SEQ ID NO: 5868 - protein, 7 aa, Artificial Sequence
  Synthetic
RSSLFVG

SEQ ID NO: 5869 - protein, 7 aa, Artificial Sequence
  Synthetic
RPGGGTY

SEQ ID NO: 5870 - protein, 7 aa, Artificial Sequence
  Synthetic
FNSQTGK

SEQ ID NO: 5871 - protein, 7 aa, Artificial Sequence
  Synthetic
KRSGYDA

SEQ ID NO: 5872 - protein, 7 aa, Artificial Sequence
  Synthetic
RGEKPGW

SEQ ID NO: 5873 - protein, 7 aa, Artificial Sequence
  Synthetic
NGSRQVH

SEQ ID NO: 5874 - protein, 7 aa, Artificial Sequence
  Synthetic
SAWSMEH

SEQ ID NO: 5875 - protein, 7 aa, Artificial Sequence
  Synthetic
SAARSLF

SEQ ID NO: 5876 - protein, 7 aa, Artificial Sequence
  Synthetic
KNVHNLA

SEQ ID NO: 5877 - protein, 7 aa, Artificial Sequence
  Synthetic
GATVKNW

SEQ ID NO: 5878 - protein, 7 aa, Artificial Sequence
  Synthetic
GFPQRNT

SEQ ID NO: 5879 - protein, 7 aa, Artificial Sequence
  Synthetic
LLRSEAR

SEQ ID NO: 5880 - protein, 7 aa, Artificial Sequence
  Synthetic
VLRNPLM

SEQ ID NO: 5881 - protein, 7 aa, Artificial Sequence
  Synthetic
MHNNLRN

SEQ ID NO: 5882 - protein, 7 aa, Artificial Sequence
  Synthetic
RLAEQRI

SEQ ID NO: 5883 - protein, 7 aa, Artificial Sequence
  Synthetic
LKHGIVN

SEQ ID NO: 5884 - protein, 7 aa, Artificial Sequence
  Synthetic
LRDRAHG

SEQ ID NO: 5885 - protein, 7 aa, Artificial Sequence
  Synthetic
NGLPRSI

SEQ ID NO: 5886 - protein, 7 aa, Artificial Sequence
  Synthetic
RPNRPQD

SEQ ID NO: 5887 - protein, 7 aa, Artificial Sequence
  Synthetic
PLVPERR

SEQ ID NO: 5888 - protein, 7 aa, Artificial Sequence
  Synthetic
KLGSGVW

SEQ ID NO: 5889 - protein, 7 aa, Artificial Sequence
  Synthetic
RSVRLES

SEQ ID NO: 5890 - protein, 7 aa, Artificial Sequence
  Synthetic
TKTIQLY

SEQ ID NO: 5891 - protein, 7 aa, Artificial Sequence
  Synthetic
MHFESPR

SEQ ID NO: 5892 - protein, 7 aa, Artificial Sequence
  Synthetic
THKSSTL

SEQ ID NO: 5893 - protein, 7 aa, Artificial Sequence
  Synthetic
LGAGLLR

SEQ ID NO: 5894 - protein, 7 aa, Artificial Sequence
  Synthetic
TTQSIRF

SEQ ID NO: 5895 - protein, 7 aa, Artificial Sequence
  Synthetic
GRAPINH

SEQ ID NO: 5896 - protein, 7 aa, Artificial Sequence
  Synthetic
LGLGWSP

SEQ ID NO: 5897 - protein, 7 aa, Artificial Sequence
  Synthetic
SPFGSKH

SEQ ID NO: 5898 - protein, 7 aa, Artificial Sequence
  Synthetic
FNTPRAV

SEQ ID NO: 5899 - protein, 7 aa, Artificial Sequence
  Synthetic
RHSAMGM

SEQ ID NO: 5900 - protein, 7 aa, Artificial Sequence
  Synthetic
RERMEKS

SEQ ID NO: 5901 - protein, 7 aa, Artificial Sequence
  Synthetic
MGGAVGR

SEQ ID NO: 5902 - protein, 7 aa, Artificial Sequence
  Synthetic
SLHVSGR

SEQ ID NO: 5903 - protein, 7 aa, Artificial Sequence
  Synthetic
TMESPWL

SEQ ID NO: 5904 - protein, 7 aa, Artificial Sequence
  Synthetic
WGTAIGK

SEQ ID NO: 5905 - protein, 7 aa, Artificial Sequence
  Synthetic
GRTSFQS

SEQ ID NO: 5906 - protein, 7 aa, Artificial Sequence
  Synthetic
RLESSKA

SEQ ID NO: 5907 - protein, 7 aa, Artificial Sequence
  Synthetic
AGGRVAM

SEQ ID NO: 5908 - protein, 7 aa, Artificial Sequence
  Synthetic
MGEYRAR

SEQ ID NO: 5909 - protein, 7 aa, Artificial Sequence
  Synthetic
SALRVER

SEQ ID NO: 5910 - protein, 7 aa, Artificial Sequence
  Synthetic
DGGRVGV

SEQ ID NO: 5911 - protein, 7 aa, Artificial Sequence
  Synthetic
DRFNHMH

SEQ ID NO: 5912 - protein, 7 aa, Artificial Sequence
  Synthetic
SLEAARR

SEQ ID NO: 5913 - protein, 7 aa, Artificial Sequence
  Synthetic
ARHQEKS

SEQ ID NO: 5914 - protein, 7 aa, Artificial Sequence
  Synthetic
ALVKPMH

SEQ ID NO: 5915 - protein, 7 aa, Artificial Sequence
  Synthetic
SRAKPEH

SEQ ID NO: 5916 - protein, 7 aa, Artificial Sequence
  Synthetic
AVWGGGP

SEQ ID NO: 5917 - protein, 7 aa, Artificial Sequence
  Synthetic
GTYPYVN

SEQ ID NO: 5918 - protein, 7 aa, Artificial Sequence
  Synthetic
DAKRPGL

SEQ ID NO: 5919 - protein, 7 aa, Artificial Sequence
  Synthetic
FDVRRPF

SEQ ID NO: 5920 - protein, 7 aa, Artificial Sequence
  Synthetic
NRGLPHG

SEQ ID NO: 5921 - protein, 7 aa, Artificial Sequence
  Synthetic
RRENGPL

SEQ ID NO: 5922 - protein, 7 aa, Artificial Sequence
  Synthetic
MVANPFR

SEQ ID NO: 5923 - protein, 7 aa, Artificial Sequence
  Synthetic
GARAELR

SEQ ID NO: 5924 - protein, 7 aa, Artificial Sequence
  Synthetic
HAPRHVQ

SEQ ID NO: 5925 - protein, 7 aa, Artificial Sequence
  Synthetic
RHQAQMT

SEQ ID NO: 5926 - protein, 7 aa, Artificial Sequence
  Synthetic
LSQVIGK

SEQ ID NO: 5927 - protein, 7 aa, Artificial Sequence
  Synthetic
LLGPERR

SEQ ID NO: 5928 - protein, 7 aa, Artificial Sequence
  Synthetic
HGMRVNA

SEQ ID NO: 5929 - protein, 7 aa, Artificial Sequence
  Synthetic
KGMSHQN

SEQ ID NO: 5930 - protein, 7 aa, Artificial Sequence
  Synthetic
RFHGRDD

SEQ ID NO: 5931 - protein, 7 aa, Artificial Sequence
  Synthetic
LRGAPHM

SEQ ID NO: 5932 - protein, 7 aa, Artificial Sequence
  Synthetic
EHWGAAR

SEQ ID NO: 5933 - protein, 7 aa, Artificial Sequence
  Synthetic
QKLHLGG

SEQ ID NO: 5934 - protein, 7 aa, Artificial Sequence
  Synthetic
ILGVYAV

SEQ ID NO: 5935 - protein, 7 aa, Artificial Sequence
  Synthetic
EGNAHNR

SEQ ID NO: 5936 - protein, 7 aa, Artificial Sequence
  Synthetic
VHLRSTS

SEQ ID NO: 5937 - protein, 7 aa, Artificial Sequence
  Synthetic
NRFVDAG

SEQ ID NO: 5938 - protein, 7 aa, Artificial Sequence
  Synthetic
AVLRNGT

SEQ ID NO: 5939 - protein, 7 aa, Artificial Sequence
  Synthetic
RLSSHQL

SEQ ID NO: 5940 - protein, 7 aa, Artificial Sequence
  Synthetic
AGGSARC

SEQ ID NO: 5941 - protein, 7 aa, Artificial Sequence
  Synthetic
GEQARHT

SEQ ID NO: 5942 - protein, 7 aa, Artificial Sequence
  Synthetic
RTANEMR

SEQ ID NO: 5943 - protein, 7 aa, Artificial Sequence
  Synthetic
RGPSNGY

SEQ ID NO: 5944 - protein, 7 aa, Artificial Sequence
  Synthetic
PGRWNGE

SEQ ID NO: 5945 - protein, 7 aa, Artificial Sequence
  Synthetic
HLGMKSH

SEQ ID NO: 5946 - protein, 7 aa, Artificial Sequence
  Synthetic
IVGPFKG

SEQ ID NO: 5947 - protein, 7 aa, Artificial Sequence
  Synthetic
ANHVREK

SEQ ID NO: 5948 - protein, 7 aa, Artificial Sequence
  Synthetic
ELVRRER

SEQ ID NO: 5949 - protein, 7 aa, Artificial Sequence
  Synthetic
NKEHSIR

SEQ ID NO: 5950 - protein, 7 aa, Artificial Sequence
  Synthetic
GTARGSF

SEQ ID NO: 5951 - protein, 7 aa, Artificial Sequence
  Synthetic
RIALDGR

SEQ ID NO: 5952 - protein, 7 aa, Artificial Sequence
  Synthetic
RNGKNWE

SEQ ID NO: 5953 - protein, 7 aa, Artificial Sequence
  Synthetic
TGKLGGC

SEQ ID NO: 5954 - protein, 7 aa, Artificial Sequence
  Synthetic
AVNTSRN

SEQ ID NO: 5955 - protein, 7 aa, Artificial Sequence
  Synthetic
HHGTHER

SEQ ID NO: 5956 - protein, 7 aa, Artificial Sequence
  Synthetic
VGRFTIA

SEQ ID NO: 5957 - protein, 7 aa, Artificial Sequence
  Synthetic
RGMEFNR

SEQ ID NO: 5958 - protein, 7 aa, Artificial Sequence
  Synthetic
HVADWLK

SEQ ID NO: 5959 - protein, 7 aa, Artificial Sequence
  Synthetic
RHGPVGM

SEQ ID NO: 5960 - protein, 7 aa, Artificial Sequence
  Synthetic
IGRRQDD

SEQ ID NO: 5961 - protein, 7 aa, Artificial Sequence
  Synthetic
GDWMIAS

SEQ ID NO: 5962 - protein, 7 aa, Artificial Sequence
  Synthetic
SAWGAER

SEQ ID NO: 5963 - protein, 7 aa, Artificial Sequence
  Synthetic
SLKAPFH

SEQ ID NO: 5964 - protein, 7 aa, Artificial Sequence
  Synthetic
DARWPGS

SEQ ID NO: 5965 - protein, 7 aa, Artificial Sequence
  Synthetic
EGRSHLS

SEQ ID NO: 5966 - protein, 7 aa, Artificial Sequence
  Synthetic
EVVAARL

SEQ ID NO: 5967 - protein, 7 aa, Artificial Sequence
  Synthetic
GDRSKVW

SEQ ID NO: 5968 - protein, 7 aa, Artificial Sequence
  Synthetic
NRVREPP

SEQ ID NO: 5969 - protein, 7 aa, Artificial Sequence
  Synthetic
MGKATPW

SEQ ID NO: 5970 - protein, 7 aa, Artificial Sequence
  Synthetic
RAGHLSH

SEQ ID NO: 5971 - protein, 7 aa, Artificial Sequence
  Synthetic
RSTVTPT

SEQ ID NO: 5972 - protein, 7 aa, Artificial Sequence
  Synthetic
VLLDGCK

SEQ ID NO: 5973 - protein, 7 aa, Artificial Sequence
  Synthetic
EGRWRES

SEQ ID NO: 5974 - protein, 7 aa, Artificial Sequence
  Synthetic
VFAQGAR

SEQ ID NO: 5975 - protein, 7 aa, Artificial Sequence
  Synthetic
NLQKPFI

SEQ ID NO: 5976 - protein, 7 aa, Artificial Sequence
  Synthetic
TPWQTNG

SEQ ID NO: 5977 - protein, 7 aa, Artificial Sequence
  Synthetic
IARVPGH

SEQ ID NO: 5978 - protein, 7 aa, Artificial Sequence
  Synthetic
TALIGGF

SEQ ID NO: 5979 - protein, 7 aa, Artificial Sequence
  Synthetic
SPGGWPP

SEQ ID NO: 5980 - protein, 7 aa, Artificial Sequence
  Synthetic
SKTPDWC

SEQ ID NO: 5981 - protein, 7 aa, Artificial Sequence
  Synthetic
HNGSFPR

SEQ ID NO: 5982 - protein, 7 aa, Artificial Sequence
  Synthetic
TPWSERG

SEQ ID NO: 5983 - protein, 7 aa, Artificial Sequence
  Synthetic
RPNYGVL

SEQ ID NO: 5984 - protein, 7 aa, Artificial Sequence
  Synthetic
RAMSDNR

SEQ ID NO: 5985 - protein, 7 aa, Artificial Sequence
  Synthetic
IWVAGAA

SEQ ID NO: 5986 - protein, 7 aa, Artificial Sequence
  Synthetic
MGRIITH

SEQ ID NO: 5987 - protein, 7 aa, Artificial Sequence
  Synthetic
SGPSHIR

SEQ ID NO: 5988 - protein, 7 aa, Artificial Sequence
  Synthetic
VATVHGR

SEQ ID NO: 5989 - protein, 7 aa, Artificial Sequence
  Synthetic
TRENRVL

SEQ ID NO: 5990 - protein, 7 aa, Artificial Sequence
  Synthetic
SLNTHGK

SEQ ID NO: 5991 - protein, 7 aa, Artificial Sequence
  Synthetic
ERTIPSR

SEQ ID NO: 5992 - protein, 7 aa, Artificial Sequence
  Synthetic
ILVLGAS

SEQ ID NO: 5993 - protein, 7 aa, Artificial Sequence
  Synthetic
GSARTRE

SEQ ID NO: 5994 - protein, 7 aa, Artificial Sequence
  Synthetic
GGRTLHA

SEQ ID NO: 5995 - protein, 7 aa, Artificial Sequence
  Synthetic
RAHTPNS

SEQ ID NO: 5996 - protein, 7 aa, Artificial Sequence
  Synthetic
RGSPHIA

SEQ ID NO: 5997 - protein, 7 aa, Artificial Sequence
  Synthetic
DMHRGVN

SEQ ID NO: 5998 - protein, 7 aa, Artificial Sequence
  Synthetic
IPRGVNH

SEQ ID NO: 5999 - protein, 7 aa, Artificial Sequence
  Synthetic
EITNSVR

SEQ ID NO: 6000 - protein, 7 aa, Artificial Sequence
  Synthetic
DRMGAGR

SEQ ID NO: 6001 - protein, 7 aa, Artificial Sequence
  Synthetic
RINIQRD

SEQ ID NO: 6002 - protein, 7 aa, Artificial Sequence
  Synthetic
VPNMAHR

SEQ ID NO: 6003 - protein, 7 aa, Artificial Sequence
  Synthetic
KPHGSGT

SEQ ID NO: 6004 - protein, 7 aa, Artificial Sequence
  Synthetic
RIAVGYP

SEQ ID NO: 6005 - protein, 7 aa, Artificial Sequence
  Synthetic
LRPLTSN

SEQ ID NO: 6006 - protein, 7 aa, Artificial Sequence
  Synthetic
GKAMDTR

SEQ ID NO: 6007 - protein, 7 aa, Artificial Sequence
  Synthetic
VHRHEYA

SEQ ID NO: 6008 - protein, 7 aa, Artificial Sequence
  Synthetic
RGPNKVD

SEQ ID NO: 6009 - protein, 7 aa, Artificial Sequence
  Synthetic
NDWTVNA

SEQ ID NO: 6010 - protein, 7 aa, Artificial Sequence
  Synthetic
KSINPYA

SEQ ID NO: 6011 - protein, 7 aa, Artificial Sequence
  Synthetic
GDRPVLR

SEQ ID NO: 6012 - protein, 7 aa, Artificial Sequence
  Synthetic
GGPLNPR

SEQ ID NO: 6013 - protein, 7 aa, Artificial Sequence
  Synthetic
VHRIVNQ

SEQ ID NO: 6014 - protein, 7 aa, Artificial Sequence
  Synthetic
YHGWASA

SEQ ID NO: 6015 - protein, 7 aa, Artificial Sequence
  Synthetic
LWAPTNA

SEQ ID NO: 6016 - protein, 7 aa, Artificial Sequence
  Synthetic
KHGAEVK

SEQ ID NO: 6017 - protein, 7 aa, Artificial Sequence
  Synthetic
RRVENDW

SEQ ID NO: 6018 - protein, 7 aa, Artificial Sequence
  Synthetic
MGGQGAR

SEQ ID NO: 6019 - protein, 7 aa, Artificial Sequence
  Synthetic
RSSEREK

SEQ ID NO: 6020 - protein, 7 aa, Artificial Sequence
  Synthetic
RREAAYL

SEQ ID NO: 6021 - protein, 7 aa, Artificial Sequence
  Synthetic
LSSGLGV

SEQ ID NO: 6022 - protein, 7 aa, Artificial Sequence
  Synthetic
GGELRPK

SEQ ID NO: 6023 - protein, 7 aa, Artificial Sequence
  Synthetic
TKGVEGR

SEQ ID NO: 6024 - protein, 7 aa, Artificial Sequence
  Synthetic
WGHTFER

SEQ ID NO: 6025 - protein, 7 aa, Artificial Sequence
  Synthetic
GGFSLVS

SEQ ID NO: 6026 - protein, 7 aa, Artificial Sequence
  Synthetic
LRGNPNY

SEQ ID NO: 6027 - protein, 7 aa, Artificial Sequence
  Synthetic
WGNSLAR

SEQ ID NO: 6028 - protein, 7 aa, Artificial Sequence
  Synthetic
VMTGPPR

SEQ ID NO: 6029 - protein, 7 aa, Artificial Sequence
  Synthetic
MLSFREV

SEQ ID NO: 6030 - protein, 7 aa, Artificial Sequence
  Synthetic
GPLNLFQ

SEQ ID NO: 6031 - protein, 7 aa, Artificial Sequence
  Synthetic
GQTNKNW

SEQ ID NO: 6032 - protein, 7 aa, Artificial Sequence
  Synthetic
HGQERTW

SEQ ID NO: 6033 - protein, 7 aa, Artificial Sequence
  Synthetic
HHNRNGA

SEQ ID NO: 6034 - protein, 7 aa, Artificial Sequence
  Synthetic
VRFTNLV

SEQ ID NO: 6035 - protein, 7 aa, Artificial Sequence
  Synthetic
LRDAALR

SEQ ID NO: 6036 - protein, 7 aa, Artificial Sequence
  Synthetic
RTAGPTH

SEQ ID NO: 6037 - protein, 7 aa, Artificial Sequence
  Synthetic
GPGPDSE

SEQ ID NO: 6038 - protein, 7 aa, Artificial Sequence
  Synthetic
KHTLSTH

SEQ ID NO: 6039 - protein, 7 aa, Artificial Sequence
  Synthetic
GSGYWPA

SEQ ID NO: 6040 - protein, 7 aa, Artificial Sequence
  Synthetic
QGTGPHR

SEQ ID NO: 6041 - protein, 7 aa, Artificial Sequence
  Synthetic
GRSVTLT

SEQ ID NO: 6042 - protein, 7 aa, Artificial Sequence
  Synthetic
TELGWVP

SEQ ID NO: 6043 - protein, 7 aa, Artificial Sequence
  Synthetic
YDHMIFN

SEQ ID NO: 6044 - protein, 7 aa, Artificial Sequence
  Synthetic
EEFRPGR

SEQ ID NO: 6045 - protein, 7 aa, Artificial Sequence
  Synthetic
RHAAMPY

SEQ ID NO: 6046 - protein, 7 aa, Artificial Sequence
  Synthetic
NHNRYSD

SEQ ID NO: 6047 - protein, 7 aa, Artificial Sequence
  Synthetic
RLGSGAH

SEQ ID NO: 6048 - protein, 7 aa, Artificial Sequence
  Synthetic
VRRDGSF

SEQ ID NO: 6049 - protein, 7 aa, Artificial Sequence
  Synthetic
ADRGSVR

SEQ ID NO: 6050 - protein, 7 aa, Artificial Sequence
  Synthetic
HQRSLSS

SEQ ID NO: 6051 - protein, 7 aa, Artificial Sequence
  Synthetic
GRDRLLA

SEQ ID NO: 6052 - protein, 7 aa, Artificial Sequence
  Synthetic
MKGFERV

SEQ ID NO: 6053 - protein, 7 aa, Artificial Sequence
  Synthetic
VMTKHIL

SEQ ID NO: 6054 - protein, 7 aa, Artificial Sequence
  Synthetic
AKGYGPM

SEQ ID NO: 6055 - protein, 7 aa, Artificial Sequence
  Synthetic
VHQRTPT

SEQ ID NO: 6056 - protein, 7 aa, Artificial Sequence
  Synthetic
FHNGVRS

SEQ ID NO: 6057 - protein, 7 aa, Artificial Sequence
  Synthetic
KADGIPR

SEQ ID NO: 6058 - protein, 7 aa, Artificial Sequence
  Synthetic
RKEIRIA

SEQ ID NO: 6059 - protein, 7 aa, Artificial Sequence
  Synthetic
DARGPGC

SEQ ID NO: 6060 - protein, 7 aa, Artificial Sequence
  Synthetic
RPTTNEK

SEQ ID NO: 6061 - protein, 7 aa, Artificial Sequence
  Synthetic
FKPANER

SEQ ID NO: 6062 - protein, 7 aa, Artificial Sequence
  Synthetic
RAMDAHK

SEQ ID NO: 6063 - protein, 7 aa, Artificial Sequence
  Synthetic
HNRDTRT

SEQ ID NO: 6064 - protein, 7 aa, Artificial Sequence
  Synthetic
RRTDVTG

SEQ ID NO: 6065 - protein, 7 aa, Artificial Sequence
  Synthetic
GNRHNVT

SEQ ID NO: 6066 - protein, 7 aa, Artificial Sequence
  Synthetic
KGEWKST

SEQ ID NO: 6067 - protein, 7 aa, Artificial Sequence
  Synthetic
NGSTYVG

SEQ ID NO: 6068 - protein, 7 aa, Artificial Sequence
  Synthetic
LRHREDV

SEQ ID NO: 6069 - protein, 7 aa, Artificial Sequence
  Synthetic
RRAMDVL

SEQ ID NO: 6070 - protein, 7 aa, Artificial Sequence
  Synthetic
NRSHAEW

SEQ ID NO: 6071 - protein, 7 aa, Artificial Sequence
  Synthetic
RAMKEAS

SEQ ID NO: 6072 - protein, 7 aa, Artificial Sequence
  Synthetic
VHQRSGL

SEQ ID NO: 6073 - protein, 7 aa, Artificial Sequence
  Synthetic
REKLLEY

SEQ ID NO: 6074 - protein, 7 aa, Artificial Sequence
  Synthetic
RMGLGHT

SEQ ID NO: 6075 - protein, 7 aa, Artificial Sequence
  Synthetic
YGGKNVH

SEQ ID NO: 6076 - protein, 7 aa, Artificial Sequence
  Synthetic
CLTSHRA

SEQ ID NO: 6077 - protein, 7 aa, Artificial Sequence
  Synthetic
WLTKVDK

SEQ ID NO: 6078 - protein, 7 aa, Artificial Sequence
  Synthetic
SGGTMNR

SEQ ID NO: 6079 - protein, 7 aa, Artificial Sequence
  Synthetic
SRQDPNR

SEQ ID NO: 6080 - protein, 7 aa, Artificial Sequence
  Synthetic
RNAHTVH

SEQ ID NO: 6081 - protein, 7 aa, Artificial Sequence
  Synthetic
AQSIVDT

SEQ ID NO: 6082 - protein, 7 aa, Artificial Sequence
  Synthetic
RKDSGER

SEQ ID NO: 6083 - protein, 7 aa, Artificial Sequence
  Synthetic
RDRMLDK

SEQ ID NO: 6084 - protein, 7 aa, Artificial Sequence
  Synthetic
RHYHEAV

SEQ ID NO: 6085 - protein, 7 aa, Artificial Sequence
  Synthetic
NHRAPLN

SEQ ID NO: 6086 - protein, 7 aa, Artificial Sequence
  Synthetic
MMSHRPN

SEQ ID NO: 6087 - protein, 7 aa, Artificial Sequence
  Synthetic
KSGLPAI

SEQ ID NO: 6088 - protein, 7 aa, Artificial Sequence
  Synthetic
QVPMRVV

SEQ ID NO: 6089 - protein, 7 aa, Artificial Sequence
  Synthetic
GINVLTY

SEQ ID NO: 6090 - protein, 7 aa, Artificial Sequence
  Synthetic
LVHGPRN

SEQ ID NO: 6091 - protein, 7 aa, Artificial Sequence
  Synthetic
GLVRDGR

SEQ ID NO: 6092 - protein, 7 aa, Artificial Sequence
  Synthetic
HMLKEFV

SEQ ID NO: 6093 - protein, 7 aa, Artificial Sequence
  Synthetic
FNHRAVL

SEQ ID NO: 6094 - protein, 7 aa, Artificial Sequence
  Synthetic
RLDGTMF

SEQ ID NO: 6095 - protein, 7 aa, Artificial Sequence
  Synthetic
KFKDVNL

SEQ ID NO: 6096 - protein, 7 aa, Artificial Sequence
  Synthetic
WSHLREH

SEQ ID NO: 6097 - protein, 7 aa, Artificial Sequence
  Synthetic
GHPGRVI

SEQ ID NO: 6098 - protein, 7 aa, Artificial Sequence
  Synthetic
GHRTNST

SEQ ID NO: 6099 - protein, 7 aa, Artificial Sequence
  Synthetic
RFANGSV

SEQ ID NO: 6100 - protein, 7 aa, Artificial Sequence
  Synthetic
AQFSEAR

SEQ ID NO: 6101 - protein, 7 aa, Artificial Sequence
  Synthetic
YERVGRM

SEQ ID NO: 6102 - protein, 7 aa, Artificial Sequence
  Synthetic
TLHMRHP

SEQ ID NO: 6103 - protein, 7 aa, Artificial Sequence
  Synthetic
SVPSYRA

SEQ ID NO: 6104 - protein, 7 aa, Artificial Sequence
  Synthetic
SRSSLHS

SEQ ID NO: 6105 - protein, 7 aa, Artificial Sequence
  Synthetic
KVVHGGS

SEQ ID NO: 6106 - protein, 7 aa, Artificial Sequence
  Synthetic
PMHNRSD

SEQ ID NO: 6107 - protein, 7 aa, Artificial Sequence
  Synthetic
AWSTTVG

SEQ ID NO: 6108 - protein, 7 aa, Artificial Sequence
  Synthetic
YHTKLVT

SEQ ID NO: 6109 - protein, 7 aa, Artificial Sequence
  Synthetic
YHLNKMA

SEQ ID NO: 6110 - protein, 7 aa, Artificial Sequence
  Synthetic
LKDRFSG

SEQ ID NO: 6111 - protein, 7 aa, Artificial Sequence
  Synthetic
NVGRTDR

SEQ ID NO: 6112 - protein, 7 aa, Artificial Sequence
  Synthetic
ELRSGQR

SEQ ID NO: 6113 - protein, 7 aa, Artificial Sequence
  Synthetic
ESGHRTF

SEQ ID NO: 6114 - protein, 7 aa, Artificial Sequence
  Synthetic
VRGFGEY

SEQ ID NO: 6115 - protein, 7 aa, Artificial Sequence
  Synthetic
HAALGRN

SEQ ID NO: 6116 - protein, 7 aa, Artificial Sequence
  Synthetic
RGREPPM

SEQ ID NO: 6117 - protein, 7 aa, Artificial Sequence
  Synthetic
KAHEGRS

SEQ ID NO: 6118 - protein, 7 aa, Artificial Sequence
  Synthetic
LKIPDFR

SEQ ID NO: 6119 - protein, 7 aa, Artificial Sequence
  Synthetic
KHGTPAH

SEQ ID NO: 6120 - protein, 7 aa, Artificial Sequence
  Synthetic
RTGEKQW

SEQ ID NO: 6121 - protein, 7 aa, Artificial Sequence
  Synthetic
VPQGRKD

SEQ ID NO: 6122 - protein, 7 aa, Artificial Sequence
  Synthetic
VFHRANL

SEQ ID NO: 6123 - protein, 7 aa, Artificial Sequence
  Synthetic
SAVRPFT

SEQ ID NO: 6124 - protein, 7 aa, Artificial Sequence
  Synthetic
GRGLHVG

SEQ ID NO: 6125 - protein, 7 aa, Artificial Sequence
  Synthetic
RHSPSSM

SEQ ID NO: 6126 - protein, 7 aa, Artificial Sequence
  Synthetic
HRSEGRQ

SEQ ID NO: 6127 - protein, 7 aa, Artificial Sequence
  Synthetic
GGHSLPR

SEQ ID NO: 6128 - protein, 7 aa, Artificial Sequence
  Synthetic
SDVGWSP

SEQ ID NO: 6129 - protein, 7 aa, Artificial Sequence
  Synthetic
MRGDHHL

SEQ ID NO: 6130 - protein, 7 aa, Artificial Sequence
  Synthetic
STWGQNH

SEQ ID NO: 6131 - protein, 7 aa, Artificial Sequence
  Synthetic
QAKFNTF

SEQ ID NO: 6132 - protein, 7 aa, Artificial Sequence
  Synthetic
VATRTFC

SEQ ID NO: 6133 - protein, 7 aa, Artificial Sequence
  Synthetic
VEYRIST

SEQ ID NO: 6134 - protein, 7 aa, Artificial Sequence
  Synthetic
IASVKNL

SEQ ID NO: 6135 - protein, 7 aa, Artificial Sequence
  Synthetic
TPSVLQL

SEQ ID NO: 6136 - protein, 7 aa, Artificial Sequence
  Synthetic
GHSGMYY

SEQ ID NO: 6137 - protein, 7 aa, Artificial Sequence
  Synthetic
SHMVPDF

SEQ ID NO: 6138 - protein, 7 aa, Artificial Sequence
  Synthetic
VSTSFSK

SEQ ID NO: 6139 - protein, 7 aa, Artificial Sequence
  Synthetic
HVSDGLT

SEQ ID NO: 6140 - protein, 7 aa, Artificial Sequence
  Synthetic
ERSAPKQ

SEQ ID NO: 6141 - protein, 7 aa, Artificial Sequence
  Synthetic
RSVVGMH

SEQ ID NO: 6142 - protein, 7 aa, Artificial Sequence
  Synthetic
WRGMERA

SEQ ID NO: 6143 - protein, 7 aa, Artificial Sequence
  Synthetic
GCARGGC

SEQ ID NO: 6144 - protein, 7 aa, Artificial Sequence
  Synthetic
KNTANDR

SEQ ID NO: 6145 - protein, 7 aa, Artificial Sequence
  Synthetic
DRPKLAA

SEQ ID NO: 6146 - protein, 7 aa, Artificial Sequence
  Synthetic
WASHTPK

SEQ ID NO: 6147 - protein, 7 aa, Artificial Sequence
  Synthetic
VIASKEL

SEQ ID NO: 6148 - protein, 7 aa, Artificial Sequence
  Synthetic
GVAIAHT

SEQ ID NO: 6149 - protein, 7 aa, Artificial Sequence
  Synthetic
NTELLGR

SEQ ID NO: 6150 - protein, 7 aa, Artificial Sequence
  Synthetic
MLVGAHF

SEQ ID NO: 6151 - protein, 7 aa, Artificial Sequence
  Synthetic
SHAGWAA

SEQ ID NO: 6152 - protein, 7 aa, Artificial Sequence
  Synthetic
GQGVRTS

SEQ ID NO: 6153 - protein, 7 aa, Artificial Sequence
  Synthetic
FTLSSSV

SEQ ID NO: 6154 - protein, 7 aa, Artificial Sequence
  Synthetic
NNQVWHT

SEQ ID NO: 6155 - protein, 7 aa, Artificial Sequence
  Synthetic
TAHFHLV

SEQ ID NO: 6156 - protein, 7 aa, Artificial Sequence
  Synthetic
YTGRPFE

SEQ ID NO: 6157 - protein, 7 aa, Artificial Sequence
  Synthetic
SGRALGT

SEQ ID NO: 6158 - protein, 7 aa, Artificial Sequence
  Synthetic
FSLTDPR

SEQ ID NO: 6159 - protein, 7 aa, Artificial Sequence
  Synthetic
YGIHYRS

SEQ ID NO: 6160 - protein, 7 aa, Artificial Sequence
  Synthetic
LVQVHKH

SEQ ID NO: 6161 - protein, 7 aa, Artificial Sequence
  Synthetic
AGVRVER

SEQ ID NO: 6162 - protein, 7 aa, Artificial Sequence
  Synthetic
CANHKNT

SEQ ID NO: 6163 - protein, 7 aa, Artificial Sequence
  Synthetic
GPQKSVY

SEQ ID NO: 6164 - protein, 7 aa, Artificial Sequence
  Synthetic
GGSTRGS

SEQ ID NO: 6165 - protein, 7 aa, Artificial Sequence
  Synthetic
AAHVVAV

SEQ ID NO: 6166 - protein, 7 aa, Artificial Sequence
  Synthetic
TVRTSVY

SEQ ID NO: 6167 - protein, 7 aa, Artificial Sequence
  Synthetic
KELHRGN

SEQ ID NO: 6168 - protein, 7 aa, Artificial Sequence
  Synthetic
APWTQNG

SEQ ID NO: 6169 - protein, 7 aa, Artificial Sequence
  Synthetic
IHQPTVR

SEQ ID NO: 6170 - protein, 7 aa, Artificial Sequence
  Synthetic
NSGGALR

SEQ ID NO: 6171 - protein, 7 aa, Artificial Sequence
  Synthetic
RDLPQVR

SEQ ID NO: 6172 - protein, 7 aa, Artificial Sequence
  Synthetic
GPSGLGR

SEQ ID NO: 6173 - protein, 7 aa, Artificial Sequence
  Synthetic
KNFHAPL

SEQ ID NO: 6174 - protein, 7 aa, Artificial Sequence
  Synthetic
TKVGYMN

SEQ ID NO: 6175 - protein, 7 aa, Artificial Sequence
  Synthetic
MEFKLPL

SEQ ID NO: 6176 - protein, 7 aa, Artificial Sequence
  Synthetic
GLWKGAN

SEQ ID NO: 6177 - protein, 7 aa, Artificial Sequence
  Synthetic
ARWSGSD

SEQ ID NO: 6178 - protein, 7 aa, Artificial Sequence
  Synthetic
GGGAGRL

SEQ ID NO: 6179 - protein, 7 aa, Artificial Sequence
  Synthetic
RPHSAML

SEQ ID NO: 6180 - protein, 7 aa, Artificial Sequence
  Synthetic
RQGTFEK

SEQ ID NO: 6181 - protein, 7 aa, Artificial Sequence
  Synthetic
HRDLRGN

SEQ ID NO: 6182 - protein, 7 aa, Artificial Sequence
  Synthetic
PRMGPHA

SEQ ID NO: 6183 - protein, 7 aa, Artificial Sequence
  Synthetic
LRNLDAK

SEQ ID NO: 6184 - protein, 7 aa, Artificial Sequence
  Synthetic
RDDRLGR

SEQ ID NO: 6185 - protein, 7 aa, Artificial Sequence
  Synthetic
RASGQDK

SEQ ID NO: 6186 - protein, 7 aa, Artificial Sequence
  Synthetic
NQMPTLR

SEQ ID NO: 6187 - protein, 7 aa, Artificial Sequence
  Synthetic
RLTIEGR

SEQ ID NO: 6188 - protein, 7 aa, Artificial Sequence
  Synthetic
LKHTDGR

SEQ ID NO: 6189 - protein, 7 aa, Artificial Sequence
  Synthetic
MVKHGGS

SEQ ID NO: 6190 - protein, 7 aa, Artificial Sequence
  Synthetic
WIRANSE

SEQ ID NO: 6191 - protein, 7 aa, Artificial Sequence
  Synthetic
VGPGRSV

SEQ ID NO: 6192 - protein, 7 aa, Artificial Sequence
  Synthetic
HLRFSIE

SEQ ID NO: 6193 - protein, 7 aa, Artificial Sequence
  Synthetic
WSRAFEA

SEQ ID NO: 6194 - protein, 7 aa, Artificial Sequence
  Synthetic
SELPVFS

SEQ ID NO: 6195 - protein, 7 aa, Artificial Sequence
  Synthetic
RLKLEMG

SEQ ID NO: 6196 - protein, 7 aa, Artificial Sequence
  Synthetic
NALTIVG

SEQ ID NO: 6197 - protein, 7 aa, Artificial Sequence
  Synthetic
EGVSGSI

SEQ ID NO: 6198 - protein, 7 aa, Artificial Sequence
  Synthetic
LIAQHVE

SEQ ID NO: 6199 - protein, 7 aa, Artificial Sequence
  Synthetic
VHLALNA

SEQ ID NO: 6200 - protein, 7 aa, Artificial Sequence
  Synthetic
LGGRVIV

SEQ ID NO: 6201 - protein, 7 aa, Artificial Sequence
  Synthetic
VTKGIIF

SEQ ID NO: 6202 - protein, 7 aa, Artificial Sequence
  Synthetic
LVANDKF

SEQ ID NO: 6203 - protein, 7 aa, Artificial Sequence
  Synthetic
ADARSGW

SEQ ID NO: 6204 - protein, 7 aa, Artificial Sequence
  Synthetic
SSGHLTV

SEQ ID NO: 6205 - protein, 7 aa, Artificial Sequence
  Synthetic
CSTSVVV

SEQ ID NO: 6206 - protein, 7 aa, Artificial Sequence
  Synthetic
DKGYGSL

SEQ ID NO: 6207 - protein, 7 aa, Artificial Sequence
  Synthetic
MVLGRSA

SEQ ID NO: 6208 - protein, 7 aa, Artificial Sequence
  Synthetic
LHARGMV

SEQ ID NO: 6209 - protein, 7 aa, Artificial Sequence
  Synthetic
LGRTACT

SEQ ID NO: 6210 - protein, 7 aa, Artificial Sequence
  Synthetic
SAGAKHQ

SEQ ID NO: 6211 - protein, 7 aa, Artificial Sequence
  Synthetic
RHVTHDH

SEQ ID NO: 6212 - protein, 7 aa, Artificial Sequence
  Synthetic
VHGAALK

SEQ ID NO: 6213 - protein, 7 aa, Artificial Sequence
  Synthetic
SRGSSSC

SEQ ID NO: 6214 - protein, 7 aa, Artificial Sequence
  Synthetic
RWNVVNE

SEQ ID NO: 6215 - protein, 7 aa, Artificial Sequence
  Synthetic
RSGVDGR

SEQ ID NO: 6216 - protein, 7 aa, Artificial Sequence
  Synthetic
QHAMVRN

SEQ ID NO: 6217 - protein, 7 aa, Artificial Sequence
  Synthetic
RETIARH

SEQ ID NO: 6218 - protein, 7 aa, Artificial Sequence
  Synthetic
LRAHGVS

SEQ ID NO: 6219 - protein, 7 aa, Artificial Sequence
  Synthetic
TAWAAKG

SEQ ID NO: 6220 - protein, 7 aa, Artificial Sequence
  Synthetic
HRTVVGT

SEQ ID NO: 6221 - protein, 7 aa, Artificial Sequence
  Synthetic
HEIAAGW

SEQ ID NO: 6222 - protein, 7 aa, Artificial Sequence
  Synthetic
ISRQLSG

SEQ ID NO: 6223 - protein, 7 aa, Artificial Sequence
  Synthetic
RGMSQKE

SEQ ID NO: 6224 - protein, 7 aa, Artificial Sequence
  Synthetic
ERAVSSK

SEQ ID NO: 6225 - protein, 7 aa, Artificial Sequence
  Synthetic
YSGSQYL

SEQ ID NO: 6226 - protein, 7 aa, Artificial Sequence
  Synthetic
SAQTSGW

SEQ ID NO: 6227 - protein, 7 aa, Artificial Sequence
  Synthetic
LRDPFPG

SEQ ID NO: 6228 - protein, 7 aa, Artificial Sequence
  Synthetic
KEVHQVR

SEQ ID NO: 6229 - protein, 7 aa, Artificial Sequence
  Synthetic
VNGKVGP

SEQ ID NO: 6230 - protein, 7 aa, Artificial Sequence
  Synthetic
LHNGGRL

SEQ ID NO: 6231 - protein, 7 aa, Artificial Sequence
  Synthetic
RMQRAGE

SEQ ID NO: 6232 - protein, 7 aa, Artificial Sequence
  Synthetic
GEWSRGC

SEQ ID NO: 6233 - protein, 7 aa, Artificial Sequence
  Synthetic
NAYVSKV

SEQ ID NO: 6234 - protein, 7 aa, Artificial Sequence
  Synthetic
QSSNPMR

SEQ ID NO: 6235 - protein, 7 aa, Artificial Sequence
  Synthetic
RRMDNLL

SEQ ID NO: 6236 - protein, 7 aa, Artificial Sequence
  Synthetic
GGHAGRV

SEQ ID NO: 6237 - protein, 7 aa, Artificial Sequence
  Synthetic
LGPVLPR

SEQ ID NO: 6238 - protein, 7 aa, Artificial Sequence
  Synthetic
NTGQQGR

SEQ ID NO: 6239 - protein, 7 aa, Artificial Sequence
  Synthetic
RLNKNDF

SEQ ID NO: 6240 - protein, 7 aa, Artificial Sequence
  Synthetic
CEKRQRE

SEQ ID NO: 6241 - protein, 7 aa, Artificial Sequence
  Synthetic
RLARELI

SEQ ID NO: 6242 - protein, 7 aa, Artificial Sequence
  Synthetic
RREPEFK

SEQ ID NO: 6243 - protein, 7 aa, Artificial Sequence
  Synthetic
WAGAVVR

SEQ ID NO: 6244 - protein, 7 aa, Artificial Sequence
  Synthetic
ADQVRKL

SEQ ID NO: 6245 - protein, 7 aa, Artificial Sequence
  Synthetic
VWRPKDV

SEQ ID NO: 6246 - protein, 7 aa, Artificial Sequence
  Synthetic
WGDAKGR

SEQ ID NO: 6247 - protein, 7 aa, Artificial Sequence
  Synthetic
IKGNHVF

SEQ ID NO: 6248 - protein, 7 aa, Artificial Sequence
  Synthetic
RVLDGAR

SEQ ID NO: 6249 - protein, 7 aa, Artificial Sequence
  Synthetic
ERAISSR

SEQ ID NO: 6250 - protein, 7 aa, Artificial Sequence
  Synthetic
GRMREEW

SEQ ID NO: 6251 - protein, 7 aa, Artificial Sequence
  Synthetic
YSRNTSQ

SEQ ID NO: 6252 - protein, 7 aa, Artificial Sequence
  Synthetic
NDPRRSM

SEQ ID NO: 6253 - protein, 7 aa, Artificial Sequence
  Synthetic
HIHLNIG

SEQ ID NO: 6254 - protein, 7 aa, Artificial Sequence
  Synthetic
RREPSHN

SEQ ID NO: 6255 - protein, 7 aa, Artificial Sequence
  Synthetic
SGTRLAS

SEQ ID NO: 6256 - protein, 7 aa, Artificial Sequence
  Synthetic
NKKWEDT

SEQ ID NO: 6257 - protein, 7 aa, Artificial Sequence
  Synthetic
ISLRGDR

SEQ ID NO: 6258 - protein, 7 aa, Artificial Sequence
  Synthetic
SEQYVRG

SEQ ID NO: 6259 - protein, 7 aa, Artificial Sequence
  Synthetic
QHVGAAR

SEQ ID NO: 6260 - protein, 7 aa, Artificial Sequence
  Synthetic
SLAAHRA

SEQ ID NO: 6261 - protein, 7 aa, Artificial Sequence
  Synthetic
PLRHDST

SEQ ID NO: 6262 - protein, 7 aa, Artificial Sequence
  Synthetic
RGNLNHT

SEQ ID NO: 6263 - protein, 7 aa, Artificial Sequence
  Synthetic
GYPHKTC

SEQ ID NO: 6264 - protein, 7 aa, Artificial Sequence
  Synthetic
GAHVQGR

SEQ ID NO: 6265 - protein, 7 aa, Artificial Sequence
  Synthetic
HRVDILR

SEQ ID NO: 6266 - protein, 7 aa, Artificial Sequence
  Synthetic
LLKGSVI

SEQ ID NO: 6267 - protein, 7 aa, Artificial Sequence
  Synthetic
HVAVNLR

SEQ ID NO: 6268 - protein, 7 aa, Artificial Sequence
  Synthetic
GEKNHGA

SEQ ID NO: 6269 - protein, 7 aa, Artificial Sequence
  Synthetic
NHVSSYE

SEQ ID NO: 6270 - protein, 7 aa, Artificial Sequence
  Synthetic
GHAGLIR

SEQ ID NO: 6271 - protein, 7 aa, Artificial Sequence
  Synthetic
EKAVVVK

SEQ ID NO: 6272 - protein, 7 aa, Artificial Sequence
  Synthetic
LWAVRSE

SEQ ID NO: 6273 - protein, 7 aa, Artificial Sequence
  Synthetic
KVINEVR

SEQ ID NO: 6274 - protein, 7 aa, Artificial Sequence
  Synthetic
RMGDRTL

SEQ ID NO: 6275 - protein, 7 aa, Artificial Sequence
  Synthetic
APIRLSH

SEQ ID NO: 6276 - protein, 7 aa, Artificial Sequence
  Synthetic
HMKVDMR

SEQ ID NO: 6277 - protein, 7 aa, Artificial Sequence
  Synthetic
VPHNPFK

SEQ ID NO: 6278 - protein, 7 aa, Artificial Sequence
  Synthetic
RGGPHVL

SEQ ID NO: 6279 - protein, 7 aa, Artificial Sequence
  Synthetic
HRGIPGV

SEQ ID NO: 6280 - protein, 7 aa, Artificial Sequence
  Synthetic
SNNRTER

SEQ ID NO: 6281 - protein, 7 aa, Artificial Sequence
  Synthetic
HAQPVQR

SEQ ID NO: 6282 - protein, 7 aa, Artificial Sequence
  Synthetic
RYSPGPN

SEQ ID NO: 6283 - protein, 7 aa, Artificial Sequence
  Synthetic
GGLAQGR

SEQ ID NO: 6284 - protein, 7 aa, Artificial Sequence
  Synthetic
RVGKSDW

SEQ ID NO: 6285 - protein, 7 aa, Artificial Sequence
  Synthetic
VQNRPAF

SEQ ID NO: 6286 - protein, 7 aa, Artificial Sequence
  Synthetic
AVEHRAG

SEQ ID NO: 6287 - protein, 7 aa, Artificial Sequence
  Synthetic
TNVVGQH

SEQ ID NO: 6288 - protein, 7 aa, Artificial Sequence
  Synthetic
SGIQSVR

SEQ ID NO: 6289 - protein, 7 aa, Artificial Sequence
  Synthetic
VQLRETR

SEQ ID NO: 6290 - protein, 7 aa, Artificial Sequence
  Synthetic
RAAIGVT

SEQ ID NO: 6291 - protein, 7 aa, Artificial Sequence
  Synthetic
HLSARIA

SEQ ID NO: 6292 - protein, 7 aa, Artificial Sequence
  Synthetic
NKVDVGR

SEQ ID NO: 6293 - protein, 7 aa, Artificial Sequence
  Synthetic
WGREAKG

SEQ ID NO: 6294 - protein, 7 aa, Artificial Sequence
  Synthetic
VFPRGLV

SEQ ID NO: 6295 - protein, 7 aa, Artificial Sequence
  Synthetic
YAPFWTA

SEQ ID NO: 6296 - protein, 7 aa, Artificial Sequence
  Synthetic
SIVNGRG

SEQ ID NO: 6297 - protein, 7 aa, Artificial Sequence
  Synthetic
REPGNVK

SEQ ID NO: 6298 - protein, 7 aa, Artificial Sequence
  Synthetic
GSIGTKS

SEQ ID NO: 6299 - protein, 7 aa, Artificial Sequence
  Synthetic
LRSDASN

SEQ ID NO: 6300 - protein, 7 aa, Artificial Sequence
  Synthetic
RGDSIMR

SEQ ID NO: 6301 - protein, 7 aa, Artificial Sequence
  Synthetic
KVRLEHG

SEQ ID NO: 6302 - protein, 7 aa, Artificial Sequence
  Synthetic
DGGRTMW

SEQ ID NO: 6303 - protein, 7 aa, Artificial Sequence
  Synthetic
GKDLHPV

SEQ ID NO: 6304 - protein, 7 aa, Artificial Sequence
  Synthetic
MVRQLSA

SEQ ID NO: 6305 - protein, 7 aa, Artificial Sequence
  Synthetic
KSSFCES

SEQ ID NO: 6306 - protein, 7 aa, Artificial Sequence
  Synthetic
GNLLSPS

SEQ ID NO: 6307 - protein, 7 aa, Artificial Sequence
  Synthetic
RHVGHAG

SEQ ID NO: 6308 - protein, 7 aa, Artificial Sequence
  Synthetic
VARDRSM

SEQ ID NO: 6309 - protein, 7 aa, Artificial Sequence
  Synthetic
RHNPLTF

SEQ ID NO: 6310 - protein, 7 aa, Artificial Sequence
  Synthetic
ARLVEGR

SEQ ID NO: 6311 - protein, 7 aa, Artificial Sequence
  Synthetic
VLHTLDD

SEQ ID NO: 6312 - protein, 7 aa, Artificial Sequence
  Synthetic
SIVTANM

SEQ ID NO: 6313 - protein, 7 aa, Artificial Sequence
  Synthetic
TRTKDVG

SEQ ID NO: 6314 - protein, 7 aa, Artificial Sequence
  Synthetic
KAMSYGH

SEQ ID NO: 6315 - protein, 7 aa, Artificial Sequence
  Synthetic
GWRGNEH

SEQ ID NO: 6316 - protein, 7 aa, Artificial Sequence
  Synthetic
TKGLLTE

SEQ ID NO: 6317 - protein, 7 aa, Artificial Sequence
  Synthetic
LRIPLDR

SEQ ID NO: 6318 - protein, 7 aa, Artificial Sequence
  Synthetic
WKGQRDG

SEQ ID NO: 6319 - protein, 7 aa, Artificial Sequence
  Synthetic
HSKSLLH

SEQ ID NO: 6320 - protein, 7 aa, Artificial Sequence
  Synthetic
NRENMHR

SEQ ID NO: 6321 - protein, 7 aa, Artificial Sequence
  Synthetic
DRDLVRT

SEQ ID NO: 6322 - protein, 7 aa, Artificial Sequence
  Synthetic
LPGSVQR

SEQ ID NO: 6323 - protein, 7 aa, Artificial Sequence
  Synthetic
VVRGPNN

SEQ ID NO: 6324 - protein, 7 aa, Artificial Sequence
  Synthetic
GSVNVLR

SEQ ID NO: 6325 - protein, 7 aa, Artificial Sequence
  Synthetic
GSGSKDW

SEQ ID NO: 6326 - protein, 7 aa, Artificial Sequence
  Synthetic
WSDFKHV

SEQ ID NO: 6327 - protein, 7 aa, Artificial Sequence
  Synthetic
GGANHYH

SEQ ID NO: 6328 - protein, 7 aa, Artificial Sequence
  Synthetic
GRNDAHL

SEQ ID NO: 6329 - protein, 7 aa, Artificial Sequence
  Synthetic
HKASGRP

SEQ ID NO: 6330 - protein, 7 aa, Artificial Sequence
  Synthetic
LAQHLGR

SEQ ID NO: 6331 - protein, 7 aa, Artificial Sequence
  Synthetic
GLKNWTS

SEQ ID NO: 6332 - protein, 7 aa, Artificial Sequence
  Synthetic
QPQRPFV

SEQ ID NO: 6333 - protein, 7 aa, Artificial Sequence
  Synthetic
FLVRSVA

SEQ ID NO: 6334 - protein, 7 aa, Artificial Sequence
  Synthetic
RYTESLK

SEQ ID NO: 6335 - protein, 7 aa, Artificial Sequence
  Synthetic
FAQRIVH

SEQ ID NO: 6336 - protein, 7 aa, Artificial Sequence
  Synthetic
GGRLVAV

SEQ ID NO: 6337 - protein, 7 aa, Artificial Sequence
  Synthetic
LGSRLGY

SEQ ID NO: 6338 - protein, 7 aa, Artificial Sequence
  Synthetic
RVDMPFQ

SEQ ID NO: 6339 - protein, 7 aa, Artificial Sequence
  Synthetic
RQERPFL

SEQ ID NO: 6340 - protein, 7 aa, Artificial Sequence
  Synthetic
FNQIWAA

SEQ ID NO: 6341 - protein, 7 aa, Artificial Sequence
  Synthetic
MHKILAV

SEQ ID NO: 6342 - protein, 7 aa, Artificial Sequence
  Synthetic
YRDRGQG

SEQ ID NO: 6343 - protein, 7 aa, Artificial Sequence
  Synthetic
QNALSSG

SEQ ID NO: 6344 - protein, 7 aa, Artificial Sequence
  Synthetic
HRAEPKL

SEQ ID NO: 6345 - protein, 7 aa, Artificial Sequence
  Synthetic
PKLVNIF

SEQ ID NO: 6346 - protein, 7 aa, Artificial Sequence
  Synthetic
ELRGRMS

SEQ ID NO: 6347 - protein, 7 aa, Artificial Sequence
  Synthetic
RKPDPHV

SEQ ID NO: 6348 - protein, 7 aa, Artificial Sequence
  Synthetic
LLLHQVK

SEQ ID NO: 6349 - protein, 7 aa, Artificial Sequence
  Synthetic
NSGIHLR

SEQ ID NO: 6350 - protein, 7 aa, Artificial Sequence
  Synthetic
HEKMSAR

SEQ ID NO: 6351 - protein, 7 aa, Artificial Sequence
  Synthetic
KSGVEYR

SEQ ID NO: 6352 - protein, 7 aa, Artificial Sequence
  Synthetic
YHAGRPG

SEQ ID NO: 6353 - protein, 7 aa, Artificial Sequence
  Synthetic
IRMADSR

SEQ ID NO: 6354 - protein, 7 aa, Artificial Sequence
  Synthetic
KWGGSSA

SEQ ID NO: 6355 - protein, 7 aa, Artificial Sequence
  Synthetic
GRGMNSC

SEQ ID NO: 6356 - protein, 7 aa, Artificial Sequence
  Synthetic
LHNVGAR

SEQ ID NO: 6357 - protein, 7 aa, Artificial Sequence
  Synthetic
WFPGGAS

SEQ ID NO: 6358 - protein, 7 aa, Artificial Sequence
  Synthetic
GGDRWAY

SEQ ID NO: 6359 - protein, 7 aa, Artificial Sequence
  Synthetic
THRAMVA

SEQ ID NO: 6360 - protein, 7 aa, Artificial Sequence
  Synthetic
EDFVRDL

SEQ ID NO: 6361 - protein, 7 aa, Artificial Sequence
  Synthetic
ASLRLDI

SEQ ID NO: 6362 - protein, 7 aa, Artificial Sequence
  Synthetic
LIQTTSW

SEQ ID NO: 6363 - protein, 7 aa, Artificial Sequence
  Synthetic
DSPREHR

SEQ ID NO: 6364 - protein, 7 aa, Artificial Sequence
  Synthetic
LWRDADF

SEQ ID NO: 6365 - protein, 7 aa, Artificial Sequence
  Synthetic
IGRDAQR

SEQ ID NO: 6366 - protein, 7 aa, Artificial Sequence
  Synthetic
RFAALPI

SEQ ID NO: 6367 - protein, 7 aa, Artificial Sequence
  Synthetic
IPTVAMR

SEQ ID NO: 6368 - protein, 7 aa, Artificial Sequence
  Synthetic
NPKWDAY

SEQ ID NO: 6369 - protein, 7 aa, Artificial Sequence
  Synthetic
RAQPGGW

SEQ ID NO: 6370 - protein, 7 aa, Artificial Sequence
  Synthetic
RQSRADG

SEQ ID NO: 6371 - protein, 7 aa, Artificial Sequence
  Synthetic
SPRVTGH

SEQ ID NO: 6372 - protein, 7 aa, Artificial Sequence
  Synthetic
SRQMYSG

SEQ ID NO: 6373 - protein, 7 aa, Artificial Sequence
  Synthetic
AGHVGRA

SEQ ID NO: 6374 - protein, 7 aa, Artificial Sequence
  Synthetic
AREPASR

SEQ ID NO: 6375 - protein, 7 aa, Artificial Sequence
  Synthetic
RAPFFTD

SEQ ID NO: 6376 - protein, 7 aa, Artificial Sequence
  Synthetic
DWGSTLD

SEQ ID NO: 6377 - protein, 7 aa, Artificial Sequence
  Synthetic
VRGSMAM

SEQ ID NO: 6378 - protein, 7 aa, Artificial Sequence
  Synthetic
QEDRRGH

SEQ ID NO: 6379 - protein, 7 aa, Artificial Sequence
  Synthetic
THRAPSG

SEQ ID NO: 6380 - protein, 7 aa, Artificial Sequence
  Synthetic
RQGRMET

SEQ ID NO: 6381 - protein, 7 aa, Artificial Sequence
  Synthetic
PRSSGGG

SEQ ID NO: 6382 - protein, 7 aa, Artificial Sequence
  Synthetic
DLKQNGR

SEQ ID NO: 6383 - protein, 7 aa, Artificial Sequence
  Synthetic
NAREAGK

SEQ ID NO: 6384 - protein, 7 aa, Artificial Sequence
  Synthetic
CKSCEPS

SEQ ID NO: 6385 - protein, 7 aa, Artificial Sequence
  Synthetic
GLGREGR

SEQ ID NO: 6386 - protein, 7 aa, Artificial Sequence
  Synthetic
GARKVEG

SEQ ID NO: 6387 - protein, 7 aa, Artificial Sequence
  Synthetic
RGHGNAG

SEQ ID NO: 6388 - protein, 7 aa, Artificial Sequence
  Synthetic
RSEVSGK

SEQ ID NO: 6389 - protein, 7 aa, Artificial Sequence
  Synthetic
WVVKGSA

SEQ ID NO: 6390 - protein, 7 aa, Artificial Sequence
  Synthetic
NSFKNLL

SEQ ID NO: 6391 - protein, 7 aa, Artificial Sequence
  Synthetic
MTSLGNR

SEQ ID NO: 6392 - protein, 7 aa, Artificial Sequence
  Synthetic
RPTGHAL

SEQ ID NO: 6393 - protein, 7 aa, Artificial Sequence
  Synthetic
RHSIAEF

SEQ ID NO: 6394 - protein, 7 aa, Artificial Sequence
  Synthetic
RRLADEL

SEQ ID NO: 6395 - protein, 7 aa, Artificial Sequence
  Synthetic
AKSFVSI

SEQ ID NO: 6396 - protein, 7 aa, Artificial Sequence
  Synthetic
RVLSEEK

SEQ ID NO: 6397 - protein, 7 aa, Artificial Sequence
  Synthetic
HGKGVNG

SEQ ID NO: 6398 - protein, 7 aa, Artificial Sequence
  Synthetic
FKNGSHV

SEQ ID NO: 6399 - protein, 7 aa, Artificial Sequence
  Synthetic
LERSGLR

SEQ ID NO: 6400 - protein, 7 aa, Artificial Sequence
  Synthetic
HERRPGP

SEQ ID NO: 6401 - protein, 7 aa, Artificial Sequence
  Synthetic
GGPGLVR

SEQ ID NO: 6402 - protein, 7 aa, Artificial Sequence
  Synthetic
LAVIPVP

SEQ ID NO: 6403 - protein, 7 aa, Artificial Sequence
  Synthetic
CQAARLG

SEQ ID NO: 6404 - protein, 7 aa, Artificial Sequence
  Synthetic
SMDRVFL

SEQ ID NO: 6405 - protein, 7 aa, Artificial Sequence
  Synthetic
GALPMTP

SEQ ID NO: 6406 - protein, 7 aa, Artificial Sequence
  Synthetic
SPRTPFV

SEQ ID NO: 6407 - protein, 7 aa, Artificial Sequence
  Synthetic
VGNILVR

SEQ ID NO: 6408 - protein, 7 aa, Artificial Sequence
  Synthetic
TAIERKH

SEQ ID NO: 6409 - protein, 7 aa, Artificial Sequence
  Synthetic
AAGNVKH

SEQ ID NO: 6410 - protein, 7 aa, Artificial Sequence
  Synthetic
RAGTSHP

SEQ ID NO: 6411 - protein, 7 aa, Artificial Sequence
  Synthetic
VQGNPGR

SEQ ID NO: 6412 - protein, 7 aa, Artificial Sequence
  Synthetic
GRVLGPH

SEQ ID NO: 6413 - protein, 7 aa, Artificial Sequence
  Synthetic
LMRPTLH

SEQ ID NO: 6414 - protein, 7 aa, Artificial Sequence
  Synthetic
GSRLHVG

SEQ ID NO: 6415 - protein, 7 aa, Artificial Sequence
  Synthetic
WSPANAR

SEQ ID NO: 6416 - protein, 7 aa, Artificial Sequence
  Synthetic
KTQTNTW

SEQ ID NO: 6417 - protein, 7 aa, Artificial Sequence
  Synthetic
LRLMHTG

SEQ ID NO: 6418 - protein, 7 aa, Artificial Sequence
  Synthetic
EAMRATM

SEQ ID NO: 6419 - protein, 7 aa, Artificial Sequence
  Synthetic
SLRTVQY

SEQ ID NO: 6420 - protein, 7 aa, Artificial Sequence
  Synthetic
KRFDGLG

SEQ ID NO: 6421 - protein, 7 aa, Artificial Sequence
  Synthetic
AFLRGGV

SEQ ID NO: 6422 - protein, 7 aa, Artificial Sequence
  Synthetic
IYLASNV

SEQ ID NO: 6423 - protein, 7 aa, Artificial Sequence
  Synthetic
MGASTYL

SEQ ID NO: 6424 - protein, 7 aa, Artificial Sequence
  Synthetic
HKASYLA

SEQ ID NO: 6425 - protein, 7 aa, Artificial Sequence
  Synthetic
VVHTGFK

SEQ ID NO: 6426 - protein, 7 aa, Artificial Sequence
  Synthetic
SFGQVAA

SEQ ID NO: 6427 - protein, 7 aa, Artificial Sequence
  Synthetic
LHHSSEL

SEQ ID NO: 6428 - protein, 7 aa, Artificial Sequence
  Synthetic
QAGQLTG

SEQ ID NO: 6429 - protein, 7 aa, Artificial Sequence
  Synthetic
ETGRWHA

SEQ ID NO: 6430 - DNA, 21 bp, Artificial Sequence
  Synthetic
gctcttgatcgtccgtttatt

SEQ ID NO: 6431 - DNA, 21 bp, Artificial Sequence
  Synthetic
gagttgtttctgtcggggcgt

SEQ ID NO: 6432 - DNA, 21 bp, Artificial Sequence
  Synthetic
ctgactctgacgacgagtgtt

SEQ ID NO: 6433 - DNA, 21 bp, Artificial Sequence
  Synthetic
ttgactatgactacgtcggtg

SEQ ID NO: 6434 - DNA, 21 bp, Artificial Sequence
  Synthetic
tatatttttgatggtgggggg

SEQ ID NO: 6435 - DNA, 21 bp, Artificial Sequence
  Synthetic
agttcggtttttagggaggtg

SEQ ID NO: 6436 - DNA, 21 bp, Artificial Sequence
  Synthetic
actccgcagaggccttttatt

SEQ ID NO: 6437 - DNA, 21 bp, Artificial Sequence
  Synthetic
tggggtgctgcgtctcagttt

SEQ ID NO: 6438 - DNA, 21 bp, Artificial Sequence
  Synthetic
gttggtgttcctcttgggcat

SEQ ID NO: 6439 - DNA, 21 bp, Artificial Sequence
  Synthetic
tcggtggataagccgtttttg

SEQ ID NO: 6440 - DNA, 21 bp, Artificial Sequence
  Synthetic
tttgtgagtggtgggccttat

SEQ ID NO: 6441 - DNA, 21 bp, Artificial Sequence
  Synthetic
gggacgtttttgccgccgagt

SEQ ID NO: 6442 - DNA, 21 bp, Artificial Sequence
  Synthetic
agtattggtaagccttttatt

SEQ ID NO: 6443 - DNA, 21 bp, Artificial Sequence
  Synthetic
ggtgcgttgggttgggctcct

SEQ ID NO: 6444 - DNA, 21 bp, Artificial Sequence
  Synthetic
agtgctgctcgtccttttact

SEQ ID NO: 6445 - DNA, 21 bp, Artificial Sequence
  Synthetic
aataagctgggttgggttgct

SEQ ID NO: 6446 - DNA, 21 bp, Artificial Sequence
  Synthetic
tggacgggggagtatcctagg

SEQ ID NO: 6447 - DNA, 21 bp, Artificial Sequence
  Synthetic
cagttgaggtttgttgaggtg

SEQ ID NO: 6448 - DNA, 21 bp, Artificial Sequence
  Synthetic
ggtctgtgggagagtgggggg

SEQ ID NO: 6449 - DNA, 21 bp, Artificial Sequence
  Synthetic
ccgtcttcgagtacgtcttgg

SEQ ID NO: 6450 - DNA, 21 bp, Artificial Sequence
  Synthetic
catgtgaagtttgaggctatt

SEQ ID NO: 6451 - DNA, 21 bp, Artificial Sequence
  Synthetic
acggtgtggcgtgagggtggt

SEQ ID NO: 6452 - DNA, 21 bp, Artificial Sequence
  Synthetic
acgagtgggcggccttttgtg

SEQ ID NO: 6453 - DNA, 21 bp, Artificial Sequence
  Synthetic
gggaagcagggttttgttgcg

SEQ ID NO: 6454 - DNA, 21 bp, Artificial Sequence
  Synthetic
gctggggtggctttgggtcgg

SEQ ID NO: 6455 - DNA, 21 bp, Artificial Sequence
  Synthetic
catgctgttgggtggactgcg

SEQ ID NO: 6456 - DNA, 21 bp, Artificial Sequence
  Synthetic
tctccgtcgcttccttttcgt

SEQ ID NO: 6457 - DNA, 21 bp, Artificial Sequence
  Synthetic
gttgggcgtccgctgggggtg

SEQ ID NO: 6458 - DNA, 21 bp, Artificial Sequence
  Synthetic
tcggctcgttttgagtttgtg

SEQ ID NO: 6459 - DNA, 21 bp, Artificial Sequence
  Synthetic
tctgatgttatgccgtttcgg

SEQ ID NO: 6460 - DNA, 21 bp, Artificial Sequence
  Synthetic
ggtgcgcttgggtttattgcg

SEQ ID NO: 6461 - DNA, 21 bp, Artificial Sequence
  Synthetic
acggtttggcggaatgagggt

SEQ ID NO: 6462 - DNA, 21 bp, Artificial Sequence
  Synthetic
ccggtgtcgagttcgtcgtgg

SEQ ID NO: 6463 - DNA, 21 bp, Artificial Sequence
  Synthetic
agtagtgcgggttgggttgct

SEQ ID NO: 6464 - DNA, 21 bp, Artificial Sequence
  Synthetic
gtggggattagtccgccgcgg

SEQ ID NO: 6465 - DNA, 21 bp, Artificial Sequence
  Synthetic
ctggggagggctctggggcag

SEQ ID NO: 6466 - DNA, 21 bp, Artificial Sequence
  Synthetic
gttggtaggccgttgggggcg

SEQ ID NO: 6467 - DNA, 21 bp, Artificial Sequence
  Synthetic
gatgcgtggcgtagggatggg

SEQ ID NO: 6468 - DNA, 21 bp, Artificial Sequence
  Synthetic
ggggctcttggttttattgct

SEQ ID NO: 6469 - DNA, 21 bp, Artificial Sequence
  Synthetic
acgccgggtacgccgtggttg

SEQ ID NO: 6470 - DNA, 21 bp, Artificial Sequence
  Synthetic
tatgatcagcatttgtttcgt

SEQ ID NO: 6471 - DNA, 21 bp, Artificial Sequence
  Synthetic
gagggtcgtgcgttgggtttg

SEQ ID NO: 6472 - DNA, 21 bp, Artificial Sequence
  Synthetic
ttggagtttcatcctcctcgt

SEQ ID NO: 6473 - DNA, 21 bp, Artificial Sequence
  Synthetic
cttgggcgtgcgttggggctt

SEQ ID NO: 6474 - DNA, 21 bp, Artificial Sequence
  Synthetic
tcgcagtctaggccgtttcag

SEQ ID NO: 6475 - DNA, 21 bp, Artificial Sequence
  Synthetic
gctgggtgtggtgttgtgtgt

SEQ ID NO: 6476 - DNA, 21 bp, Artificial Sequence
  Synthetic
agtaagactgggtgggcgccg

SEQ ID NO: 6477 - DNA, 21 bp, Artificial Sequence
  Synthetic
actccggcgagtccgtttctg

SEQ ID NO: 6478 - DNA, 21 bp, Artificial Sequence
  Synthetic
gctgcttttagtcctcctaag

SEQ ID NO: 6479 - DNA, 21 bp, Artificial Sequence
  Synthetic
tctgagaagtatgggattttt

SEQ ID NO: 6480 - DNA, 21 bp, Artificial Sequence
  Synthetic
ggtattgggaggccttttact

SEQ ID NO: 6481 - DNA, 21 bp, Artificial Sequence
  Synthetic
gattggaggggggagcagtat

SEQ ID NO: 6482 - DNA, 21 bp, Artificial Sequence
  Synthetic
tatgggcatatgcctttttct

SEQ ID NO: 6483 - DNA, 21 bp, Artificial Sequence
  Synthetic
agtagggttggttgggtggcg

SEQ ID NO: 6484 - DNA, 21 bp, Artificial Sequence
  Synthetic
acgaaggcgcagccttttttg

SEQ ID NO: 6485 - DNA, 21 bp, Artificial Sequence
  Synthetic
agtccgactatggtgtttaag

SEQ ID NO: 6486 - DNA, 21 bp, Artificial Sequence
  Synthetic
actagtaagttgccttttttt

SEQ ID NO: 6487 - DNA, 21 bp, Artificial Sequence
  Synthetic
acgttgaggtttgagtctatt

SEQ ID NO: 6488 - DNA, 21 bp, Artificial Sequence
  Synthetic
gagggttttgctcctcctaag

SEQ ID NO: 6489 - DNA, 21 bp, Artificial Sequence
  Synthetic
gttactctgtctacgagtaag

SEQ ID NO: 6490 - DNA, 21 bp, Artificial Sequence
  Synthetic
actcagcgttttgagaatatt

SEQ ID NO: 6491 - DNA, 21 bp, Artificial Sequence
  Synthetic
tggacggatgttggtcctagg

SEQ ID NO: 6492 - DNA, 21 bp, Artificial Sequence
  Synthetic
acgtctactcattggactccg

SEQ ID NO: 6493 - DNA, 21 bp, Artificial Sequence
  Synthetic
tgggcttctggggggccttat

SEQ ID NO: 6494 - DNA, 21 bp, Artificial Sequence
  Synthetic
acgactttgcagactagtagg

SEQ ID NO: 6495 - DNA, 21 bp, Artificial Sequence
  Synthetic
actaatatgacggtgtctcgt

SEQ ID NO: 6496 - DNA, 21 bp, Artificial Sequence
  Synthetic
tcgattttggggtttgttgct

SEQ ID NO: 6497 - DNA, 21 bp, Artificial Sequence
  Synthetic
gcgccggtgggttggacggcg

SEQ ID NO: 6498 - DNA, 21 bp, Artificial Sequence
  Synthetic
acgctggcgaagccgtttcat

SEQ ID NO: 6499 - DNA, 21 bp, Artificial Sequence
  Synthetic
actgtgtggaggtcggatggt

SEQ ID NO: 6500 - DNA, 21 bp, Artificial Sequence
  Synthetic
cagaagacgtttacgaatatg

SEQ ID NO: 6501 - DNA, 21 bp, Artificial Sequence
  Synthetic
gggcggctgccgattgtgcct

SEQ ID NO: 6502 - DNA, 21 bp, Artificial Sequence
  Synthetic
ccggttatgacgtcttcgtgg

SEQ ID NO: 6503 - DNA, 21 bp, Artificial Sequence
  Synthetic
tctgcgcttggttttattgcg

SEQ ID NO: 6504 - DNA, 21 bp, Artificial Sequence
  Synthetic
gatctgcataagccttggatt

SEQ ID NO: 6505 - DNA, 21 bp, Artificial Sequence
  Synthetic
aatacgctggcgacggctagg

SEQ ID NO: 6506 - DNA, 21 bp, Artificial Sequence
  Synthetic
ctgacgattcggacgagtatt

SEQ ID NO: 6507 - DNA, 21 bp, Artificial Sequence
  Synthetic
ggtcagtggcagcctcctagt

SEQ ID NO: 6508 - DNA, 21 bp, Artificial Sequence
  Synthetic
cctctgattgctacgcggatt

SEQ ID NO: 6509 - DNA, 21 bp, Artificial Sequence
  Synthetic
gagaatatgccttgggctaag

SEQ ID NO: 6510 - DNA, 21 bp, Artificial Sequence
  Synthetic
attgtgactaagccgtttctg

SEQ ID NO: 6511 - DNA, 21 bp, Artificial Sequence
  Synthetic
cttggggttcagttgggtaag

SEQ ID NO: 6512 - DNA, 21 bp, Artificial Sequence
  Synthetic
gctgatattgggtgggctgcg

SEQ ID NO: 6513 - DNA, 21 bp, Artificial Sequence
  Synthetic
gggatgtggagtcctccggag

SEQ ID NO: 6514 - DNA, 21 bp, Artificial Sequence
  Synthetic
ggtgttgataggccttttttg

SEQ ID NO: 6515 - DNA, 21 bp, Artificial Sequence
  Synthetic
tcggttgataatccttttagg

SEQ ID NO: 6516 - DNA, 21 bp, Artificial Sequence
  Synthetic
tctattgataagcctttttat

SEQ ID NO: 6517 - DNA, 21 bp, Artificial Sequence
  Synthetic
tatgaggatcgtttgtggcat

SEQ ID NO: 6518 - DNA, 21 bp, Artificial Sequence
  Synthetic
actcttaagacgccttttatt

SEQ ID NO: 6519 - DNA, 21 bp, Artificial Sequence
  Synthetic
cagtctaggtttgctgatatt

SEQ ID NO: 6520 - DNA, 21 bp, Artificial Sequence
  Synthetic
cttaatttgaagactagtatt

SEQ ID NO: 6521 - DNA, 21 bp, Artificial Sequence
  Synthetic
gatgggctttggccgcatggt

SEQ ID NO: 6522 - DNA, 21 bp, Artificial Sequence
  Synthetic
actgggagtaagccttttttg

SEQ ID NO: 6523 - DNA, 21 bp, Artificial Sequence
  Synthetic
actcgtgataggccgtttatt

SEQ ID NO: 6524 - DNA, 21 bp, Artificial Sequence
  Synthetic
ggtccgcagatgccgtttcgt

SEQ ID NO: 6525 - DNA, 21 bp, Artificial Sequence
  Synthetic
gtgggtattcgtctggggctg

SEQ ID NO: 6526 - DNA, 21 bp, Artificial Sequence
  Synthetic
ggggtgtttagtcctcctcct

SEQ ID NO: 6527 - DNA, 21 bp, Artificial Sequence
  Synthetic
ctgggtgtgcagcttggtcgg

SEQ ID NO: 6528 - DNA, 21 bp, Artificial Sequence
  Synthetic
aatttgacgcgtccgtttatt

SEQ ID NO: 6529 - DNA, 21 bp, Artificial Sequence
  Synthetic
ccgagttcttctcatacttgg

SEQ ID NO: 6530 - DNA, 21 bp, Artificial Sequence
  Synthetic
agtgtttggagggagcttggt

SEQ ID NO: 6531 - DNA, 21 bp, Artificial Sequence
  Synthetic
agtactgagcgtccgtggctt

SEQ ID NO: 6532 - DNA, 21 bp, Artificial Sequence
  Synthetic
attgagtttgctcctccgcgt

SEQ ID NO: 6533 - DNA, 21 bp, Artificial Sequence
  Synthetic
ctgacgttgcagactagtatt

SEQ ID NO: 6534 - DNA, 21 bp, Artificial Sequence
  Synthetic
gattttgcgcgtccttttctt

SEQ ID NO: 6535 - DNA, 21 bp, Artificial Sequence
  Synthetic
aagagtgagtggggtagttat

SEQ ID NO: 6536 - DNA, 21 bp, Artificial Sequence
  Synthetic
ttgggtattgcgttggggaag

SEQ ID NO: 6537 - DNA, 21 bp, Artificial Sequence
  Synthetic
tctgcgatgactacgtcttgg

SEQ ID NO: 6538 - DNA, 21 bp, Artificial Sequence
  Synthetic
agttcgattgggtggagtgcg

SEQ ID NO: 6539 - DNA, 21 bp, Artificial Sequence
  Synthetic
tggccgcctaatttgacgatg

SEQ ID NO: 6540 - DNA, 21 bp, Artificial Sequence
  Synthetic
ggtatttttgatggtggtggt

SEQ ID NO: 6541 - DNA, 21 bp, Artificial Sequence
  Synthetic
tcggcggagactccttttagg

SEQ ID NO: 6542 - DNA, 21 bp, Artificial Sequence
  Synthetic
gcggtttattttgagaaggtt

SEQ ID NO: 6543 - DNA, 21 bp, Artificial Sequence
  Synthetic
attgcgagtcggccttttctg

SEQ ID NO: 6544 - DNA, 21 bp, Artificial Sequence
  Synthetic
agtggtgagttttgtaagcag

SEQ ID NO: 6545 - DNA, 21 bp, Artificial Sequence
  Synthetic
ctgttgaatcgtccgtttgcg

SEQ ID NO: 6546 - DNA, 21 bp, Artificial Sequence
  Synthetic
ccggtttcttcttctacgtgg

SEQ ID NO: 6547 - DNA, 21 bp, Artificial Sequence
  Synthetic
ttgaaggtgaatgggtatcct

SEQ ID NO: 6548 - DNA, 21 bp, Artificial Sequence
  Synthetic
agtactacgactccgtttagg

SEQ ID NO: 6549 - DNA, 21 bp, Artificial Sequence
  Synthetic
actactggtaggccttttgtt

SEQ ID NO: 6550 - DNA, 21 bp, Artificial Sequence
  Synthetic
gttgggatgcggcttgggtat

SEQ ID NO: 6551 - DNA, 21 bp, Artificial Sequence
  Synthetic
acttcgattggttttattgcg

SEQ ID NO: 6552 - DNA, 21 bp, Artificial Sequence
  Synthetic
gggattgtgggttgggttccg

SEQ ID NO: 6553 - DNA, 21 bp, Artificial Sequence
  Synthetic
gatatttcgcatgtgtttagg

SEQ ID NO: 6554 - DNA, 21 bp, Artificial Sequence
  Synthetic
gttggtcgtcctctgggtagt

SEQ ID NO: 6555 - DNA, 21 bp, Artificial Sequence
  Synthetic
agtccgcttaagccttttctg

SEQ ID NO: 6556 - DNA, 21 bp, Artificial Sequence
  Synthetic
gtgcctactaatacgtcttgg

SEQ ID NO: 6557 - DNA, 21 bp, Artificial Sequence
  Synthetic
aggacttttagtcctccttcg

SEQ ID NO: 6558 - DNA, 21 bp, Artificial Sequence
  Synthetic
tcttctattgggtggactccg

SEQ ID NO: 6559 - DNA, 21 bp, Artificial Sequence
  Synthetic
tcgggtgctaggccgtttatt

SEQ ID NO: 6560 - DNA, 21 bp, Artificial Sequence
  Synthetic
gttggtactccgtgggttgct

SEQ ID NO: 6561 - DNA, 21 bp, Artificial Sequence
  Synthetic
gttgagttttctcctcctcgt

SEQ ID NO: 6562 - DNA, 21 bp, Artificial Sequence
  Synthetic
actctgtggcggacggagggg

SEQ ID NO: 6563 - DNA, 21 bp, Artificial Sequence
  Synthetic
acgttggcgcggccgtttgcg

SEQ ID NO: 6564 - DNA, 21 bp, Artificial Sequence
  Synthetic
gcggcgcttgggtgggctgcg

SEQ ID NO: 6565 - DNA, 21 bp, Artificial Sequence
  Synthetic
gatccgtttcgtttgcagggg

SEQ ID NO: 6566 - DNA, 21 bp, Artificial Sequence
  Synthetic
gggagttttcttcctcctagt

SEQ ID NO: 6567 - DNA, 21 bp, Artificial Sequence
  Synthetic
catagtagtggttgggttgct

SEQ ID NO: 6568 - DNA, 21 bp, Artificial Sequence
  Synthetic
cctcctattgctcagagtttg

SEQ ID NO: 6569 - DNA, 21 bp, Artificial Sequence
  Synthetic
aatgcttttggtccgcatctt

SEQ ID NO: 6570 - DNA, 21 bp, Artificial Sequence
  Synthetic
ttggatccgattccgtttaag

SEQ ID NO: 6571 - DNA, 21 bp, Artificial Sequence
  Synthetic
tggactaagttgggtagtgtg

SEQ ID NO: 6572 - DNA, 21 bp, Artificial Sequence
  Synthetic
gctacttttacgcctccgaag

SEQ ID NO: 6573 - DNA, 21 bp, Artificial Sequence
  Synthetic
tcgaggcaggggtgggcgccg

SEQ ID NO: 6574 - DNA, 21 bp, Artificial Sequence
  Synthetic
caggttcggttttcgggtatt

SEQ ID NO: 6575 - DNA, 21 bp, Artificial Sequence
  Synthetic
ccgaggattgcgatggcgctg

SEQ ID NO: 6576 - DNA, 21 bp, Artificial Sequence
  Synthetic
actatgacgtcgccttttcgt

SEQ ID NO: 6577 - DNA, 21 bp, Artificial Sequence
  Synthetic
ccggcgattgcgagtaagttg

SEQ ID NO: 6578 - DNA, 21 bp, Artificial Sequence
  Synthetic
tcgaatttgtttcataatgtg

SEQ ID NO: 6579 - DNA, 21 bp, Artificial Sequence
  Synthetic
cctcttcttgggacgcgtttg

SEQ ID NO: 6580 - DNA, 21 bp, Artificial Sequence
  Synthetic
tttcgtgataggccgtttatt

SEQ ID NO: 6581 - DNA, 21 bp, Artificial Sequence
  Synthetic
acgagggagaagccttttcag

SEQ ID NO: 6582 - DNA, 21 bp, Artificial Sequence
  Synthetic
tatggtgcttcgccttttcat

SEQ ID NO: 6583 - DNA, 21 bp, Artificial Sequence
  Synthetic
acgagtagtacgccgtttcgt

SEQ ID NO: 6584 - DNA, 21 bp, Artificial Sequence
  Synthetic
attcctggttggtatgagagg

SEQ ID NO: 6585 - DNA, 21 bp, Artificial Sequence
  Synthetic
gtgagtaatatgccttttagg

SEQ ID NO: 6586 - DNA, 21 bp, Artificial Sequence
  Synthetic
gctatttctaggactagttgg

SEQ ID NO: 6587 - DNA, 21 bp, Artificial Sequence
  Synthetic
agtattgcgaggccttttagt

SEQ ID NO: 6588 - DNA, 21 bp, Artificial Sequence
  Synthetic
ggtgagtttggttttgtgccg

SEQ ID NO: 6589 - DNA, 21 bp, Artificial Sequence
  Synthetic
atgccggttattccgactccg

SEQ ID NO: 6590 - DNA, 21 bp, Artificial Sequence
  Synthetic
gttggtaagccgctgggttat

SEQ ID NO: 6591 - DNA, 21 bp, Artificial Sequence
  Synthetic
actatgaagcagccgtttatt

SEQ ID NO: 6592 - DNA, 21 bp, Artificial Sequence
  Synthetic
cagcgggagttttgtgctctt

SEQ ID NO: 6593 - DNA, 21 bp, Artificial Sequence
  Synthetic
tatctggagaagctttttcag

SEQ ID NO: 6594 - DNA, 21 bp, Artificial Sequence
  Synthetic
gttggtaggcctcttggtgct

SEQ ID NO: 6595 - DNA, 21 bp, Artificial Sequence
  Synthetic
ggtagttttagtcctccggct

SEQ ID NO: 6596 - DNA, 21 bp, Artificial Sequence
  Synthetic
tttactttgaatagttctcgg

SEQ ID NO: 6597 - DNA, 21 bp, Artificial Sequence
  Synthetic
gatatgtttcatttgagtggg

SEQ ID NO: 6598 - DNA, 21 bp, Artificial Sequence
  Synthetic
tctgcggtttttagtcaggtg

SEQ ID NO: 6599 - DNA, 21 bp, Artificial Sequence
  Synthetic
gggacgatgggttgggcgccg

SEQ ID NO: 6600 - DNA, 21 bp, Artificial Sequence
  Synthetic
ttgctttcggctccgtttcgg

SEQ ID NO: 6601 - DNA, 21 bp, Artificial Sequence
  Synthetic
tctccgaagggttgggctccg

SEQ ID NO: 6602 - DNA, 21 bp, Artificial Sequence
  Synthetic
acgaaggattggccgtttcag

SEQ ID NO: 6603 - DNA, 21 bp, Artificial Sequence
  Synthetic
ctgggtagggcgctggggatg

SEQ ID NO: 6604 - DNA, 21 bp, Artificial Sequence
  Synthetic
ctgggggttgcgttgggtatg

SEQ ID NO: 6605 - DNA, 21 bp, Artificial Sequence
  Synthetic
cgtacgggttggcctggtgct

SEQ ID NO: 6606 - DNA, 21 bp, Artificial Sequence
  Synthetic
ggggctggttttttttctgag

SEQ ID NO: 6607 - DNA, 21 bp, Artificial Sequence
  Synthetic
aatgtttggcaggttgctggt

SEQ ID NO: 6608 - DNA, 21 bp, Artificial Sequence
  Synthetic
tttactctgaaggagcctaag

SEQ ID NO: 6609 - DNA, 21 bp, Artificial Sequence
  Synthetic
tgtcctcctgggtggtgtggg

SEQ ID NO: 6610 - DNA, 21 bp, Artificial Sequence
  Synthetic
actatggagtatatgctgggg

SEQ ID NO: 6611 - DNA, 21 bp, Artificial Sequence
  Synthetic
aaggctagttttgcttcgatt

SEQ ID NO: 6612 - DNA, 21 bp, Artificial Sequence
  Synthetic
agtcttgcgcatccttttcat

SEQ ID NO: 6613 - DNA, 21 bp, Artificial Sequence
  Synthetic
agtgcggtttttaagcatgtt

SEQ ID NO: 6614 - DNA, 21 bp, Artificial Sequence
  Synthetic
ctggggcgggctctggggcat

SEQ ID NO: 6615 - DNA, 21 bp, Artificial Sequence
  Synthetic
tctttgaatgttccttttcgt

SEQ ID NO: 6616 - DNA, 21 bp, Artificial Sequence
  Synthetic
aatatttggtatccgactggt

SEQ ID NO: 6617 - DNA, 21 bp, Artificial Sequence
  Synthetic
ttggggcgggctctgggtcat

SEQ ID NO: 6618 - DNA, 21 bp, Artificial Sequence
  Synthetic
aaggtgcagtttaaggatgtg

SEQ ID NO: 6619 - DNA, 21 bp, Artificial Sequence
  Synthetic
agggtgaagtttgagagtgtt

SEQ ID NO: 6620 - DNA, 21 bp, Artificial Sequence
  Synthetic
ctttcgtttacgccgccgcag

SEQ ID NO: 6621 - DNA, 21 bp, Artificial Sequence
  Synthetic
tctaagcagtttgcgtctgtg

SEQ ID NO: 6622 - DNA, 21 bp, Artificial Sequence
  Synthetic
ggtctgacgaggccttttacg

SEQ ID NO: 6623 - DNA, 21 bp, Artificial Sequence
  Synthetic
gctgtggagtttaagaatgtg

SEQ ID NO: 6624 - DNA, 21 bp, Artificial Sequence
  Synthetic
ggggcttttgctcctccgcag

SEQ ID NO: 6625 - DNA, 21 bp, Artificial Sequence
  Synthetic
catcctctgtggggtgatgtt

SEQ ID NO: 6626 - DNA, 21 bp, Artificial Sequence
  Synthetic
ggtattgctaagccgtttctg

SEQ ID NO: 6627 - DNA, 21 bp, Artificial Sequence
  Synthetic
tttggtttgaagttggctatt

SEQ ID NO: 6628 - DNA, 21 bp, Artificial Sequence
  Synthetic
gtgggtcgtccgttgggtgct

SEQ ID NO: 6629 - DNA, 21 bp, Artificial Sequence
  Synthetic
gtgggggctaatccgtttgtg

SEQ ID NO: 6630 - DNA, 21 bp, Artificial Sequence
  Synthetic
ggttggggtagttatgggggt

SEQ ID NO: 6631 - DNA, 21 bp, Artificial Sequence
  Synthetic
tgtctgcctgctttggggtgt

SEQ ID NO: 6632 - DNA, 21 bp, Artificial Sequence
  Synthetic
tcgagttcgcggccttttatg

SEQ ID NO: 6633 - DNA, 21 bp, Artificial Sequence
  Synthetic
agtagtcggtttgagagtgtt

SEQ ID NO: 6634 - DNA, 21 bp, Artificial Sequence
  Synthetic
aatgcgattggttgggttgcg

SEQ ID NO: 6635 - DNA, 21 bp, Artificial Sequence
  Synthetic
acggttgcgcgtccttttatt

SEQ ID NO: 6636 - DNA, 21 bp, Artificial Sequence
  Synthetic
gttcttggttcttctcggctg

SEQ ID NO: 6637 - DNA, 21 bp, Artificial Sequence
  Synthetic
agtcgttcgttttctaatgtt

SEQ ID NO: 6638 - DNA, 21 bp, Artificial Sequence
  Synthetic
ccggagatgcgtcattcgtgg

SEQ ID NO: 6639 - DNA, 21 bp, Artificial Sequence
  Synthetic
tatgggacgtctcctttttct

SEQ ID NO: 6640 - DNA, 21 bp, Artificial Sequence
  Synthetic
ggtcgtttttatccgccggag

SEQ ID NO: 6641 - DNA, 21 bp, Artificial Sequence
  Synthetic
tctaagagtttttcgatgatt

SEQ ID NO: 6642 - DNA, 21 bp, Artificial Sequence
  Synthetic
tctcgtgtgtttgcggaggtt

SEQ ID NO: 6643 - DNA, 21 bp, Artificial Sequence
  Synthetic
actgttacggctccttggcat

SEQ ID NO: 6644 - DNA, 21 bp, Artificial Sequence
  Synthetic
gatacgagtcgtccgtttctt

SEQ ID NO: 6645 - DNA, 21 bp, Artificial Sequence
  Synthetic
gtggggaggccgctggggttt

SEQ ID NO: 6646 - DNA, 21 bp, Artificial Sequence
  Synthetic
tctcctattggttggagtccg

SEQ ID NO: 6647 - DNA, 21 bp, Artificial Sequence
  Synthetic
ccgcagaatcatgtgtcttgg

SEQ ID NO: 6648 - DNA, 21 bp, Artificial Sequence
  Synthetic
atgaattctagttttcgtccg

SEQ ID NO: 6649 - DNA, 21 bp, Artificial Sequence
  Synthetic
agtcctcagcatactagttgg

SEQ ID NO: 6650 - DNA, 21 bp, Artificial Sequence
  Synthetic
agtgtgtggagggagttgggt

SEQ ID NO: 6651 - DNA, 21 bp, Artificial Sequence
  Synthetic
tcggttgtgtttcgtgaggtg

SEQ ID NO: 6652 - DNA, 21 bp, Artificial Sequence
  Synthetic
cgtgattttgcgactttgcat

SEQ ID NO: 6653 - DNA, 21 bp, Artificial Sequence
  Synthetic
tcgcttacgaagccttttaat

SEQ ID NO: 6654 - DNA, 21 bp, Artificial Sequence
  Synthetic
gtgggtaagcctttgggtact

SEQ ID NO: 6655 - DNA, 21 bp, Artificial Sequence
  Synthetic
actgcggcgagtccttttcgt

SEQ ID NO: 6656 - DNA, 21 bp, Artificial Sequence
  Synthetic
gatgttcgtgggtttattgcg

SEQ ID NO: 6657 - DNA, 21 bp, Artificial Sequence
  Synthetic
tttcttatgggggggccgcat

SEQ ID NO: 6658 - DNA, 21 bp, Artificial Sequence
  Synthetic
atggcggataggccgtggctg

SEQ ID NO: 6659 - DNA, 21 bp, Artificial Sequence
  Synthetic
tgggagcggcttggggttgtt

SEQ ID NO: 6660 - DNA, 21 bp, Artificial Sequence
  Synthetic
tatggggtgtcgccgtttagt

SEQ ID NO: 6661 - DNA, 21 bp, Artificial Sequence
  Synthetic
tttgaggggcatatttttagg

SEQ ID NO: 6662 - DNA, 21 bp, Artificial Sequence
  Synthetic
gggcagttttctcctccgagt

SEQ ID NO: 6663 - DNA, 21 bp, Artificial Sequence
  Synthetic
gtggggttttcgccgcctaag

SEQ ID NO: 6664 - DNA, 21 bp, Artificial Sequence
  Synthetic
agtgcgactaagccgtttcat

SEQ ID NO: 6665 - DNA, 21 bp, Artificial Sequence
  Synthetic
gttggtgtgccgcttgggcgg

SEQ ID NO: 6666 - DNA, 21 bp, Artificial Sequence
  Synthetic
aattcgcttcagacttcgaag

SEQ ID NO: 6667 - DNA, 21 bp, Artificial Sequence
  Synthetic
tatgagtctcggatgtttctg

SEQ ID NO: 6668 - DNA, 21 bp, Artificial Sequence
  Synthetic
gtgtgggcgggggttggttcg

SEQ ID NO: 6669 - DNA, 21 bp, Artificial Sequence
  Synthetic
aatacgatggctgcttctcgg

SEQ ID NO: 6670 - DNA, 21 bp, Artificial Sequence
  Synthetic
tttgggattaggctggctgtg

SEQ ID NO: 6671 - DNA, 21 bp, Artificial Sequence
  Synthetic
attacgcttcggacgtctgtt

SEQ ID NO: 6672 - DNA, 21 bp, Artificial Sequence
  Synthetic
agtgattggcgtggtttggtg

SEQ ID NO: 6673 - DNA, 21 bp, Artificial Sequence
  Synthetic
tctaaggtttttgagattgtg

SEQ ID NO: 6674 - DNA, 21 bp, Artificial Sequence
  Synthetic
atgaagtcttttgctgcggtt

SEQ ID NO: 6675 - DNA, 21 bp, Artificial Sequence
  Synthetic
tctagggtgggttttgtggct

SEQ ID NO: 6676 - DNA, 21 bp, Artificial Sequence
  Synthetic
tcgaaggtgtttcatgatgtg

SEQ ID NO: 6677 - DNA, 21 bp, Artificial Sequence
  Synthetic
aagcctgctgggtgggttgct

SEQ ID NO: 6678 - DNA, 21 bp, Artificial Sequence
  Synthetic
gaggtgcggtggggtattttt

SEQ ID NO: 6679 - DNA, 21 bp, Artificial Sequence
  Synthetic
gggtcgtttatgcctcctcct

SEQ ID NO: 6680 - DNA, 21 bp, Artificial Sequence
  Synthetic
tttagtcttagtacttcgagg

SEQ ID NO: 6681 - DNA, 21 bp, Artificial Sequence
  Synthetic
gcggctgtggggtgggtggct

SEQ ID NO: 6682 - DNA, 21 bp, Artificial Sequence
  Synthetic
tcgcttcgtgtgccgtttcat

SEQ ID NO: 6683 - DNA, 21 bp, Artificial Sequence
  Synthetic
tttctgcagggtgggccttat

SEQ ID NO: 6684 - DNA, 21 bp, Artificial Sequence
  Synthetic
acgatgacgaagccttttgtt

SEQ ID NO: 6685 - DNA, 21 bp, Artificial Sequence
  Synthetic
cctacgagtattaattcgtgg

SEQ ID NO: 6686 - DNA, 21 bp, Artificial Sequence
  Synthetic
acggtgtgggcgagtaatggt

SEQ ID NO: 6687 - DNA, 21 bp, Artificial Sequence
  Synthetic
aatggggttaggcttgggttt

SEQ ID NO: 6688 - DNA, 21 bp, Artificial Sequence
  Synthetic
tggcctctgcctcagtttggt

SEQ ID NO: 6689 - DNA, 21 bp, Artificial Sequence
  Synthetic
tcggttgtggggtggtcggcg

SEQ ID NO: 6690 - DNA, 21 bp, Artificial Sequence
  Synthetic
ggtgcgttttctcctcctatg

SEQ ID NO: 6691 - DNA, 21 bp, Artificial Sequence
  Synthetic
agtactactcggccttttaat

SEQ ID NO: 6692 - DNA, 21 bp, Artificial Sequence
  Synthetic
tctttgcagactccttttaag

SEQ ID NO: 6693 - DNA, 21 bp, Artificial Sequence
  Synthetic
aggcatcctgggtgggtggct

SEQ ID NO: 6694 - DNA, 21 bp, Artificial Sequence
  Synthetic
ttgggtatggcgctggggcgg

SEQ ID NO: 6695 - DNA, 21 bp, Artificial Sequence
  Synthetic
cagcctgatatggggctttgg

SEQ ID NO: 6696 - DNA, 21 bp, Artificial Sequence
  Synthetic
ctgggtctgcttcggactcct

SEQ ID NO: 6697 - DNA, 21 bp, Artificial Sequence
  Synthetic
acggtgtggaagatggctggg

SEQ ID NO: 6698 - DNA, 21 bp, Artificial Sequence
  Synthetic
ccgtttattaatggttcgggt

SEQ ID NO: 6699 - DNA, 21 bp, Artificial Sequence
  Synthetic
aatcctattgggtgggcggcg

SEQ ID NO: 6700 - DNA, 21 bp, Artificial Sequence
  Synthetic
actgtttggcgtgctgatggg

SEQ ID NO: 6701 - DNA, 21 bp, Artificial Sequence
  Synthetic
gttgagcctttgccgtttcgt

SEQ ID NO: 6702 - DNA, 21 bp, Artificial Sequence
  Synthetic
gggaggctgcctgttatgccg

SEQ ID NO: 6703 - DNA, 21 bp, Artificial Sequence
  Synthetic
tatacggggaagccttttcag

SEQ ID NO: 6704 - DNA, 21 bp, Artificial Sequence
  Synthetic
agtgcgattaagccttttctt

SEQ ID NO: 6705 - DNA, 21 bp, Artificial Sequence
  Synthetic
tcgctgcgtatgccttttagt

SEQ ID NO: 6706 - DNA, 21 bp, Artificial Sequence
  Synthetic
gattcgttttttcctccgaag

SEQ ID NO: 6707 - DNA, 21 bp, Artificial Sequence
  Synthetic
agtcttaggtttgaggctgtg

SEQ ID NO: 6708 - DNA, 21 bp, Artificial Sequence
  Synthetic
gttgataattttgctatttgt

SEQ ID NO: 6709 - DNA, 21 bp, Artificial Sequence
  Synthetic
cctgagaatgctctgtcgtgg

SEQ ID NO: 6710 - DNA, 21 bp, Artificial Sequence
  Synthetic
tatcaggggcatctgtttgct

SEQ ID NO: 6711 - DNA, 21 bp, Artificial Sequence
  Synthetic
tcggcttggggtccgttgtct

SEQ ID NO: 6712 - DNA, 21 bp, Artificial Sequence
  Synthetic
actatttggagtaagattggt

SEQ ID NO: 6713 - DNA, 21 bp, Artificial Sequence
  Synthetic
gttgggatgccgttggggaag

SEQ ID NO: 6714 - DNA, 21 bp, Artificial Sequence
  Synthetic
gataagatttttcgtctgggt

SEQ ID NO: 6715 - DNA, 21 bp, Artificial Sequence
  Synthetic
tgggataggtctgggccgtat

SEQ ID NO: 6716 - DNA, 21 bp, Artificial Sequence
  Synthetic
tttactactctttatccgaag

SEQ ID NO: 6717 - DNA, 21 bp, Artificial Sequence
  Synthetic
atgcatgataagccttggatt

SEQ ID NO: 6718 - DNA, 21 bp, Artificial Sequence
  Synthetic
catcagattgggtggattggt

SEQ ID NO: 6719 - DNA, 21 bp, Artificial Sequence
  Synthetic
tttactcagagtactccgcgt

SEQ ID NO: 6720 - DNA, 21 bp, Artificial Sequence
  Synthetic
acgaatcagcagccttggctg

SEQ ID NO: 6721 - DNA, 21 bp, Artificial Sequence
  Synthetic
gatttgcataggccttttcat

SEQ ID NO: 6722 - DNA, 21 bp, Artificial Sequence
  Synthetic
tgggatgctgcggggccgagg

SEQ ID NO: 6723 - DNA, 21 bp, Artificial Sequence
  Synthetic
tctgttttgcagccttttagg

SEQ ID NO: 6724 - DNA, 21 bp, Artificial Sequence
  Synthetic
gatctttggaggcgtgatggt

SEQ ID NO: 6725 - DNA, 21 bp, Artificial Sequence
  Synthetic
ggtgattttgctcatcctcgg

SEQ ID NO: 6726 - DNA, 21 bp, Artificial Sequence
  Synthetic
acgcttattccgcttcatcgg

SEQ ID NO: 6727 - DNA, 21 bp, Artificial Sequence
  Synthetic
ttgactatgtcgacttctcgg

SEQ ID NO: 6728 - DNA, 21 bp, Artificial Sequence
  Synthetic
ttgggggttcggcttggtgtg

SEQ ID NO: 6729 - DNA, 21 bp, Artificial Sequence
  Synthetic
gagcagtctcgtccgtttctg

SEQ ID NO: 6730 - DNA, 21 bp, Artificial Sequence
  Synthetic
tcggcgtggggtacggcgcat

SEQ ID NO: 6731 - DNA, 21 bp, Artificial Sequence
  Synthetic
acgctgtggcgggagggtggt

SEQ ID NO: 6732 - DNA, 21 bp, Artificial Sequence
  Synthetic
ggtgagatgaggccttttctt

SEQ ID NO: 6733 - DNA, 21 bp, Artificial Sequence
  Synthetic
ttgcctgaggcgccgtttcgg

SEQ ID NO: 6734 - DNA, 21 bp, Artificial Sequence
  Synthetic
tctaatatgggttttgttgct

SEQ ID NO: 6735 - DNA, 21 bp, Artificial Sequence
  Synthetic
cctctgaataatacgagttgg

SEQ ID NO: 6736 - DNA, 21 bp, Artificial Sequence
  Synthetic
cttggtaggccgctgggtgct

SEQ ID NO: 6737 - DNA, 21 bp, Artificial Sequence
  Synthetic
ggtatttggttgcctcatggg

SEQ ID NO: 6738 - DNA, 21 bp, Artificial Sequence
  Synthetic
tctttgcgtttgccgtttcag

SEQ ID NO: 6739 - DNA, 21 bp, Artificial Sequence
  Synthetic
cagacggcttttaataggatt

SEQ ID NO: 6740 - DNA, 21 bp, Artificial Sequence
  Synthetic
tatggtgatcagctttttcgg

SEQ ID NO: 6741 - DNA, 21 bp, Artificial Sequence
  Synthetic
ccgaaggcttttgctcttgtg

SEQ ID NO: 6742 - DNA, 21 bp, Artificial Sequence
  Synthetic
aatactatgagtacttcgcgg

SEQ ID NO: 6743 - DNA, 21 bp, Artificial Sequence
  Synthetic
gggcaggagcagttttttagg

SEQ ID NO: 6744 - DNA, 21 bp, Artificial Sequence
  Synthetic
gggcgtgaggggtggattcct

SEQ ID NO: 6745 - DNA, 21 bp, Artificial Sequence
  Synthetic
gctgatcagatttgggtggct

SEQ ID NO: 6746 - DNA, 21 bp, Artificial Sequence
  Synthetic
tatgatgctaggccgtttttg

SEQ ID NO: 6747 - DNA, 21 bp, Artificial Sequence
  Synthetic
agtgtgctggggtgggctcct

SEQ ID NO: 6748 - DNA, 21 bp, Artificial Sequence
  Synthetic
ttggatccgttgccttttcag

SEQ ID NO: 6749 - DNA, 21 bp, Artificial Sequence
  Synthetic
agtgctaagttgccgtttctt

SEQ ID NO: 6750 - DNA, 21 bp, Artificial Sequence
  Synthetic
agtcattggggggagcgggtt

SEQ ID NO: 6751 - DNA, 21 bp, Artificial Sequence
  Synthetic
ggtccgtttgggcctcagtat

SEQ ID NO: 6752 - DNA, 21 bp, Artificial Sequence
  Synthetic
tggggtgcgatgccttttcag

SEQ ID NO: 6753 - DNA, 21 bp, Artificial Sequence
  Synthetic
ggtgtgtttaatcctcctacg

SEQ ID NO: 6754 - DNA, 21 bp, Artificial Sequence
  Synthetic
ctgggtagggcgctggggacg

SEQ ID NO: 6755 - DNA, 21 bp, Artificial Sequence
  Synthetic
acggtgcttaatccttttatt

SEQ ID NO: 6756 - DNA, 21 bp, Artificial Sequence
  Synthetic
actgggggtaggccttttatt

SEQ ID NO: 6757 - DNA, 21 bp, Artificial Sequence
  Synthetic
gtggtttttgagtcgccgagg

SEQ ID NO: 6758 - DNA, 21 bp, Artificial Sequence
  Synthetic
actcttagggatccgtggctg

SEQ ID NO: 6759 - DNA, 21 bp, Artificial Sequence
  Synthetic
atgaagcttgattttaagccg

SEQ ID NO: 6760 - DNA, 21 bp, Artificial Sequence
  Synthetic
ccggtggatagggcgacgtgg

SEQ ID NO: 6761 - DNA, 21 bp, Artificial Sequence
  Synthetic
tatggtcagcagtattttttg

SEQ ID NO: 6762 - DNA, 21 bp, Artificial Sequence
  Synthetic
actttgagtcatccgtttgtg

SEQ ID NO: 6763 - DNA, 21 bp, Artificial Sequence
  Synthetic
atgcagcgtccgatgcttgtg

SEQ ID NO: 6764 - DNA, 21 bp, Artificial Sequence
  Synthetic
tcgcattggggtgagatgaag

SEQ ID NO: 6765 - DNA, 21 bp, Artificial Sequence
  Synthetic
tctgtgtgggatggtgggggt

SEQ ID NO: 6766 - DNA, 21 bp, Artificial Sequence
  Synthetic
acgccgagtagtccgtttcgg

SEQ ID NO: 6767 - DNA, 21 bp, Artificial Sequence
  Synthetic
actgctgggtggggggctgcg

SEQ ID NO: 6768 - DNA, 21 bp, Artificial Sequence
  Synthetic
tatgatgggcggccttgggcg

SEQ ID NO: 6769 - DNA, 21 bp, Artificial Sequence
  Synthetic
tctgtttcgctgccttttcgg

SEQ ID NO: 6770 - DNA, 21 bp, Artificial Sequence
  Synthetic
tctgagacgaagccgtggcat

SEQ ID NO: 6771 - DNA, 21 bp, Artificial Sequence
  Synthetic
ttgggtaggccgctggggacg

SEQ ID NO: 6772 - DNA, 21 bp, Artificial Sequence
  Synthetic
gcgggtgtgcgtcttggtctt

SEQ ID NO: 6773 - DNA, 21 bp, Artificial Sequence
  Synthetic
actgagttggcgtattttaag

SEQ ID NO: 6774 - DNA, 21 bp, Artificial Sequence
  Synthetic
actccgtggtatgcgacgggt

SEQ ID NO: 6775 - DNA, 21 bp, Artificial Sequence
  Synthetic
tcggctgggactccgtttcgg

SEQ ID NO: 6776 - DNA, 21 bp, Artificial Sequence
  Synthetic
cgggattttagtcctcctcag

SEQ ID NO: 6777 - DNA, 21 bp, Artificial Sequence
  Synthetic
aatgtttggtcgagtgttggg

SEQ ID NO: 6778 - DNA, 21 bp, Artificial Sequence
  Synthetic
gctgtttggttgccgcatggg

SEQ ID NO: 6779 - DNA, 21 bp, Artificial Sequence
  Synthetic
gcgctgccgcatggttggcag

SEQ ID NO: 6780 - DNA, 21 bp, Artificial Sequence
  Synthetic
aagagttgtggtatggcgtgt

SEQ ID NO: 6781 - DNA, 21 bp, Artificial Sequence
  Synthetic
tcgattgcgggttgggtggct

SEQ ID NO: 6782 - DNA, 21 bp, Artificial Sequence
  Synthetic
gagactggttggcatcctgcg

SEQ ID NO: 6783 - DNA, 21 bp, Artificial Sequence
  Synthetic
tttacgcttaattctccgagg

SEQ ID NO: 6784 - DNA, 21 bp, Artificial Sequence
  Synthetic
gatgggtttgggtttcatcct

SEQ ID NO: 6785 - DNA, 21 bp, Artificial Sequence
  Synthetic
ttgacgcttatgacttcgatt

SEQ ID NO: 6786 - DNA, 21 bp, Artificial Sequence
  Synthetic
gatgtttggagggctgagggg

SEQ ID NO: 6787 - DNA, 21 bp, Artificial Sequence
  Synthetic
actacgcgggcgccttttatg

SEQ ID NO: 6788 - DNA, 21 bp, Artificial Sequence
  Synthetic
acgactgctttgccgtttcgg

SEQ ID NO: 6789 - DNA, 21 bp, Artificial Sequence
  Synthetic
acgactactcattggactcct

SEQ ID NO: 6790 - DNA, 21 bp, Artificial Sequence
  Synthetic
gattggaggggtgttcagcat

SEQ ID NO: 6791 - DNA, 21 bp, Artificial Sequence
  Synthetic
gtgggggtgtatcctccgaag

SEQ ID NO: 6792 - DNA, 21 bp, Artificial Sequence
  Synthetic
tctgttcggttttctgaggtt

SEQ ID NO: 6793 - DNA, 21 bp, Artificial Sequence
  Synthetic
gctccgcagcagccttggttg

SEQ ID NO: 6794 - DNA, 21 bp, Artificial Sequence
  Synthetic
gttcctgggtggtatcctgat

SEQ ID NO: 6795 - DNA, 21 bp, Artificial Sequence
  Synthetic
actaggagtaatccgtttggt

SEQ ID NO: 6796 - DNA, 21 bp, Artificial Sequence
  Synthetic
gatggtgggatttggattgct

SEQ ID NO: 6797 - DNA, 21 bp, Artificial Sequence
  Synthetic
ggggtgtggtatccgaatggg

SEQ ID NO: 6798 - DNA, 21 bp, Artificial Sequence
  Synthetic
gtttcgtttagtcctccgagt

SEQ ID NO: 6799 - DNA, 21 bp, Artificial Sequence
  Synthetic
atgcgggctggttttacggtt

SEQ ID NO: 6800 - DNA, 21 bp, Artificial Sequence
  Synthetic
aatatgtgggatgctgggggt

SEQ ID NO: 6801 - DNA, 21 bp, Artificial Sequence
  Synthetic
attgggtcgcttccgtttcgt

SEQ ID NO: 6802 - DNA, 21 bp, Artificial Sequence
  Synthetic
attagggagtggccgaatccg

SEQ ID NO: 6803 - DNA, 21 bp, Artificial Sequence
  Synthetic
tgggatactgctgggccgcgg

SEQ ID NO: 6804 - DNA, 21 bp, Artificial Sequence
  Synthetic
gatgtgtttaagttgtcgggt

SEQ ID NO: 6805 - DNA, 21 bp, Artificial Sequence
  Synthetic
actgagcagcgtccgtttctt

SEQ ID NO: 6806 - DNA, 21 bp, Artificial Sequence
  Synthetic
cttgggacgccgttggggaag

SEQ ID NO: 6807 - DNA, 21 bp, Artificial Sequence
  Synthetic
tcggctatgggttgggcgccg

SEQ ID NO: 6808 - DNA, 21 bp, Artificial Sequence
  Synthetic
agtcgtactttttcgagtgtg

SEQ ID NO: 6809 - DNA, 21 bp, Artificial Sequence
  Synthetic
tatgagctgaattattttcat

SEQ ID NO: 6810 - DNA, 21 bp, Artificial Sequence
  Synthetic
tatggggagcgtctttttttg

SEQ ID NO: 6811 - DNA, 21 bp, Artificial Sequence
  Synthetic
tcgccgcctcagccgtggctt

SEQ ID NO: 6812 - DNA, 21 bp, Artificial Sequence
  Synthetic
actactgcgctgccgtttctt

SEQ ID NO: 6813 - DNA, 21 bp, Artificial Sequence
  Synthetic
gctttgaggtttgaggctgtt

SEQ ID NO: 6814 - DNA, 21 bp, Artificial Sequence
  Synthetic
gggcgtgattggccgtatgcg

SEQ ID NO: 6815 - DNA, 21 bp, Artificial Sequence
  Synthetic
tcgcatgttttttcggctgtg

SEQ ID NO: 6816 - DNA, 21 bp, Artificial Sequence
  Synthetic
tttggtgattcgccgtttcgg

SEQ ID NO: 6817 - DNA, 21 bp, Artificial Sequence
  Synthetic
acggatactcggccgtttttg

SEQ ID NO: 6818 - DNA, 21 bp, Artificial Sequence
  Synthetic
tatgatgggaattattttgtt

SEQ ID NO: 6819 - DNA, 21 bp, Artificial Sequence
  Synthetic
ggtgattatggttttttgcct

SEQ ID NO: 6820 - DNA, 21 bp, Artificial Sequence
  Synthetic
atggttaagtttgagcaggtt

SEQ ID NO: 6821 - DNA, 21 bp, Artificial Sequence
  Synthetic
cagacgagttttgctgcggtg

SEQ ID NO: 6822 - DNA, 21 bp, Artificial Sequence
  Synthetic
gggaagggtccgtggttgcct

SEQ ID NO: 6823 - DNA, 21 bp, Artificial Sequence
  Synthetic
acggctgttcgtccgtttgtg

SEQ ID NO: 6824 - DNA, 21 bp, Artificial Sequence
  Synthetic
actgcttttcagcctccgagg

SEQ ID NO: 6825 - DNA, 21 bp, Artificial Sequence
  Synthetic
cagaggatttttgcggatgtt

SEQ ID NO: 6826 - DNA, 21 bp, Artificial Sequence
  Synthetic
tctattcctaggccttttcct

SEQ ID NO: 6827 - DNA, 21 bp, Artificial Sequence
  Synthetic
acgattcgtgagccttggctg

SEQ ID NO: 6828 - DNA, 21 bp, Artificial Sequence
  Synthetic
gagccgcatacgatttcgtgg

SEQ ID NO: 6829 - DNA, 21 bp, Artificial Sequence
  Synthetic
gatccgtttaggccgcagggg

SEQ ID NO: 6830 - DNA, 21 bp, Artificial Sequence
  Synthetic
atgcctgttaaggggtgggtt

SEQ ID NO: 6831 - DNA, 21 bp, Artificial Sequence
  Synthetic
tggactatggagtatcctttg

SEQ ID NO: 6832 - DNA, 21 bp, Artificial Sequence
  Synthetic
actaagcgttatcctattccg

SEQ ID NO: 6833 - DNA, 21 bp, Artificial Sequence
  Synthetic
acgccgcaggttccgtttaag

SEQ ID NO: 6834 - DNA, 21 bp, Artificial Sequence
  Synthetic
tggtctttgaagactagtgtg

SEQ ID NO: 6835 - DNA, 21 bp, Artificial Sequence
  Synthetic
attactatgtcgacgtctaag

SEQ ID NO: 6836 - DNA, 21 bp, Artificial Sequence
  Synthetic
gttcaggggtggtataatgag

SEQ ID NO: 6837 - DNA, 21 bp, Artificial Sequence
  Synthetic
tttcatggtgcggcgtttctt

SEQ ID NO: 6838 - DNA, 21 bp, Artificial Sequence
  Synthetic
attgagtttactcctcctagg

SEQ ID NO: 6839 - DNA, 21 bp, Artificial Sequence
  Synthetic
acgtctgatcggccgtttcag

SEQ ID NO: 6840 - DNA, 21 bp, Artificial Sequence
  Synthetic
ccgctttcttttaagaatgtt

SEQ ID NO: 6841 - DNA, 21 bp, Artificial Sequence
  Synthetic
acggtggcgaagccgtttcat

SEQ ID NO: 6842 - DNA, 21 bp, Artificial Sequence
  Synthetic
tcgagttgtggtgttgtttgt

SEQ ID NO: 6843 - DNA, 21 bp, Artificial Sequence
  Synthetic
gatgttactaggccttttctt

SEQ ID NO: 6844 - DNA, 21 bp, Artificial Sequence
  Synthetic
gttggggttccgattgggcgg

SEQ ID NO: 6845 - DNA, 21 bp, Artificial Sequence
  Synthetic
tatcaggatagggtgtttttg

SEQ ID NO: 6846 - DNA, 21 bp, Artificial Sequence
  Synthetic
aattcgtttagtcctccgcgt

SEQ ID NO: 6847 - DNA, 21 bp, Artificial Sequence
  Synthetic
ggttctcttgggtgggcgccg

SEQ ID NO: 6848 - DNA, 21 bp, Artificial Sequence
  Synthetic
tctcttcgttatccgattccg

SEQ ID NO: 6849 - DNA, 21 bp, Artificial Sequence
  Synthetic
gatgtttttaggcttgctggg

SEQ ID NO: 6850 - DNA, 21 bp, Artificial Sequence
  Synthetic
tttccgaattggacgtctccg

SEQ ID NO: 6851 - DNA, 21 bp, Artificial Sequence
  Synthetic
tctactgataggccgtggctg

SEQ ID NO: 6852 - DNA, 21 bp, Artificial Sequence
  Synthetic
gatctgagtaggccgtttgtt

SEQ ID NO: 6853 - DNA, 21 bp, Artificial Sequence
  Synthetic
aatacgttttctcctccgagt

SEQ ID NO: 6854 - DNA, 21 bp, Artificial Sequence
  Synthetic
ggtgttacgcgtccttttatt

SEQ ID NO: 6855 - DNA, 21 bp, Artificial Sequence
  Synthetic
gagggtgtgcgtttggggctg

SEQ ID NO: 6856 - DNA, 21 bp, Artificial Sequence
  Synthetic
tcgactttttcgcctcctcgg

SEQ ID NO: 6857 - DNA, 21 bp, Artificial Sequence
  Synthetic
ggtagggctgggtgggtggct

SEQ ID NO: 6858 - DNA, 21 bp, Artificial Sequence
  Synthetic
ggtgagtggagtccgcctaag

SEQ ID NO: 6859 - DNA, 21 bp, Artificial Sequence
  Synthetic
actactgttgctccttttcgg

SEQ ID NO: 6860 - DNA, 21 bp, Artificial Sequence
  Synthetic
aatgcgtggggtattgcgcat

SEQ ID NO: 6861 - DNA, 21 bp, Artificial Sequence
  Synthetic
gttcagactttttgtacgggg

SEQ ID NO: 6862 - DNA, 21 bp, Artificial Sequence
  Synthetic
tctgttaataatccttttaag

SEQ ID NO: 6863 - DNA, 21 bp, Artificial Sequence
  Synthetic
gcgcttagtggttgggtggct

SEQ ID NO: 6864 - DNA, 21 bp, Artificial Sequence
  Synthetic
aattctctgagtacttctcgg

SEQ ID NO: 6865 - DNA, 21 bp, Artificial Sequence
  Synthetic
ccgtataagtttaatattgat

SEQ ID NO: 6866 - DNA, 21 bp, Artificial Sequence
  Synthetic
ttgccggatcggccttttatg

SEQ ID NO: 6867 - DNA, 21 bp, Artificial Sequence
  Synthetic
gcgggtttttcgcctcctgtg

SEQ ID NO: 6868 - DNA, 21 bp, Artificial Sequence
  Synthetic
actagtaattggcctggttct

SEQ ID NO: 6869 - DNA, 21 bp, Artificial Sequence
  Synthetic
agtgctgttggttgggctgct

SEQ ID NO: 6870 - DNA, 21 bp, Artificial Sequence
  Synthetic
gtgggtgtggcgctggggctt

SEQ ID NO: 6871 - DNA, 21 bp, Artificial Sequence
  Synthetic
atgcctcctttttttcagcag

SEQ ID NO: 6872 - DNA, 21 bp, Artificial Sequence
  Synthetic
ggtaattatggttttgtgccg

SEQ ID NO: 6873 - DNA, 21 bp, Artificial Sequence
  Synthetic
ggggcttgggtggtgcaggct

SEQ ID NO: 6874 - DNA, 21 bp, Artificial Sequence
  Synthetic
ttgaagcatgggtttacggtg

SEQ ID NO: 6875 - DNA, 21 bp, Artificial Sequence
  Synthetic
tctgcgcttgggtgggctcct

SEQ ID NO: 6876 - DNA, 21 bp, Artificial Sequence
  Synthetic
gatccttttaggaagagtggg

SEQ ID NO: 6877 - DNA, 21 bp, Artificial Sequence
  Synthetic
attgggactacgccgtttagg

SEQ ID NO: 6878 - DNA, 21 bp, Artificial Sequence
  Synthetic
acgggtgtgaaggggattttt

SEQ ID NO: 6879 - DNA, 21 bp, Artificial Sequence
  Synthetic
tatcagcagcgttattttgcg

SEQ ID NO: 6880 - DNA, 21 bp, Artificial Sequence
  Synthetic
gctagtacttttgggactttt

SEQ ID NO: 6881 - DNA, 21 bp, Artificial Sequence
  Synthetic
agtacggatcgtccttttaag

SEQ ID NO: 6882 - DNA, 21 bp, Artificial Sequence
  Synthetic
tcgtcgtcttttaagaatgtt

SEQ ID NO: 6883 - DNA, 21 bp, Artificial Sequence
  Synthetic
atgttgagtaagccgtttttg

SEQ ID NO: 6884 - DNA, 21 bp, Artificial Sequence
  Synthetic
aatcctgctgggtgggtgccg

SEQ ID NO: 6885 - DNA, 21 bp, Artificial Sequence
  Synthetic
aatccttctaatacgtcgtgg

SEQ ID NO: 6886 - DNA, 21 bp, Artificial Sequence
  Synthetic
acggtttggtcgcagacgggt

SEQ ID NO: 6887 - DNA, 21 bp, Artificial Sequence
  Synthetic
gtgggtgtgcagctgggttgt

SEQ ID NO: 6888 - DNA, 21 bp, Artificial Sequence
  Synthetic
attgatggttggtttgttaag

SEQ ID NO: 6889 - DNA, 21 bp, Artificial Sequence
  Synthetic
acggtggataggccttttgtt

SEQ ID NO: 6890 - DNA, 21 bp, Artificial Sequence
  Synthetic
tctctgacgcttccgtttaag

SEQ ID NO: 6891 - DNA, 21 bp, Artificial Sequence
  Synthetic
gttgggaagcctttggggcag

SEQ ID NO: 6892 - DNA, 21 bp, Artificial Sequence
  Synthetic
gatcctgtgtttcgtatggct

SEQ ID NO: 6893 - DNA, 21 bp, Artificial Sequence
  Synthetic
tcgtcggtttttagggaggtg

SEQ ID NO: 6894 - DNA, 21 bp, Artificial Sequence
  Synthetic
gtgggtcctatgccgtttctg

SEQ ID NO: 6895 - DNA, 21 bp, Artificial Sequence
  Synthetic
tggactatggagaatcctaag

SEQ ID NO: 6896 - DNA, 21 bp, Artificial Sequence
  Synthetic
tatgttgatcatatttttcgg

SEQ ID NO: 6897 - DNA, 21 bp, Artificial Sequence
  Synthetic
gggagttttagtccgcctacg

SEQ ID NO: 6898 - DNA, 21 bp, Artificial Sequence
  Synthetic
gggttgcttggttttgttgct

SEQ ID NO: 6899 - DNA, 21 bp, Artificial Sequence
  Synthetic
gttgcttttgagaatcctcgg

SEQ ID NO: 6900 - DNA, 21 bp, Artificial Sequence
  Synthetic
agtcttggtggttgggtggct

SEQ ID NO: 6901 - DNA, 21 bp, Artificial Sequence
  Synthetic
ggggtttggttgcctccggag

SEQ ID NO: 6902 - DNA, 21 bp, Artificial Sequence
  Synthetic
tctgagtttattccgccgagg

SEQ ID NO: 6903 - DNA, 21 bp, Artificial Sequence
  Synthetic
gatttgagtcatgtgtttcgt

SEQ ID NO: 6904 - DNA, 21 bp, Artificial Sequence
  Synthetic
gtggggagtttttgtcatgct

SEQ ID NO: 6905 - DNA, 21 bp, Artificial Sequence
  Synthetic
actactgataatccttttcgg

SEQ ID NO: 6906 - DNA, 21 bp, Artificial Sequence
  Synthetic
tcggttattggttgggctcct

SEQ ID NO: 6907 - DNA, 21 bp, Artificial Sequence
  Synthetic
agtgtgtctaggccttttatt

SEQ ID NO: 6908 - DNA, 21 bp, Artificial Sequence
  Synthetic
tcgagtttggggtgggctgcg

SEQ ID NO: 6909 - DNA, 21 bp, Artificial Sequence
  Synthetic
aaggttaattttggggatttt

SEQ ID NO: 6910 - DNA, 21 bp, Artificial Sequence
  Synthetic
gtgggtctggctccgccgaag

SEQ ID NO: 6911 - DNA, 21 bp, Artificial Sequence
  Synthetic
acgccgcgggctcctttttat

SEQ ID NO: 6912 - DNA, 21 bp, Artificial Sequence
  Synthetic
actttgagtcgtcctctgttg

SEQ ID NO: 6913 - DNA, 21 bp, Artificial Sequence
  Synthetic
acggctagtactccttggctt

SEQ ID NO: 6914 - DNA, 21 bp, Artificial Sequence
  Synthetic
aggaagacttttgagaatgtg

SEQ ID NO: 6915 - DNA, 21 bp, Artificial Sequence
  Synthetic
tttactttggctgctcctaag

SEQ ID NO: 6916 - DNA, 21 bp, Artificial Sequence
  Synthetic
agtcggacttttgagagggtg

SEQ ID NO: 6917 - DNA, 21 bp, Artificial Sequence
  Synthetic
tcgattggggctccgtttcgg

SEQ ID NO: 6918 - DNA, 21 bp, Artificial Sequence
  Synthetic
gttggttttgttcctcctatg

SEQ ID NO: 6919 - DNA, 21 bp, Artificial Sequence
  Synthetic
gcttttaagtttgcggatgtt

SEQ ID NO: 6920 - DNA, 21 bp, Artificial Sequence
  Synthetic
tctgagtggacgcctccgatg

SEQ ID NO: 6921 - DNA, 21 bp, Artificial Sequence
  Synthetic
tctgctacgcggccttttgtt

SEQ ID NO: 6922 - DNA, 21 bp, Artificial Sequence
  Synthetic
ttggtgtttcaggagccgcgg

SEQ ID NO: 6923 - DNA, 21 bp, Artificial Sequence
  Synthetic
tctttggctgtgccttttaag

SEQ ID NO: 6924 - DNA, 21 bp, Artificial Sequence
  Synthetic
gtggcggcgctgccttttcgg

SEQ ID NO: 6925 - DNA, 21 bp, Artificial Sequence
  Synthetic
tcggggtcgttttgtacggcg

SEQ ID NO: 6926 - DNA, 21 bp, Artificial Sequence
  Synthetic
actaatattgggtttgcggcg

SEQ ID NO: 6927 - DNA, 21 bp, Artificial Sequence
  Synthetic
ttgtctactcgtccgtttatt

SEQ ID NO: 6928 - DNA, 21 bp, Artificial Sequence
  Synthetic
agttcggtgggttggctggct

SEQ ID NO: 6929 - DNA, 21 bp, Artificial Sequence
  Synthetic
gtgctgggttggtatgctgag

SEQ ID NO: 6930 - DNA, 21 bp, Artificial Sequence
  Synthetic
gggctggataagccgtttctt

SEQ ID NO: 6931 - DNA, 21 bp, Artificial Sequence
  Synthetic
gcggggcagatttggagtccg

SEQ ID NO: 6932 - DNA, 21 bp, Artificial Sequence
  Synthetic
ggtcattttacgccgcctgct

SEQ ID NO: 6933 - DNA, 21 bp, Artificial Sequence
  Synthetic
gttctggggagtgctaggctt

SEQ ID NO: 6934 - DNA, 21 bp, Artificial Sequence
  Synthetic
aagaaggctttttcggatatt

SEQ ID NO: 6935 - DNA, 21 bp, Artificial Sequence
  Synthetic
attcagcataatttgtcgttt

SEQ ID NO: 6936 - DNA, 21 bp, Artificial Sequence
  Synthetic
cctaatcatgctatttcgtgg

SEQ ID NO: 6937 - DNA, 21 bp, Artificial Sequence
  Synthetic
gagggggttaggcttggttat

SEQ ID NO: 6938 - DNA, 21 bp, Artificial Sequence
  Synthetic
caggttgagtttgctcatgtt

SEQ ID NO: 6939 - DNA, 21 bp, Artificial Sequence
  Synthetic
tatgaggggaggccttttgtg

SEQ ID NO: 6940 - DNA, 21 bp, Artificial Sequence
  Synthetic
ccgactcatactgtgagttgg

SEQ ID NO: 6941 - DNA, 21 bp, Artificial Sequence
  Synthetic
gcgattgcgcggccttttgct

SEQ ID NO: 6942 - DNA, 21 bp, Artificial Sequence
  Synthetic
actgtgctgcctcagaggatg

SEQ ID NO: 6943 - DNA, 21 bp, Artificial Sequence
  Synthetic
gatgttactaggccttggatt

SEQ ID NO: 6944 - DNA, 21 bp, Artificial Sequence
  Synthetic
gttgggtttagtcctcctgct

SEQ ID NO: 6945 - DNA, 21 bp, Artificial Sequence
  Synthetic
actctttttcgtgagtttggg

SEQ ID NO: 6946 - DNA, 21 bp, Artificial Sequence
  Synthetic
catgtgttgactgggtggcag

SEQ ID NO: 6947 - DNA, 21 bp, Artificial Sequence
  Synthetic
agtgtgagtcggccttttatg

SEQ ID NO: 6948 - DNA, 21 bp, Artificial Sequence
  Synthetic
actgatgagcgtccttttagg

SEQ ID NO: 6949 - DNA, 21 bp, Artificial Sequence
  Synthetic
tatgattttaagagtcctcgg

SEQ ID NO: 6950 - DNA, 21 bp, Artificial Sequence
  Synthetic
actacgttgacggtttcgcgg

SEQ ID NO: 6951 - DNA, 21 bp, Artificial Sequence
  Synthetic
tgggatcttgagtatgctcgt

SEQ ID NO: 6952 - DNA, 21 bp, Artificial Sequence
  Synthetic
agtgttactaatgtttttaag

SEQ ID NO: 6953 - DNA, 21 bp, Artificial Sequence
  Synthetic
tatgagaggcatccgtttaat

SEQ ID NO: 6954 - DNA, 21 bp, Artificial Sequence
  Synthetic
agtacgactagtccttttcgg

SEQ ID NO: 6955 - DNA, 21 bp, Artificial Sequence
  Synthetic
ttgacgttgcgtagttcggtg

SEQ ID NO: 6956 - DNA, 21 bp, Artificial Sequence
  Synthetic
gctaatgctggttgggttgct

SEQ ID NO: 6957 - DNA, 21 bp, Artificial Sequence
  Synthetic
tttccgatgaatcgtagtgtg

SEQ ID NO: 6958 - DNA, 21 bp, Artificial Sequence
  Synthetic
agtctgcttgcgccgtttgtg

SEQ ID NO: 6959 - DNA, 21 bp, Artificial Sequence
  Synthetic
cagtatcggtttgcggatgtt

SEQ ID NO: 6960 - DNA, 21 bp, Artificial Sequence
  Synthetic
tctatgttgaggccgtttgag

SEQ ID NO: 6961 - DNA, 21 bp, Artificial Sequence
  Synthetic
agggtgtgtggtgttgtttgt

SEQ ID NO: 6962 - DNA, 21 bp, Artificial Sequence
  Synthetic
agtaataggtttgaggttgtg

SEQ ID NO: 6963 - DNA, 21 bp, Artificial Sequence
  Synthetic
catacgtggctgcctcctgag

SEQ ID NO: 6964 - DNA, 21 bp, Artificial Sequence
  Synthetic
aagctgggttatgagattctt

SEQ ID NO: 6965 - DNA, 21 bp, Artificial Sequence
  Synthetic
gggacttgggcgggtgggggt

SEQ ID NO: 6966 - DNA, 21 bp, Artificial Sequence
  Synthetic
tggaagaatcttggttcggtt

SEQ ID NO: 6967 - DNA, 21 bp, Artificial Sequence
  Synthetic
caggttcattttacgaagatg

SEQ ID NO: 6968 - DNA, 21 bp, Artificial Sequence
  Synthetic
ctggggcttccgtatacgtat

SEQ ID NO: 6969 - DNA, 21 bp, Artificial Sequence
  Synthetic
gttgggatgagtccgcctagg

SEQ ID NO: 6970 - DNA, 21 bp, Artificial Sequence
  Synthetic
ggtgcttggaatcctccgaat

SEQ ID NO: 6971 - DNA, 21 bp, Artificial Sequence
  Synthetic
tataatgagcattatttttcg

SEQ ID NO: 6972 - DNA, 21 bp, Artificial Sequence
  Synthetic
ggttcgtggactcctccttct

SEQ ID NO: 6973 - DNA, 21 bp, Artificial Sequence
  Synthetic
agtgtttctcagatgtttcgt

SEQ ID NO: 6974 - DNA, 21 bp, Artificial Sequence
  Synthetic
gggtcgtttactccgccggct

SEQ ID NO: 6975 - DNA, 21 bp, Artificial Sequence
  Synthetic
gttgatcatcagtattttagg

SEQ ID NO: 6976 - DNA, 21 bp, Artificial Sequence
  Synthetic
ttgggtgttcggattggtttt

SEQ ID NO: 6977 - DNA, 21 bp, Artificial Sequence
  Synthetic
tatgattctaatatttttagg

SEQ ID NO: 6978 - DNA, 21 bp, Artificial Sequence
  Synthetic
agtcttgatcgggtgtttctg

SEQ ID NO: 6979 - DNA, 21 bp, Artificial Sequence
  Synthetic
ggtgagtttgctcagccgagg

SEQ ID NO: 6980 - DNA, 21 bp, Artificial Sequence
  Synthetic
gggacgattggttgggttgcg

SEQ ID NO: 6981 - DNA, 21 bp, Artificial Sequence
  Synthetic
gtggggaggcctcttggtctt

SEQ ID NO: 6982 - DNA, 21 bp, Artificial Sequence
  Synthetic
agtgctttggggtggtcggcg

SEQ ID NO: 6983 - DNA, 21 bp, Artificial Sequence
  Synthetic
aaggagaagttttctcatgtt

SEQ ID NO: 6984 - DNA, 21 bp, Artificial Sequence
  Synthetic
gcgccgagtgcgttgagttgg

SEQ ID NO: 6985 - DNA, 21 bp, Artificial Sequence
  Synthetic
acggggactccttgggtggct

SEQ ID NO: 6986 - DNA, 21 bp, Artificial Sequence
  Synthetic
tgggatttgaattatcctaag

SEQ ID NO: 6987 - DNA, 21 bp, Artificial Sequence
  Synthetic
tttccgtcgaatattagttgg

SEQ ID NO: 6988 - DNA, 21 bp, Artificial Sequence
  Synthetic
gagtcttttgctacgcttcat

SEQ ID NO: 6989 - DNA, 21 bp, Artificial Sequence
  Synthetic
gagatggcgcgtccgtttatg

SEQ ID NO: 6990 - DNA, 21 bp, Artificial Sequence
  Synthetic
actgctggttggggtgcgcct

SEQ ID NO: 6991 - DNA, 21 bp, Artificial Sequence
  Synthetic
acgggtcggtttggtgatttt

SEQ ID NO: 6992 - DNA, 21 bp, Artificial Sequence
  Synthetic
attctgcgtggttatgtttct

SEQ ID NO: 6993 - DNA, 21 bp, Artificial Sequence
  Synthetic
catgagggggcttattttaag

SEQ ID NO: 6994 - DNA, 21 bp, Artificial Sequence
  Synthetic
acgttgttgggttttgcgccg

SEQ ID NO: 6995 - DNA, 21 bp, Artificial Sequence
  Synthetic
agtgggaggccgctgggttgt

SEQ ID NO: 6996 - DNA, 21 bp, Artificial Sequence
  Synthetic
tcgttggatgttccttttcgg

SEQ ID NO: 6997 - DNA, 21 bp, Artificial Sequence
  Synthetic
attggggttatgccttttctg

SEQ ID NO: 6998 - DNA, 21 bp, Artificial Sequence
  Synthetic
gagcctatttggaagcgtgag

SEQ ID NO: 6999 - DNA, 21 bp, Artificial Sequence
  Synthetic
tatggtgctgcgtattttcag

SEQ ID NO: 7000 - DNA, 21 bp, Artificial Sequence
  Synthetic
tgggatactgcgggtcctaag

SEQ ID NO: 7001 - DNA, 21 bp, Artificial Sequence
  Synthetic
caggatcgttggaaggatttt

SEQ ID NO: 7002 - DNA, 21 bp, Artificial Sequence
  Synthetic
tctcctatgaatctgacgatg

SEQ ID NO: 7003 - DNA, 21 bp, Artificial Sequence
  Synthetic
attactacgagtacgtctatt

SEQ ID NO: 7004 - DNA, 21 bp, Artificial Sequence
  Synthetic
agggatagttggggtcagttt

SEQ ID NO: 7005 - DNA, 21 bp, Artificial Sequence
  Synthetic
aaggttagtaatacgagttgg

SEQ ID NO: 7006 - DNA, 21 bp, Artificial Sequence
  Synthetic
agtgttttttgtaagactcct

SEQ ID NO: 7007 - DNA, 21 bp, Artificial Sequence
  Synthetic
gcgaatagtggttggattgcg

SEQ ID NO: 7008 - DNA, 21 bp, Artificial Sequence
  Synthetic
tcggctaggtttgctgaggtt

SEQ ID NO: 7009 - DNA, 21 bp, Artificial Sequence
  Synthetic
ggggtggcgcggccgtttgtt

SEQ ID NO: 7010 - DNA, 21 bp, Artificial Sequence
  Synthetic
tttgatcaggcttatccgcgg

SEQ ID NO: 7011 - DNA, 21 bp, Artificial Sequence
  Synthetic
ggtacttgggttccgcctccg

SEQ ID NO: 7012 - DNA, 21 bp, Artificial Sequence
  Synthetic
agtgttcgttttcagcaggtg

SEQ ID NO: 7013 - DNA, 21 bp, Artificial Sequence
  Synthetic
ttggggattctgccttttgct

SEQ ID NO: 7014 - DNA, 21 bp, Artificial Sequence
  Synthetic
actgtgtggcatgcggagggt

SEQ ID NO: 7015 - DNA, 21 bp, Artificial Sequence
  Synthetic
caggttagtttttctagggtt

SEQ ID NO: 7016 - DNA, 21 bp, Artificial Sequence
  Synthetic
ttgggggcggcgctgggtagg

SEQ ID NO: 7017 - DNA, 21 bp, Artificial Sequence
  Synthetic
gttggtgttgctttgggtcgt

SEQ ID NO: 7018 - DNA, 21 bp, Artificial Sequence
  Synthetic
tcgagtgtgggttgggttggt

SEQ ID NO: 7019 - DNA, 21 bp, Artificial Sequence
  Synthetic
tcgaagatttttagtgaggtg

SEQ ID NO: 7020 - DNA, 21 bp, Artificial Sequence
  Synthetic
gataggttgggttttcttcct

SEQ ID NO: 7021 - DNA, 21 bp, Artificial Sequence
  Synthetic
aatgtttggagtgttcatggg

SEQ ID NO: 7022 - DNA, 21 bp, Artificial Sequence
  Synthetic
tcgagtcagttttgtaaggcg

SEQ ID NO: 7023 - DNA, 21 bp, Artificial Sequence
  Synthetic
gcgtttaagtttgagcaggtg

SEQ ID NO: 7024 - DNA, 21 bp, Artificial Sequence
  Synthetic
gatgcggtgtttcgtattgcg

SEQ ID NO: 7025 - DNA, 21 bp, Artificial Sequence
  Synthetic
tttactcttagtgctagtgtg

SEQ ID NO: 7026 - DNA, 21 bp, Artificial Sequence
  Synthetic
ggtaggaatagtttttttgag

SEQ ID NO: 7027 - DNA, 21 bp, Artificial Sequence
  Synthetic
acggtttcgtttgagcggatt

SEQ ID NO: 7028 - DNA, 21 bp, Artificial Sequence
  Synthetic
acgcttttgactccgtttgcg

SEQ ID NO: 7029 - DNA, 21 bp, Artificial Sequence
  Synthetic
ttttggacgggtggtagtggt

SEQ ID NO: 7030 - DNA, 21 bp, Artificial Sequence
  Synthetic
tctagggagtttaagtgtgtg

SEQ ID NO: 7031 - DNA, 21 bp, Artificial Sequence
  Synthetic
attccggggtggtatagtgag

SEQ ID NO: 7032 - DNA, 21 bp, Artificial Sequence
  Synthetic
agtcctgtggggtggtcgccg

SEQ ID NO: 7033 - DNA, 21 bp, Artificial Sequence
  Synthetic
actcagaatgcgccttttcgt

SEQ ID NO: 7034 - DNA, 21 bp, Artificial Sequence
  Synthetic
tctaaggcgtttgagaaggtg

SEQ ID NO: 7035 - DNA, 21 bp, Artificial Sequence
  Synthetic
ctgcgtgtggcgggtactgat

SEQ ID NO: 7036 - DNA, 21 bp, Artificial Sequence
  Synthetic
tttggggttggtcttgcgcgg

SEQ ID NO: 7037 - DNA, 21 bp, Artificial Sequence
  Synthetic
tatgtggagcggccgtttgcg

SEQ ID NO: 7038 - DNA, 21 bp, Artificial Sequence
  Synthetic
tcgcctgagaatccgtttagg

SEQ ID NO: 7039 - DNA, 21 bp, Artificial Sequence
  Synthetic
acttcggcgagtccgtggctt

SEQ ID NO: 7040 - DNA, 21 bp, Artificial Sequence
  Synthetic
tatggtgagtatttttttgcg

SEQ ID NO: 7041 - DNA, 21 bp, Artificial Sequence
  Synthetic
caggtgcattttaagactatg

SEQ ID NO: 7042 - DNA, 21 bp, Artificial Sequence
  Synthetic
tctaagttgggttttgtggct

SEQ ID NO: 7043 - DNA, 21 bp, Artificial Sequence
  Synthetic
tctacgggttatgggatgttt

SEQ ID NO: 7044 - DNA, 21 bp, Artificial Sequence
  Synthetic
gatatgtcgcggccttttcat

SEQ ID NO: 7045 - DNA, 21 bp, Artificial Sequence
  Synthetic
aatattgctaggccgttttat

SEQ ID NO: 7046 - DNA, 21 bp, Artificial Sequence
  Synthetic
tcttctgtgcattggtcgccg

SEQ ID NO: 7047 - DNA, 21 bp, Artificial Sequence
  Synthetic
acttggaagggttgggagccg

SEQ ID NO: 7048 - DNA, 21 bp, Artificial Sequence
  Synthetic
catgcgcaggggtgggttccg

SEQ ID NO: 7049 - DNA, 21 bp, Artificial Sequence
  Synthetic
cagcgtgatcagtggtctaag

SEQ ID NO: 7050 - DNA, 21 bp, Artificial Sequence
  Synthetic
gattggcgtggtgagttgtgg

SEQ ID NO: 7051 - DNA, 21 bp, Artificial Sequence
  Synthetic
gctggtgttaggcttgggctg

SEQ ID NO: 7052 - DNA, 21 bp, Artificial Sequence
  Synthetic
tcgtctagtcgtccgtttgtt

SEQ ID NO: 7053 - DNA, 21 bp, Artificial Sequence
  Synthetic
cttgcggagaagccttggctg

SEQ ID NO: 7054 - DNA, 21 bp, Artificial Sequence
  Synthetic
gggggttttgtgcctccgatg

SEQ ID NO: 7055 - DNA, 21 bp, Artificial Sequence
  Synthetic
acggtgtggtcggctagtggt

SEQ ID NO: 7056 - DNA, 21 bp, Artificial Sequence
  Synthetic
attccggggtttattggtcgg

SEQ ID NO: 7057 - DNA, 21 bp, Artificial Sequence
  Synthetic
aatggtgggtggccggggtcg

SEQ ID NO: 7058 - DNA, 21 bp, Artificial Sequence
  Synthetic
gttcctgatcatctgtcttgg

SEQ ID NO: 7059 - DNA, 21 bp, Artificial Sequence
  Synthetic
tctcgtacgtttgcggcggtg

SEQ ID NO: 7060 - DNA, 21 bp, Artificial Sequence
  Synthetic
actatttctaggcctcttctg

SEQ ID NO: 7061 - DNA, 21 bp, Artificial Sequence
  Synthetic
ggtgtgtttgttcctcctcag

SEQ ID NO: 7062 - DNA, 21 bp, Artificial Sequence
  Synthetic
caggtgaattttttgaaggtg

SEQ ID NO: 7063 - DNA, 21 bp, Artificial Sequence
  Synthetic
cagctgcgttttcaggatgtg

SEQ ID NO: 7064 - DNA, 21 bp, Artificial Sequence
  Synthetic
tgggatcttcagtatgcgaag

SEQ ID NO: 7065 - DNA, 21 bp, Artificial Sequence
  Synthetic
gggacgtgggatcctcctgct

SEQ ID NO: 7066 - DNA, 21 bp, Artificial Sequence
  Synthetic
ttgagtgagttttgtgtgatt

SEQ ID NO: 7067 - DNA, 21 bp, Artificial Sequence
  Synthetic
agtattcttgggtttgttgcg

SEQ ID NO: 7068 - DNA, 21 bp, Artificial Sequence
  Synthetic
caggtggagtttcggtcgatt

SEQ ID NO: 7069 - DNA, 21 bp, Artificial Sequence
  Synthetic
ttggataatttttgtaagaat

SEQ ID NO: 7070 - DNA, 21 bp, Artificial Sequence
  Synthetic
gatccggtttttcggattacg

SEQ ID NO: 7071 - DNA, 21 bp, Artificial Sequence
  Synthetic
tggggttcgaatatttttctt

SEQ ID NO: 7072 - DNA, 21 bp, Artificial Sequence
  Synthetic
aatgtttggcatgcgcagggt

SEQ ID NO: 7073 - DNA, 21 bp, Artificial Sequence
  Synthetic
gcgggtgtgaggttggggctt

SEQ ID NO: 7074 - DNA, 21 bp, Artificial Sequence
  Synthetic
gggagggataggccgtttgtg

SEQ ID NO: 7075 - DNA, 21 bp, Artificial Sequence
  Synthetic
ggtcagtgggatagtgggggt

SEQ ID NO: 7076 - DNA, 21 bp, Artificial Sequence
  Synthetic
tctgcgaataagccgtttctg

SEQ ID NO: 7077 - DNA, 21 bp, Artificial Sequence
  Synthetic
tctgttgataatccgtttcgt

SEQ ID NO: 7078 - DNA, 21 bp, Artificial Sequence
  Synthetic
tttgatacgagtgggccgagg

SEQ ID NO: 7079 - DNA, 21 bp, Artificial Sequence
  Synthetic
agtgctgatcgtccttttcag

SEQ ID NO: 7080 - DNA, 21 bp, Artificial Sequence
  Synthetic
ggttcggagaggccttttctt

SEQ ID NO: 7081 - DNA, 21 bp, Artificial Sequence
  Synthetic
tctctgacgaagccgtttaat

SEQ ID NO: 7082 - DNA, 21 bp, Artificial Sequence
  Synthetic
tgggatgcgcagtatccgagg

SEQ ID NO: 7083 - DNA, 21 bp, Artificial Sequence
  Synthetic
ggtgtgtggattgtgaagccg

SEQ ID NO: 7084 - DNA, 21 bp, Artificial Sequence
  Synthetic
tctgctcggtcgccgtttttg

SEQ ID NO: 7085 - DNA, 21 bp, Artificial Sequence
  Synthetic
atgcctccggggtggttgccg

SEQ ID NO: 7086 - DNA, 21 bp, Artificial Sequence
  Synthetic
gtggagaggtggaattttgat

SEQ ID NO: 7087 - DNA, 21 bp, Artificial Sequence
  Synthetic
tgggatctggctggtccgaag

SEQ ID NO: 7088 - DNA, 21 bp, Artificial Sequence
  Synthetic
tctacgcgtactccgtttttg

SEQ ID NO: 7089 - DNA, 21 bp, Artificial Sequence
  Synthetic
agggatcctggttgggtgcct

SEQ ID NO: 7090 - DNA, 21 bp, Artificial Sequence
  Synthetic
tatcctacgaggccgtttaat

SEQ ID NO: 7091 - DNA, 21 bp, Artificial Sequence
  Synthetic
acgcttaagtttgagaggatt

SEQ ID NO: 7092 - DNA, 21 bp, Artificial Sequence
  Synthetic
tctagtcggtttgaggcggtt

SEQ ID NO: 7093 - DNA, 21 bp, Artificial Sequence
  Synthetic
tcgttgaagctgccttttatg

SEQ ID NO: 7094 - DNA, 21 bp, Artificial Sequence
  Synthetic
acggtgcttcgtcctctgctt

SEQ ID NO: 7095 - DNA, 21 bp, Artificial Sequence
  Synthetic
acgctgaataggatttttatt

SEQ ID NO: 7096 - DNA, 21 bp, Artificial Sequence
  Synthetic
ggtcagcttggttggattcag

SEQ ID NO: 7097 - DNA, 21 bp, Artificial Sequence
  Synthetic
tatcctgatatggtgtttagg

SEQ ID NO: 7098 - DNA, 21 bp, Artificial Sequence
  Synthetic
ggtgttacgcatctttttaag

SEQ ID NO: 7099 - DNA, 21 bp, Artificial Sequence
  Synthetic
tctgtttggcgggtggagggt

SEQ ID NO: 7100 - DNA, 21 bp, Artificial Sequence
  Synthetic
cttttgactcgtccgtttgct

SEQ ID NO: 7101 - DNA, 21 bp, Artificial Sequence
  Synthetic
tggactgagagttatcctcgt

SEQ ID NO: 7102 - DNA, 21 bp, Artificial Sequence
  Synthetic
agtgcgtctcagccttggttg

SEQ ID NO: 7103 - DNA, 21 bp, Artificial Sequence
  Synthetic
gtggggacgccgttggggcgt

SEQ ID NO: 7104 - DNA, 21 bp, Artificial Sequence
  Synthetic
cgtcctccttcgatttcgtgg

SEQ ID NO: 7105 - DNA, 21 bp, Artificial Sequence
  Synthetic
acgccgtggcgtcatgatggg

SEQ ID NO: 7106 - DNA, 21 bp, Artificial Sequence
  Synthetic
gttggtactcggttggggtgt

SEQ ID NO: 7107 - DNA, 21 bp, Artificial Sequence
  Synthetic
gatcctatttttaggcatatg

SEQ ID NO: 7108 - DNA, 21 bp, Artificial Sequence
  Synthetic
tatacgtttgcgccgccgagt

SEQ ID NO: 7109 - DNA, 21 bp, Artificial Sequence
  Synthetic
ggtaagttttctcctccgcag

SEQ ID NO: 7110 - DNA, 21 bp, Artificial Sequence
  Synthetic
ggggagaggggttgggttgcg

SEQ ID NO: 7111 - DNA, 21 bp, Artificial Sequence
  Synthetic
gggcgtgatgggtggattgct

SEQ ID NO: 7112 - DNA, 21 bp, Artificial Sequence
  Synthetic
ggggtttatttgcctcctact

SEQ ID NO: 7113 - DNA, 21 bp, Artificial Sequence
  Synthetic
tctgtgcgttttgagaaggtg

SEQ ID NO: 7114 - DNA, 21 bp, Artificial Sequence
  Synthetic
gatgattatgggtttcatccg

SEQ ID NO: 7115 - DNA, 21 bp, Artificial Sequence
  Synthetic
tggactttttcgccgcctcag

SEQ ID NO: 7116 - DNA, 21 bp, Artificial Sequence
  Synthetic
actgtggcttcgccttggatg

SEQ ID NO: 7117 - DNA, 21 bp, Artificial Sequence
  Synthetic
attggtgtgcgtcttgggctg

SEQ ID NO: 7118 - DNA, 21 bp, Artificial Sequence
  Synthetic
gattatgagtggccggggtct

SEQ ID NO: 7119 - DNA, 21 bp, Artificial Sequence
  Synthetic
gaggatatgcggacttcttgg

SEQ ID NO: 7120 - DNA, 21 bp, Artificial Sequence
  Synthetic
acggtggagcggccttttagt

SEQ ID NO: 7121 - DNA, 21 bp, Artificial Sequence
  Synthetic
acgcatacgtctccttggcat

SEQ ID NO: 7122 - DNA, 21 bp, Artificial Sequence
  Synthetic
tctgtggagtttcgtctggtg

SEQ ID NO: 7123 - DNA, 21 bp, Artificial Sequence
  Synthetic
ggtactatggggtggactgct

SEQ ID NO: 7124 - DNA, 21 bp, Artificial Sequence
  Synthetic
tttactctggaggggcctatg

SEQ ID NO: 7125 - DNA, 21 bp, Artificial Sequence
  Synthetic
cagaaggttggttgggtggcg

SEQ ID NO: 7126 - DNA, 21 bp, Artificial Sequence
  Synthetic
aatacgatggcggtgtctcgt

SEQ ID NO: 7127 - DNA, 21 bp, Artificial Sequence
  Synthetic
cagcaggagttttgtgctgtt

SEQ ID NO: 7128 - DNA, 21 bp, Artificial Sequence
  Synthetic
ggtgcgattggttttattgcg

SEQ ID NO: 7129 - DNA, 21 bp, Artificial Sequence
  Synthetic
gattctaattggcctgggtcg

SEQ ID NO: 7130 - DNA, 21 bp, Artificial Sequence
  Synthetic
gcgagtccgggttgggtggct

SEQ ID NO: 7131 - DNA, 21 bp, Artificial Sequence
  Synthetic
cagctgaagtttgctgaggtg

SEQ ID NO: 7132 - DNA, 21 bp, Artificial Sequence
  Synthetic
acgccgtctaggacttcttgg

SEQ ID NO: 7133 - DNA, 21 bp, Artificial Sequence
  Synthetic
tggacttctttttcgagtgtt

SEQ ID NO: 7134 - DNA, 21 bp, Artificial Sequence
  Synthetic
ggtcctagtaggccttttcag

SEQ ID NO: 7135 - DNA, 21 bp, Artificial Sequence
  Synthetic
ggtaagctgggttgggtgccg

SEQ ID NO: 7136 - DNA, 21 bp, Artificial Sequence
  Synthetic
agtgctgtgtttaagaatgtg

SEQ ID NO: 7137 - DNA, 21 bp, Artificial Sequence
  Synthetic
gatagtaggtggggggagttt

SEQ ID NO: 7138 - DNA, 21 bp, Artificial Sequence
  Synthetic
gaggggactaggctgggttat

SEQ ID NO: 7139 - DNA, 21 bp, Artificial Sequence
  Synthetic
aatctttttggtgatcgtttg

SEQ ID NO: 7140 - DNA, 21 bp, Artificial Sequence
  Synthetic
ttggattatgggtttgtgccg

SEQ ID NO: 7141 - DNA, 21 bp, Artificial Sequence
  Synthetic
catgtttttcttcaggatggt

SEQ ID NO: 7142 - DNA, 21 bp, Artificial Sequence
  Synthetic
gaggctccgctgccgtggcgt

SEQ ID NO: 7143 - DNA, 21 bp, Artificial Sequence
  Synthetic
gggattagtaggccttttcag

SEQ ID NO: 7144 - DNA, 21 bp, Artificial Sequence
  Synthetic
gatgtttttaggattcatggg

SEQ ID NO: 7145 - DNA, 21 bp, Artificial Sequence
  Synthetic
caggtgatgtctacgtcgtgg

SEQ ID NO: 7146 - DNA, 21 bp, Artificial Sequence
  Synthetic
ccgaagacttttagtcagatt

SEQ ID NO: 7147 - DNA, 21 bp, Artificial Sequence
  Synthetic
tttgggcttaaggatattttt

SEQ ID NO: 7148 - DNA, 21 bp, Artificial Sequence
  Synthetic
tctgagttgggttggagtccg

SEQ ID NO: 7149 - DNA, 21 bp, Artificial Sequence
  Synthetic
gttcctcataatctgacttgg

SEQ ID NO: 7150 - DNA, 21 bp, Artificial Sequence
  Synthetic
aagagtctgccttttctgccg

SEQ ID NO: 7151 - DNA, 21 bp, Artificial Sequence
  Synthetic
caggctcgttttcaggagatt

SEQ ID NO: 7152 - DNA, 21 bp, Artificial Sequence
  Synthetic
gcgcctaagcatgagtggctg

SEQ ID NO: 7153 - DNA, 21 bp, Artificial Sequence
  Synthetic
tcgaagaattggccgggttcg

SEQ ID NO: 7154 - DNA, 21 bp, Artificial Sequence
  Synthetic
ggggttgatcggccttttgtg

SEQ ID NO: 7155 - DNA, 21 bp, Artificial Sequence
  Synthetic
gatgagactcgtttgtttcgt

SEQ ID NO: 7156 - DNA, 21 bp, Artificial Sequence
  Synthetic
cataattgggatccgccgagt

SEQ ID NO: 7157 - DNA, 21 bp, Artificial Sequence
  Synthetic
tgggatttgcatgatccgaag

SEQ ID NO: 7158 - DNA, 21 bp, Artificial Sequence
  Synthetic
agtggtgggtggggtgtgccg

SEQ ID NO: 7159 - DNA, 21 bp, Artificial Sequence
  Synthetic
gttaatggtaatgagcgtgtt

SEQ ID NO: 7160 - DNA, 21 bp, Artificial Sequence
  Synthetic
gggtctcttggttggtctcct

SEQ ID NO: 7161 - DNA, 21 bp, Artificial Sequence
  Synthetic
aagattaattttgctcatgtg

SEQ ID NO: 7162 - DNA, 21 bp, Artificial Sequence
  Synthetic
tatgatactaggccttttact

SEQ ID NO: 7163 - DNA, 21 bp, Artificial Sequence
  Synthetic
tctttggagcagccttttaag

SEQ ID NO: 7164 - DNA, 21 bp, Artificial Sequence
  Synthetic
aggctttgtggtcttgtgtgt

SEQ ID NO: 7165 - DNA, 21 bp, Artificial Sequence
  Synthetic
acggtgtggagtagggagggg

SEQ ID NO: 7166 - DNA, 21 bp, Artificial Sequence
  Synthetic
tctcattggtttcctaatggg

SEQ ID NO: 7167 - DNA, 21 bp, Artificial Sequence
  Synthetic
tgggaggcttttgagcgggtt

SEQ ID NO: 7168 - DNA, 21 bp, Artificial Sequence
  Synthetic
cttacgcttcatacgagtgtg

SEQ ID NO: 7169 - DNA, 21 bp, Artificial Sequence
  Synthetic
tgggatcttcagtatccgatt

SEQ ID NO: 7170 - DNA, 21 bp, Artificial Sequence
  Synthetic
atggattgggttccgcctaag

SEQ ID NO: 7171 - DNA, 21 bp, Artificial Sequence
  Synthetic
agtctgcgtgcgccgtttgtg

SEQ ID NO: 7172 - DNA, 21 bp, Artificial Sequence
  Synthetic
ccgcatcataagcagtgggat

SEQ ID NO: 7173 - DNA, 21 bp, Artificial Sequence
  Synthetic
aatgtttctcgtccgtttctg

SEQ ID NO: 7174 - DNA, 21 bp, Artificial Sequence
  Synthetic
gctgatactgggtgggttgcg

SEQ ID NO: 7175 - DNA, 21 bp, Artificial Sequence
  Synthetic
tcgcctgttatttgtagtggg

SEQ ID NO: 7176 - DNA, 21 bp, Artificial Sequence
  Synthetic
tcgtttacttttgctgaggtt

SEQ ID NO: 7177 - DNA, 21 bp, Artificial Sequence
  Synthetic
tcgcctgagaggccttttact

SEQ ID NO: 7178 - DNA, 21 bp, Artificial Sequence
  Synthetic
attgggaggccgcttggttcg

SEQ ID NO: 7179 - DNA, 21 bp, Artificial Sequence
  Synthetic
aggattcagtttgcggatatt

SEQ ID NO: 7180 - DNA, 21 bp, Artificial Sequence
  Synthetic
atggatccgatgccttttcgg

SEQ ID NO: 7181 - DNA, 21 bp, Artificial Sequence
  Synthetic
tggggtgcggcgaatgctctt

SEQ ID NO: 7182 - DNA, 21 bp, Artificial Sequence
  Synthetic
cagaggcagtttaatagtgtt

SEQ ID NO: 7183 - DNA, 21 bp, Artificial Sequence
  Synthetic
ggggtttggatgggtgggggt

SEQ ID NO: 7184 - DNA, 21 bp, Artificial Sequence
  Synthetic
acggctttgccgcagaggcag

SEQ ID NO: 7185 - DNA, 21 bp, Artificial Sequence
  Synthetic
ggggttggtaagccttttctg

SEQ ID NO: 7186 - DNA, 21 bp, Artificial Sequence
  Synthetic
gctccggttccgcattgggtg

SEQ ID NO: 7187 - DNA, 21 bp, Artificial Sequence
  Synthetic
gtggaggtttttgggaggttt

SEQ ID NO: 7188 - DNA, 21 bp, Artificial Sequence
  Synthetic
atgctggagcgtccgtggaat

SEQ ID NO: 7189 - DNA, 21 bp, Artificial Sequence
  Synthetic
ttggctagtaagccttttttg

SEQ ID NO: 7190 - DNA, 21 bp, Artificial Sequence
  Synthetic
aataagcttgggtggagtcct

SEQ ID NO: 7191 - DNA, 21 bp, Artificial Sequence
  Synthetic
agtgattggactaagagggtg

SEQ ID NO: 7192 - DNA, 21 bp, Artificial Sequence
  Synthetic
ttgctttttggtgctaagtat

SEQ ID NO: 7193 - DNA, 21 bp, Artificial Sequence
  Synthetic
tatgatgctcagtattttaag

SEQ ID NO: 7194 - DNA, 21 bp, Artificial Sequence
  Synthetic
agttcgaatctgccgtttcgt

SEQ ID NO: 7195 - DNA, 21 bp, Artificial Sequence
  Synthetic
acttctactttttgtacgcct

SEQ ID NO: 7196 - DNA, 21 bp, Artificial Sequence
  Synthetic
gatgtttggcgggctagtggt

SEQ ID NO: 7197 - DNA, 21 bp, Artificial Sequence
  Synthetic
gtggatcctatgccttttcat

SEQ ID NO: 7198 - DNA, 21 bp, Artificial Sequence
  Synthetic
acgctggggaggccgttttct

SEQ ID NO: 7199 - DNA, 21 bp, Artificial Sequence
  Synthetic
gttacggagtttgggcgtttt

SEQ ID NO: 7200 - DNA, 21 bp, Artificial Sequence
  Synthetic
tcgctgaataggccgtttgtt

SEQ ID NO: 7201 - DNA, 21 bp, Artificial Sequence
  Synthetic
actgagttttgtaggattatg

SEQ ID NO: 7202 - DNA, 21 bp, Artificial Sequence
  Synthetic
tatgagacgcttccttttagg

SEQ ID NO: 7203 - DNA, 21 bp, Artificial Sequence
  Synthetic
ggtgttggtcgggtgtttctg

SEQ ID NO: 7204 - DNA, 21 bp, Artificial Sequence
  Synthetic
ggggcgactccttggctgcct

SEQ ID NO: 7205 - DNA, 21 bp, Artificial Sequence
  Synthetic
aatactattggttgggctccg

SEQ ID NO: 7206 - DNA, 21 bp, Artificial Sequence
  Synthetic
ttggatcctctgccgtttaag

SEQ ID NO: 7207 - DNA, 21 bp, Artificial Sequence
  Synthetic
tatctgggtaagccttttgtt

SEQ ID NO: 7208 - DNA, 21 bp, Artificial Sequence
  Synthetic
tttagtgagatgtatcctcgg

SEQ ID NO: 7209 - DNA, 21 bp, Artificial Sequence
  Synthetic
agtcgtgagcggcctttttat

SEQ ID NO: 7210 - DNA, 21 bp, Artificial Sequence
  Synthetic
tttacgcttagtagttcgaag

SEQ ID NO: 7211 - DNA, 21 bp, Artificial Sequence
  Synthetic
aatgatgttcattggactcct

SEQ ID NO: 7212 - DNA, 21 bp, Artificial Sequence
  Synthetic
gtgcggttgcctgatctgcat

SEQ ID NO: 7213 - DNA, 21 bp, Artificial Sequence
  Synthetic
gcggcgatggggtgggctgct

SEQ ID NO: 7214 - DNA, 21 bp, Artificial Sequence
  Synthetic
gttcctatgagtaagacgtgg

SEQ ID NO: 7215 - DNA, 21 bp, Artificial Sequence
  Synthetic
tatattcggacgcagaatcag

SEQ ID NO: 7216 - DNA, 21 bp, Artificial Sequence
  Synthetic
catcgggatatgggtgtttgg

SEQ ID NO: 7217 - DNA, 21 bp, Artificial Sequence
  Synthetic
gttgggcaggctttggggagg

SEQ ID NO: 7218 - DNA, 21 bp, Artificial Sequence
  Synthetic
actttgactcagccttggatt

SEQ ID NO: 7219 - DNA, 21 bp, Artificial Sequence
  Synthetic
tcgcggaagtttgagcttgtg

SEQ ID NO: 7220 - DNA, 21 bp, Artificial Sequence
  Synthetic
actgtgtgggctatgaatggg

SEQ ID NO: 7221 - DNA, 21 bp, Artificial Sequence
  Synthetic
attcctgataatctgagttgg

SEQ ID NO: 7222 - DNA, 21 bp, Artificial Sequence
  Synthetic
agtaaggttgggtggacggct

SEQ ID NO: 7223 - DNA, 21 bp, Artificial Sequence
  Synthetic
gatcctgtgtttcgtcttact

SEQ ID NO: 7224 - DNA, 21 bp, Artificial Sequence
  Synthetic
ggtgtgaataatccgtttcgt

SEQ ID NO: 7225 - DNA, 21 bp, Artificial Sequence
  Synthetic
gttgattggagtcctcctcgg

SEQ ID NO: 7226 - DNA, 21 bp, Artificial Sequence
  Synthetic
gatgttgctcggccttttctg

SEQ ID NO: 7227 - DNA, 21 bp, Artificial Sequence
  Synthetic
gctaaggagtttgcgcgtgtg

SEQ ID NO: 7228 - DNA, 21 bp, Artificial Sequence
  Synthetic
agtcagagtaggccttttaat

SEQ ID NO: 7229 - DNA, 21 bp, Artificial Sequence
  Synthetic
cctagttctgcgtcgagttgg

SEQ ID NO: 7230 - DNA, 21 bp, Artificial Sequence
  Synthetic
gcttttggtcattctgattgg

SEQ ID NO: 7231 - DNA, 21 bp, Artificial Sequence
  Synthetic
actatttgggctgttcagggg

SEQ ID NO: 7232 - DNA, 21 bp, Artificial Sequence
  Synthetic
ggtctgtggaatgctgggggg

SEQ ID NO: 7233 - DNA, 21 bp, Artificial Sequence
  Synthetic
ggtgctactatttgggctccg

SEQ ID NO: 7234 - DNA, 21 bp, Artificial Sequence
  Synthetic
acggtgagtcagatttttaag

SEQ ID NO: 7235 - DNA, 21 bp, Artificial Sequence
  Synthetic
ggttctattgggtggactcct

SEQ ID NO: 7236 - DNA, 21 bp, Artificial Sequence
  Synthetic
aatactttgtcttcttctaag

SEQ ID NO: 7237 - DNA, 21 bp, Artificial Sequence
  Synthetic
tgtattgcgcgtttggggtgt

SEQ ID NO: 7238 - DNA, 21 bp, Artificial Sequence
  Synthetic
attggggttgcgctgggtctt

SEQ ID NO: 7239 - DNA, 21 bp, Artificial Sequence
  Synthetic
acgagtattcgtccgtttctg

SEQ ID NO: 7240 - DNA, 21 bp, Artificial Sequence
  Synthetic
tctcgtgtgtttgagcaggtt

SEQ ID NO: 7241 - DNA, 21 bp, Artificial Sequence
  Synthetic
gatccgtttcggctgtctggt

SEQ ID NO: 7242 - DNA, 21 bp, Artificial Sequence
  Synthetic
tgtattaatgagacttggtgt

SEQ ID NO: 7243 - DNA, 21 bp, Artificial Sequence
  Synthetic
actattaggtcgccgtttctt

SEQ ID NO: 7244 - DNA, 21 bp, Artificial Sequence
  Synthetic
gatgcttggcataggaatggg

SEQ ID NO: 7245 - DNA, 21 bp, Artificial Sequence
  Synthetic
aatcgggtgggttgggttgcg

SEQ ID NO: 7246 - DNA, 21 bp, Artificial Sequence
  Synthetic
ctgagtagtcggccttttctt

SEQ ID NO: 7247 - DNA, 21 bp, Artificial Sequence
  Synthetic
tggacgaatcttggttctgtt

SEQ ID NO: 7248 - DNA, 21 bp, Artificial Sequence
  Synthetic
aagccgactaatactagttgg

SEQ ID NO: 7249 - DNA, 21 bp, Artificial Sequence
  Synthetic
tctgctcctttttgggtgaat

SEQ ID NO: 7250 - DNA, 21 bp, Artificial Sequence
  Synthetic
tctactcagcgtccttttatg

SEQ ID NO: 7251 - DNA, 21 bp, Artificial Sequence
  Synthetic
caggtgaagtttattactgtg

SEQ ID NO: 7252 - DNA, 21 bp, Artificial Sequence
  Synthetic
agtgagttgaagcctttttat

SEQ ID NO: 7253 - DNA, 21 bp, Artificial Sequence
  Synthetic
actgatgtgcagttttttaag

SEQ ID NO: 7254 - DNA, 21 bp, Artificial Sequence
  Synthetic
gaggggaggccgcttggtcag

SEQ ID NO: 7255 - DNA, 21 bp, Artificial Sequence
  Synthetic
tatgttgatcagtattttttg

SEQ ID NO: 7256 - DNA, 21 bp, Artificial Sequence
  Synthetic
cattctgctgggtggattgct

SEQ ID NO: 7257 - DNA, 21 bp, Artificial Sequence
  Synthetic
tgtggtgtgcggttggggctg

SEQ ID NO: 7258 - DNA, 21 bp, Artificial Sequence
  Synthetic
ggtcctgggtggcctgggagt

SEQ ID NO: 7259 - DNA, 21 bp, Artificial Sequence
  Synthetic
acgccggttacgccttttcgt

SEQ ID NO: 7260 - DNA, 21 bp, Artificial Sequence
  Synthetic
ccgaagtcgtttgagtgtgtg

SEQ ID NO: 7261 - DNA, 21 bp, Artificial Sequence
  Synthetic
catgttttggggtgggctgcg

SEQ ID NO: 7262 - DNA, 21 bp, Artificial Sequence
  Synthetic
aatgtttggcgtaatgatggg

SEQ ID NO: 7263 - DNA, 21 bp, Artificial Sequence
  Synthetic
actctgttttgtaagactccg

SEQ ID NO: 7264 - DNA, 21 bp, Artificial Sequence
  Synthetic
tattcgggggctccttttctt

SEQ ID NO: 7265 - DNA, 21 bp, Artificial Sequence
  Synthetic
tctgttgatcgtccttttgtg

SEQ ID NO: 7266 - DNA, 21 bp, Artificial Sequence
  Synthetic
actgctcggatgccgttttct

SEQ ID NO: 7267 - DNA, 21 bp, Artificial Sequence
  Synthetic
gggctgtggatgtatcctgag

SEQ ID NO: 7268 - DNA, 21 bp, Artificial Sequence
  Synthetic
catgctgcggggtggattgct

SEQ ID NO: 7269 - DNA, 21 bp, Artificial Sequence
  Synthetic
gttgctcagtttggtcagttt

SEQ ID NO: 7270 - DNA, 21 bp, Artificial Sequence
  Synthetic
catgtgtttagtcctccgacg

SEQ ID NO: 7271 - DNA, 21 bp, Artificial Sequence
  Synthetic
gggcctgatcgtccttttgtg

SEQ ID NO: 7272 - DNA, 21 bp, Artificial Sequence
  Synthetic
gcgacggctcggccttttttg

SEQ ID NO: 7273 - DNA, 21 bp, Artificial Sequence
  Synthetic
agtggtgtgccgttggggagg

SEQ ID NO: 7274 - DNA, 21 bp, Artificial Sequence
  Synthetic
acggcggatcgtccttggcat

SEQ ID NO: 7275 - DNA, 21 bp, Artificial Sequence
  Synthetic
cgtaagcagtttgctgatatt

SEQ ID NO: 7276 - DNA, 21 bp, Artificial Sequence
  Synthetic
gtgtcttttaagacgctgttg

SEQ ID NO: 7277 - DNA, 21 bp, Artificial Sequence
  Synthetic
attggggctaatccgtttact

SEQ ID NO: 7278 - DNA, 21 bp, Artificial Sequence
  Synthetic
gagcttgtgaggccgtttctt

SEQ ID NO: 7279 - DNA, 21 bp, Artificial Sequence
  Synthetic
gtgctgatgaatacgagttgg

SEQ ID NO: 7280 - DNA, 21 bp, Artificial Sequence
  Synthetic
atgaagatgaatccgtttggg

SEQ ID NO: 7281 - DNA, 21 bp, Artificial Sequence
  Synthetic
aatccggcgaatacgagttgg

SEQ ID NO: 7282 - DNA, 21 bp, Artificial Sequence
  Synthetic
gtggggcgggctctggggatg

SEQ ID NO: 7283 - DNA, 21 bp, Artificial Sequence
  Synthetic
acggcttttgctcctcctcgt

SEQ ID NO: 7284 - DNA, 21 bp, Artificial Sequence
  Synthetic
agtccgttgaggccttttact

SEQ ID NO: 7285 - DNA, 21 bp, Artificial Sequence
  Synthetic
aagcagtttaatccgccgact

SEQ ID NO: 7286 - DNA, 21 bp, Artificial Sequence
  Synthetic
actgctacgaatccgtttctt

SEQ ID NO: 7287 - DNA, 21 bp, Artificial Sequence
  Synthetic
tcgcttgtgggttgggctgct

SEQ ID NO: 7288 - DNA, 21 bp, Artificial Sequence
  Synthetic
tcgtataagaattttaatgat

SEQ ID NO: 7289 - DNA, 21 bp, Artificial Sequence
  Synthetic
actacgctgtctgtgagtagg

SEQ ID NO: 7290 - DNA, 21 bp, Artificial Sequence
  Synthetic
cggattggggttcagtgggcg

SEQ ID NO: 7291 - DNA, 21 bp, Artificial Sequence
  Synthetic
acgtatttggggaagtttagt

SEQ ID NO: 7292 - DNA, 21 bp, Artificial Sequence
  Synthetic
ttggtgccgcggtggccgcct

SEQ ID NO: 7293 - DNA, 21 bp, Artificial Sequence
  Synthetic
tcgcattggtatccggggggg

SEQ ID NO: 7294 - DNA, 21 bp, Artificial Sequence
  Synthetic
actgagaaggcgccttttctg

SEQ ID NO: 7295 - DNA, 21 bp, Artificial Sequence
  Synthetic
gtggtgtttgagagtccgagg

SEQ ID NO: 7296 - DNA, 21 bp, Artificial Sequence
  Synthetic
acggtgtggtttccgcagggg

SEQ ID NO: 7297 - DNA, 21 bp, Artificial Sequence
  Synthetic
ctgggtcagccttggattgct

SEQ ID NO: 7298 - DNA, 21 bp, Artificial Sequence
  Synthetic
gtgggtcatcttccgtttcat

SEQ ID NO: 7299 - DNA, 21 bp, Artificial Sequence
  Synthetic
tcgtctgagcggccgtttcag

SEQ ID NO: 7300 - DNA, 21 bp, Artificial Sequence
  Synthetic
ggtaatgtggggtgggttgct

SEQ ID NO: 7301 - DNA, 21 bp, Artificial Sequence
  Synthetic
ggtgcgtttttgcctccgacg

SEQ ID NO: 7302 - DNA, 21 bp, Artificial Sequence
  Synthetic
tctcataagtttgaggttgtt

SEQ ID NO: 7303 - DNA, 21 bp, Artificial Sequence
  Synthetic
cttccggagtggggtatgttt

SEQ ID NO: 7304 - DNA, 21 bp, Artificial Sequence
  Synthetic
gatatgggggctactggtagg

SEQ ID NO: 7305 - DNA, 21 bp, Artificial Sequence
  Synthetic
gagtctttgaggccgtttctg

SEQ ID NO: 7306 - DNA, 21 bp, Artificial Sequence
  Synthetic
aatctttttgcgcctcctaag

SEQ ID NO: 7307 - DNA, 21 bp, Artificial Sequence
  Synthetic
tcggagtatggttttttgccg

SEQ ID NO: 7308 - DNA, 21 bp, Artificial Sequence
  Synthetic
ggtccggtttttaagttgccg

SEQ ID NO: 7309 - DNA, 21 bp, Artificial Sequence
  Synthetic
gctcctacgcatgagtggttg

SEQ ID NO: 7310 - DNA, 21 bp, Artificial Sequence
  Synthetic
cgggagggtcggtttgggact

SEQ ID NO: 7311 - DNA, 21 bp, Artificial Sequence
  Synthetic
tatcagggggcgccgttttat

SEQ ID NO: 7312 - DNA, 21 bp, Artificial Sequence
  Synthetic
cgggcggtttttgctcaggtt

SEQ ID NO: 7313 - DNA, 21 bp, Artificial Sequence
  Synthetic
ttggggacggctttgggtcgg

SEQ ID NO: 7314 - DNA, 21 bp, Artificial Sequence
  Synthetic
gggttgcagcgtatttttcct

SEQ ID NO: 7315 - DNA, 21 bp, Artificial Sequence
  Synthetic
actcgtgagttttgtaatgtt

SEQ ID NO: 7316 - DNA, 21 bp, Artificial Sequence
  Synthetic
agtacggatcatccttttagg

SEQ ID NO: 7317 - DNA, 21 bp, Artificial Sequence
  Synthetic
actcctgatcggccttggcat

SEQ ID NO: 7318 - DNA, 21 bp, Artificial Sequence
  Synthetic
attcctttgtttgagaagatt

SEQ ID NO: 7319 - DNA, 21 bp, Artificial Sequence
  Synthetic
agtcataattttgctagtatt

SEQ ID NO: 7320 - DNA, 21 bp, Artificial Sequence
  Synthetic
ttgacgttgacgacgagtgtg

SEQ ID NO: 7321 - DNA, 21 bp, Artificial Sequence
  Synthetic
tcgcatgatattccttttcgg

SEQ ID NO: 7322 - DNA, 21 bp, Artificial Sequence
  Synthetic
aagaatagtaattggttggat

SEQ ID NO: 7323 - DNA, 21 bp, Artificial Sequence
  Synthetic
atggttgatcgtccttggatt

SEQ ID NO: 7324 - DNA, 21 bp, Artificial Sequence
  Synthetic
gatgataggcattggacgccg

SEQ ID NO: 7325 - DNA, 21 bp, Artificial Sequence
  Synthetic
ggggattgggttattcctcag

SEQ ID NO: 7326 - DNA, 21 bp, Artificial Sequence
  Synthetic
gaggcgcttcgtccgtttatg

SEQ ID NO: 7327 - DNA, 21 bp, Artificial Sequence
  Synthetic
ggttctgagtgggggaagttt

SEQ ID NO: 7328 - DNA, 21 bp, Artificial Sequence
  Synthetic
ggttcttttgggtttctgccg

SEQ ID NO: 7329 - DNA, 21 bp, Artificial Sequence
  Synthetic
gaggagggttattggagtcct

SEQ ID NO: 7330 - DNA, 21 bp, Artificial Sequence
  Synthetic
tcggagagtgggtgggtggct

SEQ ID NO: 7331 - DNA, 21 bp, Artificial Sequence
  Synthetic
ttggcgatgactacgtcttgg

SEQ ID NO: 7332 - DNA, 21 bp, Artificial Sequence
  Synthetic
gctgttacgttttcgaatatt

SEQ ID NO: 7333 - DNA, 21 bp, Artificial Sequence
  Synthetic
tggtctgtgcttgagactgtg

SEQ ID NO: 7334 - DNA, 21 bp, Artificial Sequence
  Synthetic
gttccgatgtctcgttcgttt

SEQ ID NO: 7335 - DNA, 21 bp, Artificial Sequence
  Synthetic
agtactcagcgtccttttact

SEQ ID NO: 7336 - DNA, 21 bp, Artificial Sequence
  Synthetic
cttaattttgcgacgttgacg

SEQ ID NO: 7337 - DNA, 21 bp, Artificial Sequence
  Synthetic
actgatactcagtattttagg

SEQ ID NO: 7338 - DNA, 21 bp, Artificial Sequence
  Synthetic
tgggatagttcggggcctcgt

SEQ ID NO: 7339 - DNA, 21 bp, Artificial Sequence
  Synthetic
tcggtggctgtgccttttcgt

SEQ ID NO: 7340 - DNA, 21 bp, Artificial Sequence
  Synthetic
atttgggagcagcctcatggt

SEQ ID NO: 7341 - DNA, 21 bp, Artificial Sequence
  Synthetic
aatagttttagtccgccgtat

SEQ ID NO: 7342 - DNA, 21 bp, Artificial Sequence
  Synthetic
gttggtgtgccgttgggttat

SEQ ID NO: 7343 - DNA, 21 bp, Artificial Sequence
  Synthetic
gcggcgagtcggccgtttatg

SEQ ID NO: 7344 - DNA, 21 bp, Artificial Sequence
  Synthetic
gatattgttcatccgtttcgt

SEQ ID NO: 7345 - DNA, 21 bp, Artificial Sequence
  Synthetic
gctagtgttgggtggattggg

SEQ ID NO: 7346 - DNA, 21 bp, Artificial Sequence
  Synthetic
tattctacgaatttgtttctt

SEQ ID NO: 7347 - DNA, 21 bp, Artificial Sequence
  Synthetic
gggcattgggttcctccggag

SEQ ID NO: 7348 - DNA, 21 bp, Artificial Sequence
  Synthetic
ggggagacgcggccttttctt

SEQ ID NO: 7349 - DNA, 21 bp, Artificial Sequence
  Synthetic
aatcagcttccttgggtggcg

SEQ ID NO: 7350 - DNA, 21 bp, Artificial Sequence
  Synthetic
agtggtactccgtggattggg

SEQ ID NO: 7351 - DNA, 21 bp, Artificial Sequence
  Synthetic
cgtcttggttggccgcttggg

SEQ ID NO: 7352 - DNA, 21 bp, Artificial Sequence
  Synthetic
ctggatctgccgtttttgcct

SEQ ID NO: 7353 - DNA, 21 bp, Artificial Sequence
  Synthetic
tctactattgggtggattgcg

SEQ ID NO: 7354 - DNA, 21 bp, Artificial Sequence
  Synthetic
actgtttggcgggagtatggt

SEQ ID NO: 7355 - DNA, 21 bp, Artificial Sequence
  Synthetic
gcggagattggttgggcggcg

SEQ ID NO: 7356 - DNA, 21 bp, Artificial Sequence
  Synthetic
gggctgactggtaagtcgggg

SEQ ID NO: 7357 - DNA, 21 bp, Artificial Sequence
  Synthetic
tctgttagggcgccgtttttg

SEQ ID NO: 7358 - DNA, 21 bp, Artificial Sequence
  Synthetic
gctgagtgggttccgccgatg

SEQ ID NO: 7359 - DNA, 21 bp, Artificial Sequence
  Synthetic
aatgggatgcgtagtgtgttt

SEQ ID NO: 7360 - DNA, 21 bp, Artificial Sequence
  Synthetic
gggatgttttttgaggggatg

SEQ ID NO: 7361 - DNA, 21 bp, Artificial Sequence
  Synthetic
tcgccttggggtccgaatcat

SEQ ID NO: 7362 - DNA, 21 bp, Artificial Sequence
  Synthetic
gggagttggcttattgaggcg

SEQ ID NO: 7363 - DNA, 21 bp, Artificial Sequence
  Synthetic
ggggagcagttttgtgcgttt

SEQ ID NO: 7364 - DNA, 21 bp, Artificial Sequence
  Synthetic
attacgaagttgtgtactgtt

SEQ ID NO: 7365 - DNA, 21 bp, Artificial Sequence
  Synthetic
tttggtgttcttccgtttatg

SEQ ID NO: 7366 - DNA, 21 bp, Artificial Sequence
  Synthetic
tttattagtgggggtccttat

SEQ ID NO: 7367 - DNA, 21 bp, Artificial Sequence
  Synthetic
gatacgttgccgtttcggtat

SEQ ID NO: 7368 - DNA, 21 bp, Artificial Sequence
  Synthetic
atttggcggccgggtacggtt

SEQ ID NO: 7369 - DNA, 21 bp, Artificial Sequence
  Synthetic
aagtcgtcgtttgcttcgatt

SEQ ID NO: 7370 - DNA, 21 bp, Artificial Sequence
  Synthetic
tcgcctatggcgccgtttctt

SEQ ID NO: 7371 - DNA, 21 bp, Artificial Sequence
  Synthetic
gtgccggcgcggccgtttctg

SEQ ID NO: 7372 - DNA, 21 bp, Artificial Sequence
  Synthetic
gggcagtggattattgaggct

SEQ ID NO: 7373 - DNA, 21 bp, Artificial Sequence
  Synthetic
acggtgtgggctgagcggggt

SEQ ID NO: 7374 - DNA, 21 bp, Artificial Sequence
  Synthetic
acgggggggccggtgacgtgg

SEQ ID NO: 7375 - DNA, 21 bp, Artificial Sequence
  Synthetic
aatgatacgtattggactccg

SEQ ID NO: 7376 - DNA, 21 bp, Artificial Sequence
  Synthetic
acgccgctgggttgggctgct

SEQ ID NO: 7377 - DNA, 21 bp, Artificial Sequence
  Synthetic
gctccgtcttctattagttgg

SEQ ID NO: 7378 - DNA, 21 bp, Artificial Sequence
  Synthetic
aatagttgggggccgcagcat

SEQ ID NO: 7379 - DNA, 21 bp, Artificial Sequence
  Synthetic
agtgcgatgggttgggttgcg

SEQ ID NO: 7380 - DNA, 21 bp, Artificial Sequence
  Synthetic
agtctggagcgggtgtttagt

SEQ ID NO: 7381 - DNA, 21 bp, Artificial Sequence
  Synthetic
tgggctgagaatccgtttcgg

SEQ ID NO: 7382 - DNA, 21 bp, Artificial Sequence
  Synthetic
attgagtttgtgcctccgcgt

SEQ ID NO: 7383 - DNA, 21 bp, Artificial Sequence
  Synthetic
tgggagtttaattctcctcgg

SEQ ID NO: 7384 - DNA, 21 bp, Artificial Sequence
  Synthetic
gctcagtctaattatagttgg

SEQ ID NO: 7385 - DNA, 21 bp, Artificial Sequence
  Synthetic
attagtgttattccttatcct

SEQ ID NO: 7386 - DNA, 21 bp, Artificial Sequence
  Synthetic
tatactattgctgggcctcgg

SEQ ID NO: 7387 - DNA, 21 bp, Artificial Sequence
  Synthetic
gctccggctcagccttggcat

SEQ ID NO: 7388 - DNA, 21 bp, Artificial Sequence
  Synthetic
agtttgcgtgctccgtttaat

SEQ ID NO: 7389 - DNA, 21 bp, Artificial Sequence
  Synthetic
tctggtgagttgccgtggcgg

SEQ ID NO: 7390 - DNA, 21 bp, Artificial Sequence
  Synthetic
gattggcggggggataattgg

SEQ ID NO: 7391 - DNA, 21 bp, Artificial Sequence
  Synthetic
agtcgtgagcggccgtttacg

SEQ ID NO: 7392 - DNA, 21 bp, Artificial Sequence
  Synthetic
gggttgtggtttccgcagggt

SEQ ID NO: 7393 - DNA, 21 bp, Artificial Sequence
  Synthetic
aagacgagttttgcgtcggtg

SEQ ID NO: 7394 - DNA, 21 bp, Artificial Sequence
  Synthetic
tcggttgtggggtgggcggcg

SEQ ID NO: 7395 - DNA, 21 bp, Artificial Sequence
  Synthetic
attgggcgggcgcttggttat

SEQ ID NO: 7396 - DNA, 21 bp, Artificial Sequence
  Synthetic
catgcggtgggttgggttgcg

SEQ ID NO: 7397 - DNA, 21 bp, Artificial Sequence
  Synthetic
gtttatgattttggtaagttt

SEQ ID NO: 7398 - DNA, 21 bp, Artificial Sequence
  Synthetic
tttacgcagagttatccgatg

SEQ ID NO: 7399 - DNA, 21 bp, Artificial Sequence
  Synthetic
gggttgagtgggtgggttgcg

SEQ ID NO: 7400 - DNA, 21 bp, Artificial Sequence
  Synthetic
tatggtacgcatatttttacg

SEQ ID NO: 7401 - DNA, 21 bp, Artificial Sequence
  Synthetic
gagcctatgactatttcgtgg

SEQ ID NO: 7402 - DNA, 21 bp, Artificial Sequence
  Synthetic
tatgctaatcggccttttacg

SEQ ID NO: 7403 - DNA, 21 bp, Artificial Sequence
  Synthetic
gtgggtgctcggccgttgcag

SEQ ID NO: 7404 - DNA, 21 bp, Artificial Sequence
  Synthetic
tatgttgggtggccttttgcg

SEQ ID NO: 7405 - DNA, 21 bp, Artificial Sequence
  Synthetic
ctggggcatgctctggggacg

SEQ ID NO: 7406 - DNA, 21 bp, Artificial Sequence
  Synthetic
gatgtgtttaggttgcagggt

SEQ ID NO: 7407 - DNA, 21 bp, Artificial Sequence
  Synthetic
aatgggaagttttgtcaggtt

SEQ ID NO: 7408 - DNA, 21 bp, Artificial Sequence
  Synthetic
ggtatttggtttccgaatggt

SEQ ID NO: 7409 - DNA, 21 bp, Artificial Sequence
  Synthetic
ttttcgctgcatacttctgtg

SEQ ID NO: 7410 - DNA, 21 bp, Artificial Sequence
  Synthetic
gataggcagtggccgggttct

SEQ ID NO: 7411 - DNA, 21 bp, Artificial Sequence
  Synthetic
agtgcgggttggggggcgccg

SEQ ID NO: 7412 - DNA, 21 bp, Artificial Sequence
  Synthetic
ggtgattttagtcctcctatg

SEQ ID NO: 7413 - DNA, 21 bp, Artificial Sequence
  Synthetic
acggctcaggcgccttttcgg

SEQ ID NO: 7414 - DNA, 21 bp, Artificial Sequence
  Synthetic
gcgcagtcttttgctaatgtt

SEQ ID NO: 7415 - DNA, 21 bp, Artificial Sequence
  Synthetic
gttgatacgccgtgggttgct

SEQ ID NO: 7416 - DNA, 21 bp, Artificial Sequence
  Synthetic
tgtctttgggcgcctagtggg

SEQ ID NO: 7417 - DNA, 21 bp, Artificial Sequence
  Synthetic
caggggaagttttgtgatatt

SEQ ID NO: 7418 - DNA, 21 bp, Artificial Sequence
  Synthetic
aatacgctgcaggctagtcgg

SEQ ID NO: 7419 - DNA, 21 bp, Artificial Sequence
  Synthetic
tctcctattggttggagtgcg

SEQ ID NO: 7420 - DNA, 21 bp, Artificial Sequence
  Synthetic
ttgcggccgcgggataatggg

SEQ ID NO: 7421 - DNA, 21 bp, Artificial Sequence
  Synthetic
cctgttagtttttctaaggtt

SEQ ID NO: 7422 - DNA, 21 bp, Artificial Sequence
  Synthetic
ggtcgtttgcctgttattcct

SEQ ID NO: 7423 - DNA, 21 bp, Artificial Sequence
  Synthetic
caggtgaagttgtcgatggtg

SEQ ID NO: 7424 - DNA, 21 bp, Artificial Sequence
  Synthetic
tcgagtacgttttgtagtccg

SEQ ID NO: 7425 - DNA, 21 bp, Artificial Sequence
  Synthetic
tatccggagcgtctttttgcg

SEQ ID NO: 7426 - DNA, 21 bp, Artificial Sequence
  Synthetic
tggttgttggggggttcgggt

SEQ ID NO: 7427 - DNA, 21 bp, Artificial Sequence
  Synthetic
ccggagtctcgtgtttcttgg

SEQ ID NO: 7428 - DNA, 21 bp, Artificial Sequence
  Synthetic
cagctgaatttttcgaatatt

SEQ ID NO: 7429 - DNA, 21 bp, Artificial Sequence
  Synthetic
gggaaggaggggtttattgct

SEQ ID NO: 7430 - DNA, 21 bp, Artificial Sequence
  Synthetic
ggtctgagtccgtgggtggcg

SEQ ID NO: 7431 - DNA, 21 bp, Artificial Sequence
  Synthetic
ggttatccgcagctggggcct

SEQ ID NO: 7432 - DNA, 21 bp, Artificial Sequence
  Synthetic
tggactgaggcttggccgagg

SEQ ID NO: 7433 - DNA, 21 bp, Artificial Sequence
  Synthetic
gtgctgaatgggtctaatcgt

SEQ ID NO: 7434 - DNA, 21 bp, Artificial Sequence
  Synthetic
tcggatcggggttggacggct

SEQ ID NO: 7435 - DNA, 21 bp, Artificial Sequence
  Synthetic
tttacgcttgctagtccgcgg

SEQ ID NO: 7436 - DNA, 21 bp, Artificial Sequence
  Synthetic
acgccgtggatgccttttcag

SEQ ID NO: 7437 - DNA, 21 bp, Artificial Sequence
  Synthetic
gttgtggggggttggattgcg

SEQ ID NO: 7438 - DNA, 21 bp, Artificial Sequence
  Synthetic
tctcaggtggattggattaag

SEQ ID NO: 7439 - DNA, 21 bp, Artificial Sequence
  Synthetic
tcggtgattgtgccgtttagg

SEQ ID NO: 7440 - DNA, 21 bp, Artificial Sequence
  Synthetic
ggtctttgggagtcggggggt

SEQ ID NO: 7441 - DNA, 21 bp, Artificial Sequence
  Synthetic
cagcgtcgttttgaggaggtt

SEQ ID NO: 7442 - DNA, 21 bp, Artificial Sequence
  Synthetic
tgggtttgttggggttgtgag

SEQ ID NO: 7443 - DNA, 21 bp, Artificial Sequence
  Synthetic
ttggggcggccgcttggtatt

SEQ ID NO: 7444 - DNA, 21 bp, Artificial Sequence
  Synthetic
actttgtcgagggtttttcct

SEQ ID NO: 7445 - DNA, 21 bp, Artificial Sequence
  Synthetic
tttagtttgcgttatccgttg

SEQ ID NO: 7446 - DNA, 21 bp, Artificial Sequence
  Synthetic
tatgcgggtgtttggtttaat

SEQ ID NO: 7447 - DNA, 21 bp, Artificial Sequence
  Synthetic
acggtttggctgaaggcgggg

SEQ ID NO: 7448 - DNA, 21 bp, Artificial Sequence
  Synthetic
acgggtacgcgtccttttgtt

SEQ ID NO: 7449 - DNA, 21 bp, Artificial Sequence
  Synthetic
gttggtgttgctcttgggagg

SEQ ID NO: 7450 - DNA, 21 bp, Artificial Sequence
  Synthetic
ggggtgagtttttgtggggct

SEQ ID NO: 7451 - DNA, 21 bp, Artificial Sequence
  Synthetic
ccggtgacgcggacttcgtgg

SEQ ID NO: 7452 - DNA, 21 bp, Artificial Sequence
  Synthetic
aaggagtgtggttgggtgtgt

SEQ ID NO: 7453 - DNA, 21 bp, Artificial Sequence
  Synthetic
actattaggtttgagaatgtt

SEQ ID NO: 7454 - DNA, 21 bp, Artificial Sequence
  Synthetic
ttgctggtgcagctgtttggt

SEQ ID NO: 7455 - DNA, 21 bp, Artificial Sequence
  Synthetic
tttgatgagaggctgtttagg

SEQ ID NO: 7456 - DNA, 21 bp, Artificial Sequence
  Synthetic
cagcctacttctccgtggctt

SEQ ID NO: 7457 - DNA, 21 bp, Artificial Sequence
  Synthetic
agtggtgttgcgcttggtcgt

SEQ ID NO: 7458 - DNA, 21 bp, Artificial Sequence
  Synthetic
cagaataggctggcgatggtt

SEQ ID NO: 7459 - DNA, 21 bp, Artificial Sequence
  Synthetic
actgtttggcgtctggagggt

SEQ ID NO: 7460 - DNA, 21 bp, Artificial Sequence
  Synthetic
tgtggtcgggctcttggtact

SEQ ID NO: 7461 - DNA, 21 bp, Artificial Sequence
  Synthetic
gatccttttagtgagaggcgg

SEQ ID NO: 7462 - DNA, 21 bp, Artificial Sequence
  Synthetic
aagacggagtggccttatccg

SEQ ID NO: 7463 - DNA, 21 bp, Artificial Sequence
  Synthetic
aatgcggttgggtggcttgcg

SEQ ID NO: 7464 - DNA, 21 bp, Artificial Sequence
  Synthetic
gcgacgtttacgccgccgagg

SEQ ID NO: 7465 - DNA, 21 bp, Artificial Sequence
  Synthetic
gatcttcgttggccgggttct

SEQ ID NO: 7466 - DNA, 21 bp, Artificial Sequence
  Synthetic
gatactacgccttggttgccg

SEQ ID NO: 7467 - DNA, 21 bp, Artificial Sequence
  Synthetic
tttttgaatccgtggcctgct

SEQ ID NO: 7468 - DNA, 21 bp, Artificial Sequence
  Synthetic
tatgcgactcagtttttttct

SEQ ID NO: 7469 - DNA, 21 bp, Artificial Sequence
  Synthetic
aatgctattcggccttttatt

SEQ ID NO: 7470 - DNA, 21 bp, Artificial Sequence
  Synthetic
tcggctatggggtttattgcg

SEQ ID NO: 7471 - DNA, 21 bp, Artificial Sequence
  Synthetic
tatgttgggcggatttgggag

SEQ ID NO: 7472 - DNA, 21 bp, Artificial Sequence
  Synthetic
acttgtgcgaagccgtttttg

SEQ ID NO: 7473 - DNA, 21 bp, Artificial Sequence
  Synthetic
tatcttagtaagccttttgtg

SEQ ID NO: 7474 - DNA, 21 bp, Artificial Sequence
  Synthetic
gggttgtatgggtttgttgct

SEQ ID NO: 7475 - DNA, 21 bp, Artificial Sequence
  Synthetic
gttgatggttggtatgctcct

SEQ ID NO: 7476 - DNA, 21 bp, Artificial Sequence
  Synthetic
gcgggtgggccgtggattgcg

SEQ ID NO: 7477 - DNA, 21 bp, Artificial Sequence
  Synthetic
ggtgtttatattccgccggcg

SEQ ID NO: 7478 - DNA, 21 bp, Artificial Sequence
  Synthetic
ctgatgcgtgtgccgcctatt

SEQ ID NO: 7479 - DNA, 21 bp, Artificial Sequence
  Synthetic
ttgggggttccgtttgggcgt

SEQ ID NO: 7480 - DNA, 21 bp, Artificial Sequence
  Synthetic
gttggtcgggcgcttggggtt

SEQ ID NO: 7481 - DNA, 21 bp, Artificial Sequence
  Synthetic
actcgtcttgggtttttgccg

SEQ ID NO: 7482 - DNA, 21 bp, Artificial Sequence
  Synthetic
tttggtgttggtttggctgtg

SEQ ID NO: 7483 - DNA, 21 bp, Artificial Sequence
  Synthetic
tatccgatgtctctttcgttt

SEQ ID NO: 7484 - DNA, 21 bp, Artificial Sequence
  Synthetic
agtaatcattttgcgaatgtg

SEQ ID NO: 7485 - DNA, 21 bp, Artificial Sequence
  Synthetic
gatatgtcttggggtgcgttt

SEQ ID NO: 7486 - DNA, 21 bp, Artificial Sequence
  Synthetic
gagaagagttggggtgcgttt

SEQ ID NO: 7487 - DNA, 21 bp, Artificial Sequence
  Synthetic
acgaaggagctgccttttcgg

SEQ ID NO: 7488 - DNA, 21 bp, Artificial Sequence
  Synthetic
catcagtttgcgcctcctgct

SEQ ID NO: 7489 - DNA, 21 bp, Artificial Sequence
  Synthetic
gggtatcttacttttgtggcg

SEQ ID NO: 7490 - DNA, 21 bp, Artificial Sequence
  Synthetic
gagaagtcgttttgtaaggag

SEQ ID NO: 7491 - DNA, 21 bp, Artificial Sequence
  Synthetic
gatgggactccttggctggct

SEQ ID NO: 7492 - DNA, 21 bp, Artificial Sequence
  Synthetic
aagacttcgaatgcgcatagt

SEQ ID NO: 7493 - DNA, 21 bp, Artificial Sequence
  Synthetic
ttgggtaggcctctggggtcg

SEQ ID NO: 7494 - DNA, 21 bp, Artificial Sequence
  Synthetic
gtgggtaggccgattgggatg

SEQ ID NO: 7495 - DNA, 21 bp, Artificial Sequence
  Synthetic
cataagactgggtgggtggcg

SEQ ID NO: 7496 - DNA, 21 bp, Artificial Sequence
  Synthetic
gcgctgcctagggattggctt

SEQ ID NO: 7497 - DNA, 21 bp, Artificial Sequence
  Synthetic
agttatattcttccttttcat

SEQ ID NO: 7498 - DNA, 21 bp, Artificial Sequence
  Synthetic
ccgcggagtggttttaatacg

SEQ ID NO: 7499 - DNA, 21 bp, Artificial Sequence
  Synthetic
aatatgtggtttccggggggt

SEQ ID NO: 7500 - DNA, 21 bp, Artificial Sequence
  Synthetic
gatcttaatcgtccgtttcgg

SEQ ID NO: 7501 - DNA, 21 bp, Artificial Sequence
  Synthetic
tcgtctaggtttgctgaggtt

SEQ ID NO: 7502 - DNA, 21 bp, Artificial Sequence
  Synthetic
actattgtgatgccgtttgtg

SEQ ID NO: 7503 - DNA, 21 bp, Artificial Sequence
  Synthetic
acgttggaggctctttttcgt

SEQ ID NO: 7504 - DNA, 21 bp, Artificial Sequence
  Synthetic
attggtgtggtgccgtttcat

SEQ ID NO: 7505 - DNA, 21 bp, Artificial Sequence
  Synthetic
actgaggctgcgttttttcgt

SEQ ID NO: 7506 - DNA, 21 bp, Artificial Sequence
  Synthetic
gatgtgtttcgtttgggttct

SEQ ID NO: 7507 - DNA, 21 bp, Artificial Sequence
  Synthetic
gagacggggtggccgggggct

SEQ ID NO: 7508 - DNA, 21 bp, Artificial Sequence
  Synthetic
cttgagtggactccgccgcgt

SEQ ID NO: 7509 - DNA, 21 bp, Artificial Sequence
  Synthetic
gggacttttcttcctcctacg

SEQ ID NO: 7510 - DNA, 21 bp, Artificial Sequence
  Synthetic
attgtgccgagtccttttcgg

SEQ ID NO: 7511 - DNA, 21 bp, Artificial Sequence
  Synthetic
cggacgtgggagggggggggg

SEQ ID NO: 7512 - DNA, 21 bp, Artificial Sequence
  Synthetic
gttgattttgttccgccgagg

SEQ ID NO: 7513 - DNA, 21 bp, Artificial Sequence
  Synthetic
aatcctactactacgtggcgt

SEQ ID NO: 7514 - DNA, 21 bp, Artificial Sequence
  Synthetic
gggatggttgggtgggttcct

SEQ ID NO: 7515 - DNA, 21 bp, Artificial Sequence
  Synthetic
gatgtttggcgtaaggagggg

SEQ ID NO: 7516 - DNA, 21 bp, Artificial Sequence
  Synthetic
tatagtgataggatgtttctt

SEQ ID NO: 7517 - DNA, 21 bp, Artificial Sequence
  Synthetic
actgggacgccttggctggct

SEQ ID NO: 7518 - DNA, 21 bp, Artificial Sequence
  Synthetic
cttactatttcgacttctagg

SEQ ID NO: 7519 - DNA, 21 bp, Artificial Sequence
  Synthetic
gtggctgagttttgtagggtg

SEQ ID NO: 7520 - DNA, 21 bp, Artificial Sequence
  Synthetic
agtgagcatcgtccgtttatt

SEQ ID NO: 7521 - DNA, 21 bp, Artificial Sequence
  Synthetic
gggtggcttgggtttgctgct

SEQ ID NO: 7522 - DNA, 21 bp, Artificial Sequence
  Synthetic
acggtggcgaggttgtttgtt

SEQ ID NO: 7523 - DNA, 21 bp, Artificial Sequence
  Synthetic
tatgggactagtcctttttat

SEQ ID NO: 7524 - DNA, 21 bp, Artificial Sequence
  Synthetic
agtgctagttggccgtttgct

SEQ ID NO: 7525 - DNA, 21 bp, Artificial Sequence
  Synthetic
catgctgtgccgtgggttgct

SEQ ID NO: 7526 - DNA, 21 bp, Artificial Sequence
  Synthetic
caggtgcgttttcagtctgtg

SEQ ID NO: 7527 - DNA, 21 bp, Artificial Sequence
  Synthetic
tgggagcgtttttctcatgtg

SEQ ID NO: 7528 - DNA, 21 bp, Artificial Sequence
  Synthetic
agtgtgcggatgccttttaat

SEQ ID NO: 7529 - DNA, 21 bp, Artificial Sequence
  Synthetic
agtggggatcggccttttctt

SEQ ID NO: 7530 - DNA, 21 bp, Artificial Sequence
  Synthetic
tatgtggataagttttttctt

SEQ ID NO: 7531 - DNA, 21 bp, Artificial Sequence
  Synthetic
acgcagaagctgccttggacg

SEQ ID NO: 7532 - DNA, 21 bp, Artificial Sequence
  Synthetic
ccgaggattgtgaatacttat

SEQ ID NO: 7533 - DNA, 21 bp, Artificial Sequence
  Synthetic
actccggcggctccgtttttg

SEQ ID NO: 7534 - DNA, 21 bp, Artificial Sequence
  Synthetic
tttgatgagaggtattgggcg

SEQ ID NO: 7535 - DNA, 21 bp, Artificial Sequence
  Synthetic
gggatttttgcgcgtccgatg

SEQ ID NO: 7536 - DNA, 21 bp, Artificial Sequence
  Synthetic
ttgggtttttctccgcctcat

SEQ ID NO: 7537 - DNA, 21 bp, Artificial Sequence
  Synthetic
gtgggtgttgcgttgggtcat

SEQ ID NO: 7538 - DNA, 21 bp, Artificial Sequence
  Synthetic
tatgatggttatttgtttacg

SEQ ID NO: 7539 - DNA, 21 bp, Artificial Sequence
  Synthetic
tatccgtctcgtccttttgtg

SEQ ID NO: 7540 - DNA, 21 bp, Artificial Sequence
  Synthetic
cagccggctaatacgtcttgg

SEQ ID NO: 7541 - DNA, 21 bp, Artificial Sequence
  Synthetic
cctgaggttaagcattgggtg

SEQ ID NO: 7542 - DNA, 21 bp, Artificial Sequence
  Synthetic
gctcctatggggtgggcggcg

SEQ ID NO: 7543 - DNA, 21 bp, Artificial Sequence
  Synthetic
actactatgcatactagtaag

SEQ ID NO: 7544 - DNA, 21 bp, Artificial Sequence
  Synthetic
tggaaggtgtttcaggatgtg

SEQ ID NO: 7545 - DNA, 21 bp, Artificial Sequence
  Synthetic
gatcctatttggaagagtagt

SEQ ID NO: 7546 - DNA, 21 bp, Artificial Sequence
  Synthetic
tctaaggttgggtgggcgccg

SEQ ID NO: 7547 - DNA, 21 bp, Artificial Sequence
  Synthetic
cttgattttaagtctatgcat

SEQ ID NO: 7548 - DNA, 21 bp, Artificial Sequence
  Synthetic
aaggatgtttttcatcttttg

SEQ ID NO: 7549 - DNA, 21 bp, Artificial Sequence
  Synthetic
gagcctgttcggggttggctg

SEQ ID NO: 7550 - DNA, 21 bp, Artificial Sequence
  Synthetic
ggtggggctgttactaggctg

SEQ ID NO: 7551 - DNA, 21 bp, Artificial Sequence
  Synthetic
agtaggactgggtggacggcg

SEQ ID NO: 7552 - DNA, 21 bp, Artificial Sequence
  Synthetic
ggggtgtgggttccgcctagt

SEQ ID NO: 7553 - DNA, 21 bp, Artificial Sequence
  Synthetic
agtgagatgcagccttttcgt

SEQ ID NO: 7554 - DNA, 21 bp, Artificial Sequence
  Synthetic
tttgatagtagtgggcctcgg

SEQ ID NO: 7555 - DNA, 21 bp, Artificial Sequence
  Synthetic
aatgatttgccgtataggtat

SEQ ID NO: 7556 - DNA, 21 bp, Artificial Sequence
  Synthetic
ggggggtttattcctccggag

SEQ ID NO: 7557 - DNA, 21 bp, Artificial Sequence
  Synthetic
acgatgggtcatttgcttagg

SEQ ID NO: 7558 - DNA, 21 bp, Artificial Sequence
  Synthetic
ccgattagttcgtctagttgg

SEQ ID NO: 7559 - DNA, 21 bp, Artificial Sequence
  Synthetic
gatgattggggttttgttgct

SEQ ID NO: 7560 - DNA, 21 bp, Artificial Sequence
  Synthetic
acggcgagtatgccttttctg

SEQ ID NO: 7561 - DNA, 21 bp, Artificial Sequence
  Synthetic
ggtaggtttgttcctcctcag

SEQ ID NO: 7562 - DNA, 21 bp, Artificial Sequence
  Synthetic
gcggcggtgtttcatgagatt

SEQ ID NO: 7563 - DNA, 21 bp, Artificial Sequence
  Synthetic
tgggatctggttgggccgcgg

SEQ ID NO: 7564 - DNA, 21 bp, Artificial Sequence
  Synthetic
gataaggatgttgcttctagt

SEQ ID NO: 7565 - DNA, 21 bp, Artificial Sequence
  Synthetic
tctgcggttcattgggctcct

SEQ ID NO: 7566 - DNA, 21 bp, Artificial Sequence
  Synthetic
acgcttaattatccgtttatt

SEQ ID NO: 7567 - DNA, 21 bp, Artificial Sequence
  Synthetic
tcgttgatttttaagaatgtg

SEQ ID NO: 7568 - DNA, 21 bp, Artificial Sequence
  Synthetic
aatgagttggggtggcatcct

SEQ ID NO: 7569 - DNA, 21 bp, Artificial Sequence
  Synthetic
ggggttagttataatccgttt

SEQ ID NO: 7570 - DNA, 21 bp, Artificial Sequence
  Synthetic
tctgttgagaagccgttttgg

SEQ ID NO: 7571 - DNA, 21 bp, Artificial Sequence
  Synthetic
acggagtattttccttttaag

SEQ ID NO: 7572 - DNA, 21 bp, Artificial Sequence
  Synthetic
gatatgacgaagccgtggttg

SEQ ID NO: 7573 - DNA, 21 bp, Artificial Sequence
  Synthetic
tctctttcgaagccgtttgcg

SEQ ID NO: 7574 - DNA, 21 bp, Artificial Sequence
  Synthetic
gagaagcatcctcattttttg

SEQ ID NO: 7575 - DNA, 21 bp, Artificial Sequence
  Synthetic
caggtgagttttgaggtgatt

SEQ ID NO: 7576 - DNA, 21 bp, Artificial Sequence
  Synthetic
ggggtttctttttgtccggtg

SEQ ID NO: 7577 - DNA, 21 bp, Artificial Sequence
  Synthetic
ggggctttgccgattgtgcct

SEQ ID NO: 7578 - DNA, 21 bp, Artificial Sequence
  Synthetic
caggttgtttttcagtatgtg

SEQ ID NO: 7579 - DNA, 21 bp, Artificial Sequence
  Synthetic
gaggggaatccgtggagggcg

SEQ ID NO: 7580 - DNA, 21 bp, Artificial Sequence
  Synthetic
ggtattacggtgccgtttcgg

SEQ ID NO: 7581 - DNA, 21 bp, Artificial Sequence
  Synthetic
attacgatttctacttctaag

SEQ ID NO: 7582 - DNA, 21 bp, Artificial Sequence
  Synthetic
ggtaagtggtctcctcctgct

SEQ ID NO: 7583 - DNA, 21 bp, Artificial Sequence
  Synthetic
gcgttgcagcggtttccgttg

SEQ ID NO: 7584 - DNA, 21 bp, Artificial Sequence
  Synthetic
tttgatcatgcgggtccgcgg

SEQ ID NO: 7585 - DNA, 21 bp, Artificial Sequence
  Synthetic
ggtacgtcggggtggattgcg

SEQ ID NO: 7586 - DNA, 21 bp, Artificial Sequence
  Synthetic
tatccggagcgtgtgtttgtg

SEQ ID NO: 7587 - DNA, 21 bp, Artificial Sequence
  Synthetic
tggggtcatgctcatgagagg

SEQ ID NO: 7588 - DNA, 21 bp, Artificial Sequence
  Synthetic
tctgttgtgtttgagagggtt

SEQ ID NO: 7589 - DNA, 21 bp, Artificial Sequence
  Synthetic
ggttcttggattgttgaggcg

SEQ ID NO: 7590 - DNA, 21 bp, Artificial Sequence
  Synthetic
aatcttgcgaattttgctagt

SEQ ID NO: 7591 - DNA, 21 bp, Artificial Sequence
  Synthetic
attttgaagggggcggctgtg

SEQ ID NO: 7592 - DNA, 21 bp, Artificial Sequence
  Synthetic
tttactgctgttggtccgaag

SEQ ID NO: 7593 - DNA, 21 bp, Artificial Sequence
  Synthetic
agtacgtctaagcctttttat

SEQ ID NO: 7594 - DNA, 21 bp, Artificial Sequence
  Synthetic
gggccgattgggtttattcct

SEQ ID NO: 7595 - DNA, 21 bp, Artificial Sequence
  Synthetic
ttgcagtggtcgccgccgaag

SEQ ID NO: 7596 - DNA, 21 bp, Artificial Sequence
  Synthetic
tgggatgagtatccgcggccg

SEQ ID NO: 7597 - DNA, 21 bp, Artificial Sequence
  Synthetic
cctttgaagttttcgaatgtg

SEQ ID NO: 7598 - DNA, 21 bp, Artificial Sequence
  Synthetic
tattcggagcggatttttcat

SEQ ID NO: 7599 - DNA, 21 bp, Artificial Sequence
  Synthetic
gctgcggggtggggtgctgcg

SEQ ID NO: 7600 - DNA, 21 bp, Artificial Sequence
  Synthetic
agtgtgcatggtttttatccg

SEQ ID NO: 7601 - DNA, 21 bp, Artificial Sequence
  Synthetic
gggttgggggggtggattgct

SEQ ID NO: 7602 - DNA, 21 bp, Artificial Sequence
  Synthetic
gagaatactgtttgggttccg

SEQ ID NO: 7603 - DNA, 21 bp, Artificial Sequence
  Synthetic
aattatgataagccgtggatt

SEQ ID NO: 7604 - DNA, 21 bp, Artificial Sequence
  Synthetic
gtgggtgtgcctcttgggaag

SEQ ID NO: 7605 - DNA, 21 bp, Artificial Sequence
  Synthetic
tctcttagtaatccgtttacg

SEQ ID NO: 7606 - DNA, 21 bp, Artificial Sequence
  Synthetic
actagggatgtgccttggctg

SEQ ID NO: 7607 - DNA, 21 bp, Artificial Sequence
  Synthetic
gggccgcagatgccgtttaag

SEQ ID NO: 7608 - DNA, 21 bp, Artificial Sequence
  Synthetic
ctttatggtcattatggtcct

SEQ ID NO: 7609 - DNA, 21 bp, Artificial Sequence
  Synthetic
gcgctttgggctgatgtgaat

SEQ ID NO: 7610 - DNA, 21 bp, Artificial Sequence
  Synthetic
catgggcagtggcctacgggt

SEQ ID NO: 7611 - DNA, 21 bp, Artificial Sequence
  Synthetic
tgggcgcagcctaatacgaag

SEQ ID NO: 7612 - DNA, 21 bp, Artificial Sequence
  Synthetic
gataggactagtagtcgtact

SEQ ID NO: 7613 - DNA, 21 bp, Artificial Sequence
  Synthetic
gggcagtttctgcatcctcat

SEQ ID NO: 7614 - DNA, 21 bp, Artificial Sequence
  Synthetic
cagcctactttttgtgtggcg

SEQ ID NO: 7615 - DNA, 21 bp, Artificial Sequence
  Synthetic
cctcagagtttttcgaatgtt

SEQ ID NO: 7616 - DNA, 21 bp, Artificial Sequence
  Synthetic
ttgggggctatgccgtttctt

SEQ ID NO: 7617 - DNA, 21 bp, Artificial Sequence
  Synthetic
agtgtgaagtgggcggagttt

SEQ ID NO: 7618 - DNA, 21 bp, Artificial Sequence
  Synthetic
gtgggtgtttttcctcctaag

SEQ ID NO: 7619 - DNA, 21 bp, Artificial Sequence
  Synthetic
cttaatttggggtttcatccg

SEQ ID NO: 7620 - DNA, 21 bp, Artificial Sequence
  Synthetic
tatagtcaggctttgtttaag

SEQ ID NO: 7621 - DNA, 21 bp, Artificial Sequence
  Synthetic
tttacgttgcgtagtcctctt

SEQ ID NO: 7622 - DNA, 21 bp, Artificial Sequence
  Synthetic
cttgggcgtcctctgggtcat

SEQ ID NO: 7623 - DNA, 21 bp, Artificial Sequence
  Synthetic
tcgatgcgttttgagcatatt

SEQ ID NO: 7624 - DNA, 21 bp, Artificial Sequence
  Synthetic
acggtgactaggatgtttgtt

SEQ ID NO: 7625 - DNA, 21 bp, Artificial Sequence
  Synthetic
aatgttgagcatgtgtttcgg

SEQ ID NO: 7626 - DNA, 21 bp, Artificial Sequence
  Synthetic
ctgactttgactagttcgatt

SEQ ID NO: 7627 - DNA, 21 bp, Artificial Sequence
  Synthetic
tggcttgagaggccgtttgct

SEQ ID NO: 7628 - DNA, 21 bp, Artificial Sequence
  Synthetic
cttcctacgcagatttggcag

SEQ ID NO: 7629 - DNA, 21 bp, Artificial Sequence
  Synthetic
acgacgctgattccgtttcat

SEQ ID NO: 7630 - DNA, 21 bp, Artificial Sequence
  Synthetic
gctcggaatgatgggcggtat

SEQ ID NO: 7631 - DNA, 21 bp, Artificial Sequence
  Synthetic
ggtgaggtgcgtcagttttgt

SEQ ID NO: 7632 - DNA, 21 bp, Artificial Sequence
  Synthetic
gctgcggagggttgggtggcg

SEQ ID NO: 7633 - DNA, 21 bp, Artificial Sequence
  Synthetic
ggggtgtttctgcctccgatg

SEQ ID NO: 7634 - DNA, 21 bp, Artificial Sequence
  Synthetic
gggggtgcgcggcgtgatagt

SEQ ID NO: 7635 - DNA, 21 bp, Artificial Sequence
  Synthetic
cattattcggcttttaatgat

SEQ ID NO: 7636 - DNA, 21 bp, Artificial Sequence
  Synthetic
tggggtgtgagtccttttcat

SEQ ID NO: 7637 - DNA, 21 bp, Artificial Sequence
  Synthetic
gagacggatgtgtttaggagg

SEQ ID NO: 7638 - DNA, 21 bp, Artificial Sequence
  Synthetic
gcgcctgttgtgccttcgctg

SEQ ID NO: 7639 - DNA, 21 bp, Artificial Sequence
  Synthetic
gttggtttggcgccgcctcgt

SEQ ID NO: 7640 - DNA, 21 bp, Artificial Sequence
  Synthetic
tggaatcgtattggttctgtg

SEQ ID NO: 7641 - DNA, 21 bp, Artificial Sequence
  Synthetic
gtttttacgcaggcgcggatg

SEQ ID NO: 7642 - DNA, 21 bp, Artificial Sequence
  Synthetic
tgggagggtggttctcgttat

SEQ ID NO: 7643 - DNA, 21 bp, Artificial Sequence
  Synthetic
acggatactcagtattttcgg

SEQ ID NO: 7644 - DNA, 21 bp, Artificial Sequence
  Synthetic
gggcgttttgatcctcctgct

SEQ ID NO: 7645 - DNA, 21 bp, Artificial Sequence
  Synthetic
ttgcctagtagggtgtttctt

SEQ ID NO: 7646 - DNA, 21 bp, Artificial Sequence
  Synthetic
tcgcaggatcgtccttttatt

SEQ ID NO: 7647 - DNA, 21 bp, Artificial Sequence
  Synthetic
agtcctcagttttgtacgagt

SEQ ID NO: 7648 - DNA, 21 bp, Artificial Sequence
  Synthetic
ggtcattttgcgcctccgcat

SEQ ID NO: 7649 - DNA, 21 bp, Artificial Sequence
  Synthetic
aatccgtggcatcctacgggt

SEQ ID NO: 7650 - DNA, 21 bp, Artificial Sequence
  Synthetic
gcgagttttaatcctcctagg

SEQ ID NO: 7651 - DNA, 21 bp, Artificial Sequence
  Synthetic
cagaggtcttttgcggttcag

SEQ ID NO: 7652 - DNA, 21 bp, Artificial Sequence
  Synthetic
agtccggagtggggtaatttt

SEQ ID NO: 7653 - DNA, 21 bp, Artificial Sequence
  Synthetic
agtctggagcggccgtttatt

SEQ ID NO: 7654 - DNA, 21 bp, Artificial Sequence
  Synthetic
tggactgagtttgcgcgtgtt

SEQ ID NO: 7655 - DNA, 21 bp, Artificial Sequence
  Synthetic
acggttagtgcgccttttatt

SEQ ID NO: 7656 - DNA, 21 bp, Artificial Sequence
  Synthetic
attgggattaggcttggttat

SEQ ID NO: 7657 - DNA, 21 bp, Artificial Sequence
  Synthetic
cataggactgggtgggcggct

SEQ ID NO: 7658 - DNA, 21 bp, Artificial Sequence
  Synthetic
gtgaaggggtggtatctggag

SEQ ID NO: 7659 - DNA, 21 bp, Artificial Sequence
  Synthetic
attgagcgggagtggcgtacg

SEQ ID NO: 7660 - DNA, 21 bp, Artificial Sequence
  Synthetic
gggttgtttactccgccgtcg

SEQ ID NO: 7661 - DNA, 21 bp, Artificial Sequence
  Synthetic
gttacttttaatacgccgcgg

SEQ ID NO: 7662 - DNA, 21 bp, Artificial Sequence
  Synthetic
atggggattaatagtattttt

SEQ ID NO: 7663 - DNA, 21 bp, Artificial Sequence
  Synthetic
ggttcttggacgcctccggag

SEQ ID NO: 7664 - DNA, 21 bp, Artificial Sequence
  Synthetic
gcgtatcctttttttatggag

SEQ ID NO: 7665 - DNA, 21 bp, Artificial Sequence
  Synthetic
tttgattctcatgggccgcgt

SEQ ID NO: 7666 - DNA, 21 bp, Artificial Sequence
  Synthetic
attactggtgttaataatcgg

SEQ ID NO: 7667 - DNA, 21 bp, Artificial Sequence
  Synthetic
actattaagtatggggttttt

SEQ ID NO: 7668 - DNA, 21 bp, Artificial Sequence
  Synthetic
ggtgattgggtttataaggct

SEQ ID NO: 7669 - DNA, 21 bp, Artificial Sequence
  Synthetic
tctatgtctcagctgtttaag

SEQ ID NO: 7670 - DNA, 21 bp, Artificial Sequence
  Synthetic
aaggtgcgttttgagtctgtg

SEQ ID NO: 7671 - DNA, 21 bp, Artificial Sequence
  Synthetic
tttgatattaatggtcctagg

SEQ ID NO: 7672 - DNA, 21 bp, Artificial Sequence
  Synthetic
aatgatgctgctttttttagg

SEQ ID NO: 7673 - DNA, 21 bp, Artificial Sequence
  Synthetic
cttgatagtccgtttttgccg

SEQ ID NO: 7674 - DNA, 21 bp, Artificial Sequence
  Synthetic
cttaggtttgatgggcatgtt

SEQ ID NO: 7675 - DNA, 21 bp, Artificial Sequence
  Synthetic
cagcagcctttttttctttcg

SEQ ID NO: 7676 - DNA, 21 bp, Artificial Sequence
  Synthetic
aatgcgcagttttgtactgtg

SEQ ID NO: 7677 - DNA, 21 bp, Artificial Sequence
  Synthetic
agtgttacgaatccgtgggtt

SEQ ID NO: 7678 - DNA, 21 bp, Artificial Sequence
  Synthetic
ctgcagcgggttatttctcct

SEQ ID NO: 7679 - DNA, 21 bp, Artificial Sequence
  Synthetic
agtaaggtgtttgctagtgtt

SEQ ID NO: 7680 - DNA, 21 bp, Artificial Sequence
  Synthetic
attcctggttggtatacgtcg

SEQ ID NO: 7681 - DNA, 21 bp, Artificial Sequence
  Synthetic
acttattgggcggtgaatggt

SEQ ID NO: 7682 - DNA, 21 bp, Artificial Sequence
  Synthetic
acgattcagagtctgtttgcg

SEQ ID NO: 7683 - DNA, 21 bp, Artificial Sequence
  Synthetic
gagcagcggtttgggatgttt

SEQ ID NO: 7684 - DNA, 21 bp, Artificial Sequence
  Synthetic
gtggctggtcggccttttttg

SEQ ID NO: 7685 - DNA, 21 bp, Artificial Sequence
  Synthetic
gcggggcgtccgttgggtacg

SEQ ID NO: 7686 - DNA, 21 bp, Artificial Sequence
  Synthetic
gtggtgcctaagggttggttg

SEQ ID NO: 7687 - DNA, 21 bp, Artificial Sequence
  Synthetic
ttgactttgcagacttctgtg

SEQ ID NO: 7688 - DNA, 21 bp, Artificial Sequence
  Synthetic
agtagggagtttaagcttgtg

SEQ ID NO: 7689 - DNA, 21 bp, Artificial Sequence
  Synthetic
tatgcggataagccttttctg

SEQ ID NO: 7690 - DNA, 21 bp, Artificial Sequence
  Synthetic
atgccgaattgggtggtgcct

SEQ ID NO: 7691 - DNA, 21 bp, Artificial Sequence
  Synthetic
ggggcgtgggttatttcggcg

SEQ ID NO: 7692 - DNA, 21 bp, Artificial Sequence
  Synthetic
gatggtcttccttttctgagg

SEQ ID NO: 7693 - DNA, 21 bp, Artificial Sequence
  Synthetic
agtattgtgaggccttttgtg

SEQ ID NO: 7694 - DNA, 21 bp, Artificial Sequence
  Synthetic
caggttagttttactactatt

SEQ ID NO: 7695 - DNA, 21 bp, Artificial Sequence
  Synthetic
gatgcggggtggggtaagttt

SEQ ID NO: 7696 - DNA, 21 bp, Artificial Sequence
  Synthetic
ggtttggatatgccttttcgg

SEQ ID NO: 7697 - DNA, 21 bp, Artificial Sequence
  Synthetic
actccttctgctccttggatg

SEQ ID NO: 7698 - DNA, 21 bp, Artificial Sequence
  Synthetic
ctggggcggccgtttggtcat

SEQ ID NO: 7699 - DNA, 21 bp, Artificial Sequence
  Synthetic
gctttgcagggttgggctgct

SEQ ID NO: 7700 - DNA, 21 bp, Artificial Sequence
  Synthetic
cagacttttgtgccgcctgcg

SEQ ID NO: 7701 - DNA, 21 bp, Artificial Sequence
  Synthetic
ttgggtgtgcgtattggttat

SEQ ID NO: 7702 - DNA, 21 bp, Artificial Sequence
  Synthetic
ttttctaagttgacgccgagt

SEQ ID NO: 7703 - DNA, 21 bp, Artificial Sequence
  Synthetic
atttcttttcttcgtcctgat

SEQ ID NO: 7704 - DNA, 21 bp, Artificial Sequence
  Synthetic
aatgtgtggcggagtgatggt

SEQ ID NO: 7705 - DNA, 21 bp, Artificial Sequence
  Synthetic
aatgtttggcatattgcgggg

SEQ ID NO: 7706 - DNA, 21 bp, Artificial Sequence
  Synthetic
tctgagggttggcctgggagt

SEQ ID NO: 7707 - DNA, 21 bp, Artificial Sequence
  Synthetic
caggttaattttacgagggtg

SEQ ID NO: 7708 - DNA, 21 bp, Artificial Sequence
  Synthetic
ggtgttccgtctaagcatacg

SEQ ID NO: 7709 - DNA, 21 bp, Artificial Sequence
  Synthetic
tcgattgctcggccttttacg

SEQ ID NO: 7710 - DNA, 21 bp, Artificial Sequence
  Synthetic
ctgctggatcgtccttggacg

SEQ ID NO: 7711 - DNA, 21 bp, Artificial Sequence
  Synthetic
gagggtagtattgttctgagg

SEQ ID NO: 7712 - DNA, 21 bp, Artificial Sequence
  Synthetic
ccggcgattgcgaatctgctt

SEQ ID NO: 7713 - DNA, 21 bp, Artificial Sequence
  Synthetic
gggtatagtcatgctggtagg

SEQ ID NO: 7714 - DNA, 21 bp, Artificial Sequence
  Synthetic
tatgggtctaatcctttttat

SEQ ID NO: 7715 - DNA, 21 bp, Artificial Sequence
  Synthetic
tctgattggcggaatttgatt

SEQ ID NO: 7716 - DNA, 21 bp, Artificial Sequence
  Synthetic
gtgtttccgttttttactgat

SEQ ID NO: 7717 - DNA, 21 bp, Artificial Sequence
  Synthetic
gggactatggggtggactgct

SEQ ID NO: 7718 - DNA, 21 bp, Artificial Sequence
  Synthetic
aggtcgtgggatgggggtggg

SEQ ID NO: 7719 - DNA, 21 bp, Artificial Sequence
  Synthetic
tttagtgagttttgtaagcag

SEQ ID NO: 7720 - DNA, 21 bp, Artificial Sequence
  Synthetic
gtggttaggtttgagcagatt

SEQ ID NO: 7721 - DNA, 21 bp, Artificial Sequence
  Synthetic
gcgtatgtttttaaggatgtg

SEQ ID NO: 7722 - DNA, 21 bp, Artificial Sequence
  Synthetic
actgtgaatgctccgtggcat

SEQ ID NO: 7723 - DNA, 21 bp, Artificial Sequence
  Synthetic
ggtacgtggcatgatatggtg

SEQ ID NO: 7724 - DNA, 21 bp, Artificial Sequence
  Synthetic
ggtagggggaattggacgagt

SEQ ID NO: 7725 - DNA, 21 bp, Artificial Sequence
  Synthetic
tctgctgctgggtgggtgcat

SEQ ID NO: 7726 - DNA, 21 bp, Artificial Sequence
  Synthetic
caggttaagtttctggctgtt

SEQ ID NO: 7727 - DNA, 21 bp, Artificial Sequence
  Synthetic
aattctgctggttgggtggct

SEQ ID NO: 7728 - DNA, 21 bp, Artificial Sequence
  Synthetic
tttactagtaagtatccgatg

SEQ ID NO: 7729 - DNA, 21 bp, Artificial Sequence
  Synthetic
ctgacgctgactacgtcgaag

SEQ ID NO: 7730 - DNA, 21 bp, Artificial Sequence
  Synthetic
gttgggttgtttcctcctaag

SEQ ID NO: 7731 - DNA, 21 bp, Artificial Sequence
  Synthetic
gaggagtttttgcttgggcgt

SEQ ID NO: 7732 - DNA, 21 bp, Artificial Sequence
  Synthetic
attggggctaatccgtttacg

SEQ ID NO: 7733 - DNA, 21 bp, Artificial Sequence
  Synthetic
gatgcgtggactcctcctcgt

SEQ ID NO: 7734 - DNA, 21 bp, Artificial Sequence
  Synthetic
ggtattcagcgtctgttttcg

SEQ ID NO: 7735 - DNA, 21 bp, Artificial Sequence
  Synthetic
gcgcaggcgacgccttttcgt

SEQ ID NO: 7736 - DNA, 21 bp, Artificial Sequence
  Synthetic
gtgcgtgctttttgtgagcct

SEQ ID NO: 7737 - DNA, 21 bp, Artificial Sequence
  Synthetic
tcgattgtggggtgggctgcg

SEQ ID NO: 7738 - DNA, 21 bp, Artificial Sequence
  Synthetic
ccttttgatcggagtacttgg

SEQ ID NO: 7739 - DNA, 21 bp, Artificial Sequence
  Synthetic
actcttagtagtctttttaag

SEQ ID NO: 7740 - DNA, 21 bp, Artificial Sequence
  Synthetic
cagaaggagttttgtgcgctg

SEQ ID NO: 7741 - DNA, 21 bp, Artificial Sequence
  Synthetic
agtattcatgggtgggcgcct

SEQ ID NO: 7742 - DNA, 21 bp, Artificial Sequence
  Synthetic
gagtatacgcgtccttttatg

SEQ ID NO: 7743 - DNA, 21 bp, Artificial Sequence
  Synthetic
gggccggagggtttttatcct

SEQ ID NO: 7744 - DNA, 21 bp, Artificial Sequence
  Synthetic
agtggtattgggtggactgcg

SEQ ID NO: 7745 - DNA, 21 bp, Artificial Sequence
  Synthetic
aatgcggttgggtggcatgcg

SEQ ID NO: 7746 - DNA, 21 bp, Artificial Sequence
  Synthetic
ttgatgccgaagagttgggtg

SEQ ID NO: 7747 - DNA, 21 bp, Artificial Sequence
  Synthetic
tggacgttggattcgccgcgt

SEQ ID NO: 7748 - DNA, 21 bp, Artificial Sequence
  Synthetic
ttgccttcgtttggtagtttt

SEQ ID NO: 7749 - DNA, 21 bp, Artificial Sequence
  Synthetic
tctccttggggtgttaagttt

SEQ ID NO: 7750 - DNA, 21 bp, Artificial Sequence
  Synthetic
agtcgggtttttcaggaggtg

SEQ ID NO: 7751 - DNA, 21 bp, Artificial Sequence
  Synthetic
attcctcagtttgtgtttggg

SEQ ID NO: 7752 - DNA, 21 bp, Artificial Sequence
  Synthetic
atgggtcagttttgtcaggtt

SEQ ID NO: 7753 - DNA, 21 bp, Artificial Sequence
  Synthetic
actatgtctggttgggttgct

SEQ ID NO: 7754 - DNA, 21 bp, Artificial Sequence
  Synthetic
gggcgggagtatttgattccg

SEQ ID NO: 7755 - DNA, 21 bp, Artificial Sequence
  Synthetic
tttacgactagtagttctcgt

SEQ ID NO: 7756 - DNA, 21 bp, Artificial Sequence
  Synthetic
tctactggttggccgggtgcg

SEQ ID NO: 7757 - DNA, 21 bp, Artificial Sequence
  Synthetic
gctctggatcgtccgtgggtg

SEQ ID NO: 7758 - DNA, 21 bp, Artificial Sequence
  Synthetic
gttgataagttttgtctggtg

SEQ ID NO: 7759 - DNA, 21 bp, Artificial Sequence
  Synthetic
gctgtgtttaaggagtgggtt

SEQ ID NO: 7760 - DNA, 21 bp, Artificial Sequence
  Synthetic
tatgcgggtcggatttttatt

SEQ ID NO: 7761 - DNA, 21 bp, Artificial Sequence
  Synthetic
tgtatttcggggctgggttgt

SEQ ID NO: 7762 - DNA, 21 bp, Artificial Sequence
  Synthetic
agtcctaggaatccgtttatt

SEQ ID NO: 7763 - DNA, 21 bp, Artificial Sequence
  Synthetic
acgcttgataagccttttact

SEQ ID NO: 7764 - DNA, 21 bp, Artificial Sequence
  Synthetic
gatgttgtgcattgggtggcg

SEQ ID NO: 7765 - DNA, 21 bp, Artificial Sequence
  Synthetic
gggaataatttttgtaatgtt

SEQ ID NO: 7766 - DNA, 21 bp, Artificial Sequence
  Synthetic
ctgttgggtttttgtcattct

SEQ ID NO: 7767 - DNA, 21 bp, Artificial Sequence
  Synthetic
gggatgtttatgccgcctatg

SEQ ID NO: 7768 - DNA, 21 bp, Artificial Sequence
  Synthetic
ccgacgtcttcttattcttgg

SEQ ID NO: 7769 - DNA, 21 bp, Artificial Sequence
  Synthetic
gcgccggataggccttggctt

SEQ ID NO: 7770 - DNA, 21 bp, Artificial Sequence
  Synthetic
gtgggggtgcagttggggcat

SEQ ID NO: 7771 - DNA, 21 bp, Artificial Sequence
  Synthetic
gctgatacgttttgtgtgaag

SEQ ID NO: 7772 - DNA, 21 bp, Artificial Sequence
  Synthetic
ttttggaatggggggagtggg

SEQ ID NO: 7773 - DNA, 21 bp, Artificial Sequence
  Synthetic
cagatgcagtttgatcggatt

SEQ ID NO: 7774 - DNA, 21 bp, Artificial Sequence
  Synthetic
ggtaaggaggggaatacgtgg

SEQ ID NO: 7775 - DNA, 21 bp, Artificial Sequence
  Synthetic
tggactaaggtgcctgatatt

SEQ ID NO: 7776 - DNA, 21 bp, Artificial Sequence
  Synthetic
acgaagacgagtccgtttttg

SEQ ID NO: 7777 - DNA, 21 bp, Artificial Sequence
  Synthetic
cgggaggagtggcattattct

SEQ ID NO: 7778 - DNA, 21 bp, Artificial Sequence
  Synthetic
tggactctgagtcagccgagg

SEQ ID NO: 7779 - DNA, 21 bp, Artificial Sequence
  Synthetic
cctgctaagtttgcgattatt

SEQ ID NO: 7780 - DNA, 21 bp, Artificial Sequence
  Synthetic
tttacgcttgaggtgccgcgt

SEQ ID NO: 7781 - DNA, 21 bp, Artificial Sequence
  Synthetic
ggtgtgtggcttccgcctaat

SEQ ID NO: 7782 - DNA, 21 bp, Artificial Sequence
  Synthetic
gattataattggccggggtct

SEQ ID NO: 7783 - DNA, 21 bp, Artificial Sequence
  Synthetic
actttggagtttccttttcgt

SEQ ID NO: 7784 - DNA, 21 bp, Artificial Sequence
  Synthetic
tcgagttttgttcctcctagg

SEQ ID NO: 7785 - DNA, 21 bp, Artificial Sequence
  Synthetic
cttgctaagtggccggagttt

SEQ ID NO: 7786 - DNA, 21 bp, Artificial Sequence
  Synthetic
tatgcggctatgccttttccg

SEQ ID NO: 7787 - DNA, 21 bp, Artificial Sequence
  Synthetic
tattctgagaattatttttat

SEQ ID NO: 7788 - DNA, 21 bp, Artificial Sequence
  Synthetic
caggagcggtttagtgttatg

SEQ ID NO: 7789 - DNA, 21 bp, Artificial Sequence
  Synthetic
gttggtccgatgccttgggtt

SEQ ID NO: 7790 - DNA, 21 bp, Artificial Sequence
  Synthetic
gaggagggttattggactccg

SEQ ID NO: 7791 - DNA, 21 bp, Artificial Sequence
  Synthetic
atgccgtttcctatgttgggg

SEQ ID NO: 7792 - DNA, 21 bp, Artificial Sequence
  Synthetic
cctcctattgcgagtcagttt

SEQ ID NO: 7793 - DNA, 21 bp, Artificial Sequence
  Synthetic
cagaggtgtggtattgtttgt

SEQ ID NO: 7794 - DNA, 21 bp, Artificial Sequence
  Synthetic
tctgatgggtttggtgctggt

SEQ ID NO: 7795 - DNA, 21 bp, Artificial Sequence
  Synthetic
tatggtcctttgccttttgct

SEQ ID NO: 7796 - DNA, 21 bp, Artificial Sequence
  Synthetic
aggtttgatcagccttggatt

SEQ ID NO: 7797 - DNA, 21 bp, Artificial Sequence
  Synthetic
caggggtcgaataagacgagt

SEQ ID NO: 7798 - DNA, 21 bp, Artificial Sequence
  Synthetic
acgggttttaatccgccgcgt

SEQ ID NO: 7799 - DNA, 21 bp, Artificial Sequence
  Synthetic
catgttaatggttggattgcg

SEQ ID NO: 7800 - DNA, 21 bp, Artificial Sequence
  Synthetic
ggtgtgtcgcctactgttaag

SEQ ID NO: 7801 - DNA, 21 bp, Artificial Sequence
  Synthetic
aatgctactccgtgggctccg

SEQ ID NO: 7802 - DNA, 21 bp, Artificial Sequence
  Synthetic
aatgctggtccgtggattgcg

SEQ ID NO: 7803 - DNA, 21 bp, Artificial Sequence
  Synthetic
atgccgcatccgtcttggcag

SEQ ID NO: 7804 - DNA, 21 bp, Artificial Sequence
  Synthetic
gattggcgtggggagaagttt

SEQ ID NO: 7805 - DNA, 21 bp, Artificial Sequence
  Synthetic
gagattcttaggccttttatg

SEQ ID NO: 7806 - DNA, 21 bp, Artificial Sequence
  Synthetic
agtatgcgttttgagactgtt

SEQ ID NO: 7807 - DNA, 21 bp, Artificial Sequence
  Synthetic
ggtacgtcgccgtgggttgct

SEQ ID NO: 7808 - DNA, 21 bp, Artificial Sequence
  Synthetic
agtcgtgagcggccttttgtt

SEQ ID NO: 7809 - DNA, 21 bp, Artificial Sequence
  Synthetic
cgttctgagatggggatgtgg

SEQ ID NO: 7810 - DNA, 21 bp, Artificial Sequence
  Synthetic
ctgggtcatgctctgggtcgt

SEQ ID NO: 7811 - DNA, 21 bp, Artificial Sequence
  Synthetic
agttatgtgagtccgtttatg

SEQ ID NO: 7812 - DNA, 21 bp, Artificial Sequence
  Synthetic
gattggcgtgggcttgcttat

SEQ ID NO: 7813 - DNA, 21 bp, Artificial Sequence
  Synthetic
atgccgggtcggccgtttatg

SEQ ID NO: 7814 - DNA, 21 bp, Artificial Sequence
  Synthetic
gctcttaagtttgagaatgtt

SEQ ID NO: 7815 - DNA, 21 bp, Artificial Sequence
  Synthetic
aatgcgtctgggtggctgccg

SEQ ID NO: 7816 - DNA, 21 bp, Artificial Sequence
  Synthetic
agtattgagaagccgtttgtg

SEQ ID NO: 7817 - DNA, 21 bp, Artificial Sequence
  Synthetic
gggacttcgcgtcctactctg

SEQ ID NO: 7818 - DNA, 21 bp, Artificial Sequence
  Synthetic
actccgcatatgccttttcat

SEQ ID NO: 7819 - DNA, 21 bp, Artificial Sequence
  Synthetic
gatcttaatcgtccttttcag

SEQ ID NO: 7820 - DNA, 21 bp, Artificial Sequence
  Synthetic
gtgtttaagtttggtgatatt

SEQ ID NO: 7821 - DNA, 21 bp, Artificial Sequence
  Synthetic
gttctttctaatgtttttggt

SEQ ID NO: 7822 - DNA, 21 bp, Artificial Sequence
  Synthetic
tctttgcaggggtgggttgcg

SEQ ID NO: 7823 - DNA, 21 bp, Artificial Sequence
  Synthetic
ggtcattttacgcctccgtcg

SEQ ID NO: 7824 - DNA, 21 bp, Artificial Sequence
  Synthetic
tctgatgggcgtccttttctt

SEQ ID NO: 7825 - DNA, 21 bp, Artificial Sequence
  Synthetic
aatgcttggggtacgagtcat

SEQ ID NO: 7826 - DNA, 21 bp, Artificial Sequence
  Synthetic
tggacggcgcatgatccgaag

SEQ ID NO: 7827 - DNA, 21 bp, Artificial Sequence
  Synthetic
cctgtgcggacgccgagtttg

SEQ ID NO: 7828 - DNA, 21 bp, Artificial Sequence
  Synthetic
tatggtagttcgccttttaag

SEQ ID NO: 7829 - DNA, 21 bp, Artificial Sequence
  Synthetic
gttgatgggtggggggcgttt

SEQ ID NO: 7830 - DNA, 21 bp, Artificial Sequence
  Synthetic
aatgggcagttgccttttcgg

SEQ ID NO: 7831 - DNA, 21 bp, Artificial Sequence
  Synthetic
tcggctcagtttcatttggtt

SEQ ID NO: 7832 - DNA, 21 bp, Artificial Sequence
  Synthetic
gctgcggataggccgtttctt

SEQ ID NO: 7833 - DNA, 21 bp, Artificial Sequence
  Synthetic
gtggaggggctgtggcatgtt

SEQ ID NO: 7834 - DNA, 21 bp, Artificial Sequence
  Synthetic
gataatcggggttttgttgct

SEQ ID NO: 7835 - DNA, 21 bp, Artificial Sequence
  Synthetic
acggagcgtcatccgtttctt

SEQ ID NO: 7836 - DNA, 21 bp, Artificial Sequence
  Synthetic
gggtcgtttgcgcctccttct

SEQ ID NO: 7837 - DNA, 21 bp, Artificial Sequence
  Synthetic
ctggcgatgaattcttcttgg

SEQ ID NO: 7838 - DNA, 21 bp, Artificial Sequence
  Synthetic
gggtatacgaatccgtttcag

SEQ ID NO: 7839 - DNA, 21 bp, Artificial Sequence
  Synthetic
caggtgcgttttgattcgatt

SEQ ID NO: 7840 - DNA, 21 bp, Artificial Sequence
  Synthetic
gatctgaataagccttggttg

SEQ ID NO: 7841 - DNA, 21 bp, Artificial Sequence
  Synthetic
gagcggtttactcctcctcgg

SEQ ID NO: 7842 - DNA, 21 bp, Artificial Sequence
  Synthetic
acgccgcttactccttttaag

SEQ ID NO: 7843 - DNA, 21 bp, Artificial Sequence
  Synthetic
gatctgccgcggaattgggtt

SEQ ID NO: 7844 - DNA, 21 bp, Artificial Sequence
  Synthetic
attggggtgcgtcttgggatg

SEQ ID NO: 7845 - DNA, 21 bp, Artificial Sequence
  Synthetic
tctcagtttgttcctcctcat

SEQ ID NO: 7846 - DNA, 21 bp, Artificial Sequence
  Synthetic
tcgccttctactatttcttgg

SEQ ID NO: 7847 - DNA, 21 bp, Artificial Sequence
  Synthetic
actcctcataatctgtcgtgg

SEQ ID NO: 7848 - DNA, 21 bp, Artificial Sequence
  Synthetic
cagattaggtttagtggtatt

SEQ ID NO: 7849 - DNA, 21 bp, Artificial Sequence
  Synthetic
catccggttggttggattgct

SEQ ID NO: 7850 - DNA, 21 bp, Artificial Sequence
  Synthetic
tatgataatttgccgtttcgg

SEQ ID NO: 7851 - DNA, 21 bp, Artificial Sequence
  Synthetic
ttgggggcgatgccgtttcgt

SEQ ID NO: 7852 - DNA, 21 bp, Artificial Sequence
  Synthetic
actaagtcgatgcctttttat

SEQ ID NO: 7853 - DNA, 21 bp, Artificial Sequence
  Synthetic
gatgggtatcgtccttttatt

SEQ ID NO: 7854 - DNA, 21 bp, Artificial Sequence
  Synthetic
agtaatactgggtgggcgccg

SEQ ID NO: 7855 - DNA, 21 bp, Artificial Sequence
  Synthetic
ccgattagtacgttgtcgtgg

SEQ ID NO: 7856 - DNA, 21 bp, Artificial Sequence
  Synthetic
gtggggcatcgtctgggttgt

SEQ ID NO: 7857 - DNA, 21 bp, Artificial Sequence
  Synthetic
tcgtcgcgttttgagcatatt

SEQ ID NO: 7858 - DNA, 21 bp, Artificial Sequence
  Synthetic
gcgcttatgcgtccgtttccg

SEQ ID NO: 7859 - DNA, 21 bp, Artificial Sequence
  Synthetic
ttgatgtgggatggtggtggg

SEQ ID NO: 7860 - DNA, 21 bp, Artificial Sequence
  Synthetic
ctgcttcagcggccttttctt

SEQ ID NO: 7861 - DNA, 21 bp, Artificial Sequence
  Synthetic
actcttacgatgatgtttcag

SEQ ID NO: 7862 - DNA, 21 bp, Artificial Sequence
  Synthetic
agtgtgtggcgtgttgagggg

SEQ ID NO: 7863 - DNA, 21 bp, Artificial Sequence
  Synthetic
gtggtgcggtttggggagttt

SEQ ID NO: 7864 - DNA, 21 bp, Artificial Sequence
  Synthetic
cttccggagcggccgtttgtg

SEQ ID NO: 7865 - DNA, 21 bp, Artificial Sequence
  Synthetic
gggcgggcggggtggattgct

SEQ ID NO: 7866 - DNA, 21 bp, Artificial Sequence
  Synthetic
acgaagaatgctccgtttttg

SEQ ID NO: 7867 - DNA, 21 bp, Artificial Sequence
  Synthetic
tggtcggttttttctgaggtt

SEQ ID NO: 7868 - DNA, 21 bp, Artificial Sequence
  Synthetic
ggtgagcgtgggtgggttgct

SEQ ID NO: 7869 - DNA, 21 bp, Artificial Sequence
  Synthetic
gttggggttaatccttttcag

SEQ ID NO: 7870 - DNA, 21 bp, Artificial Sequence
  Synthetic
tatggggtgatgccgtttgtg

SEQ ID NO: 7871 - DNA, 21 bp, Artificial Sequence
  Synthetic
cagagtgctttttgtgttccg

SEQ ID NO: 7872 - DNA, 21 bp, Artificial Sequence
  Synthetic
acgactggtcgtgctcttact

SEQ ID NO: 7873 - DNA, 21 bp, Artificial Sequence
  Synthetic
acgtataggtttgagtcggtg

SEQ ID NO: 7874 - DNA, 21 bp, Artificial Sequence
  Synthetic
gttatgactcagacgtggcat

SEQ ID NO: 7875 - DNA, 21 bp, Artificial Sequence
  Synthetic
aattgggttaatcctgagggg

SEQ ID NO: 7876 - DNA, 21 bp, Artificial Sequence
  Synthetic
agtgagtttcttctgggtagg

SEQ ID NO: 7877 - DNA, 21 bp, Artificial Sequence
  Synthetic
ggtgtgtgtggtatggtgtgt

SEQ ID NO: 7878 - DNA, 21 bp, Artificial Sequence
  Synthetic
gtggcgcatttttgtacgtcg

SEQ ID NO: 7879 - DNA, 21 bp, Artificial Sequence
  Synthetic
agtgctctgcggccgtttact

SEQ ID NO: 7880 - DNA, 21 bp, Artificial Sequence
  Synthetic
gattattttagtccgactcgg

SEQ ID NO: 7881 - DNA, 21 bp, Artificial Sequence
  Synthetic
agtgcgtggggtccgatgagt

SEQ ID NO: 7882 - DNA, 21 bp, Artificial Sequence
  Synthetic
cgggagtttatgatgggggcg

SEQ ID NO: 7883 - DNA, 21 bp, Artificial Sequence
  Synthetic
ttgcttcctcagaattggctt

SEQ ID NO: 7884 - DNA, 21 bp, Artificial Sequence
  Synthetic
ggtgttagtttttataatgag

SEQ ID NO: 7885 - DNA, 21 bp, Artificial Sequence
  Synthetic
tggttggcgaagggtacggtt

SEQ ID NO: 7886 - DNA, 21 bp, Artificial Sequence
  Synthetic
tctgttgcggagtggttgcgg

SEQ ID NO: 7887 - DNA, 21 bp, Artificial Sequence
  Synthetic
tatgtggatcgtctgtttatt

SEQ ID NO: 7888 - DNA, 21 bp, Artificial Sequence
  Synthetic
gcgggtgggccgtggattagt

SEQ ID NO: 7889 - DNA, 21 bp, Artificial Sequence
  Synthetic
ggtgttccgcctatgagtggg

SEQ ID NO: 7890 - DNA, 21 bp, Artificial Sequence
  Synthetic
tatgctcttaagccgtttgtt

SEQ ID NO: 7891 - DNA, 21 bp, Artificial Sequence
  Synthetic
ttttctcttcatactagtaag

SEQ ID NO: 7892 - DNA, 21 bp, Artificial Sequence
  Synthetic
actggggtggctcttgggtat

SEQ ID NO: 7893 - DNA, 21 bp, Artificial Sequence
  Synthetic
agtgtgacgacgccttttctt

SEQ ID NO: 7894 - DNA, 21 bp, Artificial Sequence
  Synthetic
cagacgcgtatgttgtatccg

SEQ ID NO: 7895 - DNA, 21 bp, Artificial Sequence
  Synthetic
actgtgtggagggaggggggt

SEQ ID NO: 7896 - DNA, 21 bp, Artificial Sequence
  Synthetic
tcgattagggtgccgtttatt

SEQ ID NO: 7897 - DNA, 21 bp, Artificial Sequence
  Synthetic
ttgggtgctgcgcttggtcgg

SEQ ID NO: 7898 - DNA, 21 bp, Artificial Sequence
  Synthetic
ttgggtcgtgcgctgggtttg

SEQ ID NO: 7899 - DNA, 21 bp, Artificial Sequence
  Synthetic
gtgcttctgaatgtttttggg

SEQ ID NO: 7900 - DNA, 21 bp, Artificial Sequence
  Synthetic
agtacgatttttaagctgcct

SEQ ID NO: 7901 - DNA, 21 bp, Artificial Sequence
  Synthetic
aatcgtgatttttgtgcgcct

SEQ ID NO: 7902 - DNA, 21 bp, Artificial Sequence
  Synthetic
ggtaagatgggttgggcggct

SEQ ID NO: 7903 - DNA, 21 bp, Artificial Sequence
  Synthetic
gctacttttattcctcctacg

SEQ ID NO: 7904 - DNA, 21 bp, Artificial Sequence
  Synthetic
actgcttggcatagtgatggg

SEQ ID NO: 7905 - DNA, 21 bp, Artificial Sequence
  Synthetic
actactgagttttgtaggttt

SEQ ID NO: 7906 - DNA, 21 bp, Artificial Sequence
  Synthetic
gggatttttattactccgatg

SEQ ID NO: 7907 - DNA, 21 bp, Artificial Sequence
  Synthetic
ggttataatggttgggctggg

SEQ ID NO: 7908 - DNA, 21 bp, Artificial Sequence
  Synthetic
gatacgtgggctccgcctaag

SEQ ID NO: 7909 - DNA, 21 bp, Artificial Sequence
  Synthetic
tcgtgggcgcggattggtgag

SEQ ID NO: 7910 - DNA, 21 bp, Artificial Sequence
  Synthetic
gcggctatggggtgggctgct

SEQ ID NO: 7911 - DNA, 21 bp, Artificial Sequence
  Synthetic
gatgatacgcatttttttcgt

SEQ ID NO: 7912 - DNA, 21 bp, Artificial Sequence
  Synthetic
ggtgtgacgcggccgtttcag

SEQ ID NO: 7913 - DNA, 21 bp, Artificial Sequence
  Synthetic
tttgggctgggtcttgctaag

SEQ ID NO: 7914 - DNA, 21 bp, Artificial Sequence
  Synthetic
attgagggttggtataggtct

SEQ ID NO: 7915 - DNA, 21 bp, Artificial Sequence
  Synthetic
gtgacgttgcagacttcgagg

SEQ ID NO: 7916 - DNA, 21 bp, Artificial Sequence
  Synthetic
catagggttcatacgagtcct

SEQ ID NO: 7917 - DNA, 21 bp, Artificial Sequence
  Synthetic
aatccggagtgggggcatttt

SEQ ID NO: 7918 - DNA, 21 bp, Artificial Sequence
  Synthetic
gagccgatgcatagttcttgg

SEQ ID NO: 7919 - DNA, 21 bp, Artificial Sequence
  Synthetic
tctaaggcttttcatctggtg

SEQ ID NO: 7920 - DNA, 21 bp, Artificial Sequence
  Synthetic
agtaatacgtgggagaagagt

SEQ ID NO: 7921 - DNA, 21 bp, Artificial Sequence
  Synthetic
cagactgattttactaggcag

SEQ ID NO: 7922 - DNA, 21 bp, Artificial Sequence
  Synthetic
aggggtctgcctgagatttgg

SEQ ID NO: 7923 - DNA, 21 bp, Artificial Sequence
  Synthetic
tatccgattgcgggttgggtg

SEQ ID NO: 7924 - DNA, 21 bp, Artificial Sequence
  Synthetic
tggcggtctttggggtcggtg

SEQ ID NO: 7925 - DNA, 21 bp, Artificial Sequence
  Synthetic
tatgcggagcgtatttttatt

SEQ ID NO: 7926 - DNA, 21 bp, Artificial Sequence
  Synthetic
attccgttgaagggttgggtg

SEQ ID NO: 7927 - DNA, 21 bp, Artificial Sequence
  Synthetic
acggatcagctgttttcgagg

SEQ ID NO: 7928 - DNA, 21 bp, Artificial Sequence
  Synthetic
ccgaggatgaatagttcgttt

SEQ ID NO: 7929 - DNA, 21 bp, Artificial Sequence
  Synthetic
gtgcagttttctcagcctaag

SEQ ID NO: 7930 - DNA, 21 bp, Artificial Sequence
  Synthetic
acgccggatagtccttggctt

SEQ ID NO: 7931 - DNA, 21 bp, Artificial Sequence
  Synthetic
ggtctttgggctggtgggggt

SEQ ID NO: 7932 - DNA, 21 bp, Artificial Sequence
  Synthetic
ctgggtgttcgtctggggatt

SEQ ID NO: 7933 - DNA, 21 bp, Artificial Sequence
  Synthetic
catacggaggcgttggtggcg

SEQ ID NO: 7934 - DNA, 21 bp, Artificial Sequence
  Synthetic
tctgcgagttctccgtttcgg

SEQ ID NO: 7935 - DNA, 21 bp, Artificial Sequence
  Synthetic
acgggtcgggcgcttggtact

SEQ ID NO: 7936 - DNA, 21 bp, Artificial Sequence
  Synthetic
gggacgtgggttccgcctaat

SEQ ID NO: 7937 - DNA, 21 bp, Artificial Sequence
  Synthetic
aagccgcctttttatcttgag

SEQ ID NO: 7938 - DNA, 21 bp, Artificial Sequence
  Synthetic
tctgatgcgcagtattttagg

SEQ ID NO: 7939 - DNA, 21 bp, Artificial Sequence
  Synthetic
cttaaggtgagtggttttccg

SEQ ID NO: 7940 - DNA, 21 bp, Artificial Sequence
  Synthetic
tatgcggagaagtattttttg

SEQ ID NO: 7941 - DNA, 21 bp, Artificial Sequence
  Synthetic
gatggtcagctttttttgcgt

SEQ ID NO: 7942 - DNA, 21 bp, Artificial Sequence
  Synthetic
tctgtgagtcatccttttaag

SEQ ID NO: 7943 - DNA, 21 bp, Artificial Sequence
  Synthetic
tgggatcttttgggggctagg

SEQ ID NO: 7944 - DNA, 21 bp, Artificial Sequence
  Synthetic
tggacgcttaaggatccgctg

SEQ ID NO: 7945 - DNA, 21 bp, Artificial Sequence
  Synthetic
actccggcgaggccgtttacg

SEQ ID NO: 7946 - DNA, 21 bp, Artificial Sequence
  Synthetic
gcgccggcggattggctgcgt

SEQ ID NO: 7947 - DNA, 21 bp, Artificial Sequence
  Synthetic
gagaatgtggcgtttcggaat

SEQ ID NO: 7948 - DNA, 21 bp, Artificial Sequence
  Synthetic
cttatttgtcctaagctgtgt

SEQ ID NO: 7949 - DNA, 21 bp, Artificial Sequence
  Synthetic
tttgatcttagtgggcctatg

SEQ ID NO: 7950 - DNA, 21 bp, Artificial Sequence
  Synthetic
actccgattcagatttttaag

SEQ ID NO: 7951 - DNA, 21 bp, Artificial Sequence
  Synthetic
gcgaagacgtttgcgtgtgtt

SEQ ID NO: 7952 - DNA, 21 bp, Artificial Sequence
  Synthetic
tcgaaggctgggtgggcgccg

SEQ ID NO: 7953 - DNA, 21 bp, Artificial Sequence
  Synthetic
aatgatacgcagttttttagg

SEQ ID NO: 7954 - DNA, 21 bp, Artificial Sequence
  Synthetic
tatcagtttacgacgcctaag

SEQ ID NO: 7955 - DNA, 21 bp, Artificial Sequence
  Synthetic
tctaatactagtccttttagg

SEQ ID NO: 7956 - DNA, 21 bp, Artificial Sequence
  Synthetic
ggtaattggtctgggggtggt

SEQ ID NO: 7957 - DNA, 21 bp, Artificial Sequence
  Synthetic
tctaatctggcgccgtttcgt

SEQ ID NO: 7958 - DNA, 21 bp, Artificial Sequence
  Synthetic
tcgggtgatcgtccgtggctt

SEQ ID NO: 7959 - DNA, 21 bp, Artificial Sequence
  Synthetic
attgttcctttttggacggcg

SEQ ID NO: 7960 - DNA, 21 bp, Artificial Sequence
  Synthetic
tatgctgggcagtattttcat

SEQ ID NO: 7961 - DNA, 21 bp, Artificial Sequence
  Synthetic
cggatttttccttatgtggat

SEQ ID NO: 7962 - DNA, 21 bp, Artificial Sequence
  Synthetic
actgctgagcttccgtttagg

SEQ ID NO: 7963 - DNA, 21 bp, Artificial Sequence
  Synthetic
tttgcggagatgccttttagg

SEQ ID NO: 7964 - DNA, 21 bp, Artificial Sequence
  Synthetic
actgataagtgggggtctttt

SEQ ID NO: 7965 - DNA, 21 bp, Artificial Sequence
  Synthetic
gttgtgaggtttgaggcggtt

SEQ ID NO: 7966 - DNA, 21 bp, Artificial Sequence
  Synthetic
gggcgtgatgggtgggtgcct

SEQ ID NO: 7967 - DNA, 21 bp, Artificial Sequence
  Synthetic
tatgatggtcgtatgtttttg

SEQ ID NO: 7968 - DNA, 21 bp, Artificial Sequence
  Synthetic
gggatggcgttggcggttacg

SEQ ID NO: 7969 - DNA, 21 bp, Artificial Sequence
  Synthetic
tttagtgtgtctgcgagtcgg

SEQ ID NO: 7970 - DNA, 21 bp, Artificial Sequence
  Synthetic
tcggctcctcgtccttttgcg

SEQ ID NO: 7971 - DNA, 21 bp, Artificial Sequence
  Synthetic
agtgtgtcgtttgcgcatgtg

SEQ ID NO: 7972 - DNA, 21 bp, Artificial Sequence
  Synthetic
atgaaggctgattttatgcct

SEQ ID NO: 7973 - DNA, 21 bp, Artificial Sequence
  Synthetic
agtgagcttggttggattccg

SEQ ID NO: 7974 - DNA, 21 bp, Artificial Sequence
  Synthetic
cagattactttttgtccgagt

SEQ ID NO: 7975 - DNA, 21 bp, Artificial Sequence
  Synthetic
tatgagagttttctgtttcat

SEQ ID NO: 7976 - DNA, 21 bp, Artificial Sequence
  Synthetic
gtgttgggttttattggtgtg

SEQ ID NO: 7977 - DNA, 21 bp, Artificial Sequence
  Synthetic
ttggctaattggccttttccg

SEQ ID NO: 7978 - DNA, 21 bp, Artificial Sequence
  Synthetic
agtgggaatgggtgggttgcg

SEQ ID NO: 7979 - DNA, 21 bp, Artificial Sequence
  Synthetic
gatctttttagtccgagtcgg

SEQ ID NO: 7980 - DNA, 21 bp, Artificial Sequence
  Synthetic
cttagtccgttttttttggct

SEQ ID NO: 7981 - DNA, 21 bp, Artificial Sequence
  Synthetic
tatggtcagaatctttttgtt

SEQ ID NO: 7982 - DNA, 21 bp, Artificial Sequence
  Synthetic
gttactagtctggatcatcgt

SEQ ID NO: 7983 - DNA, 21 bp, Artificial Sequence
  Synthetic
tatgatagtcatctttttcag

SEQ ID NO: 7984 - DNA, 21 bp, Artificial Sequence
  Synthetic
tggggtgcggcggctgctttg

SEQ ID NO: 7985 - DNA, 21 bp, Artificial Sequence
  Synthetic
aagacggcgtttgcgcatgtg

SEQ ID NO: 7986 - DNA, 21 bp, Artificial Sequence
  Synthetic
ttggtgaatttttgtagtgct

SEQ ID NO: 7987 - DNA, 21 bp, Artificial Sequence
  Synthetic
actcattggttgacgcatggg

SEQ ID NO: 7988 - DNA, 21 bp, Artificial Sequence
  Synthetic
catcgtccggaggggcgtagt

SEQ ID NO: 7989 - DNA, 21 bp, Artificial Sequence
  Synthetic
agggcgcatgagaagctgcag

SEQ ID NO: 7990 - DNA, 21 bp, Artificial Sequence
  Synthetic
aagcctgatatggggatttgg

SEQ ID NO: 7991 - DNA, 21 bp, Artificial Sequence
  Synthetic
agtctgcatgggtgggctgct

SEQ ID NO: 7992 - DNA, 21 bp, Artificial Sequence
  Synthetic
tgtattgcgcgtattggttgt

SEQ ID NO: 7993 - DNA, 21 bp, Artificial Sequence
  Synthetic
agtctttttggttttagtcct

SEQ ID NO: 7994 - DNA, 21 bp, Artificial Sequence
  Synthetic
tgtgtttggagtaatacgtgt

SEQ ID NO: 7995 - DNA, 21 bp, Artificial Sequence
  Synthetic
tcgcgtgctcagccgtttttg

SEQ ID NO: 7996 - DNA, 21 bp, Artificial Sequence
  Synthetic
actgatatgcctcatgtgtct

SEQ ID NO: 7997 - DNA, 21 bp, Artificial Sequence
  Synthetic
atttatgttatggggtctgtt

SEQ ID NO: 7998 - DNA, 21 bp, Artificial Sequence
  Synthetic
gttggggcgaatccgtttgtg

SEQ ID NO: 7999 - DNA, 21 bp, Artificial Sequence
  Synthetic
ccggagaagacgtttcgtact

SEQ ID NO: 8000 - DNA, 21 bp, Artificial Sequence
  Synthetic
aatacgattagtacgtcgaag

SEQ ID NO: 8001 - DNA, 21 bp, Artificial Sequence
  Synthetic
caggcggggttttgtgctttg

SEQ ID NO: 8002 - DNA, 21 bp, Artificial Sequence
  Synthetic
agtcagcagttttcgcagatt

SEQ ID NO: 8003 - DNA, 21 bp, Artificial Sequence
  Synthetic
tctggttatcctgtgcggggg

SEQ ID NO: 8004 - DNA, 21 bp, Artificial Sequence
  Synthetic
cttgctcagctttgtacggtg

SEQ ID NO: 8005 - DNA, 21 bp, Artificial Sequence
  Synthetic
agtctgaatcatatgcggagt

SEQ ID NO: 8006 - DNA, 21 bp, Artificial Sequence
  Synthetic
tgggatgattggggtccgcgt

SEQ ID NO: 8007 - DNA, 21 bp, Artificial Sequence
  Synthetic
actctgctgcgggtttttccg

SEQ ID NO: 8008 - DNA, 21 bp, Artificial Sequence
  Synthetic
tgggagtctaggccgtttatt

SEQ ID NO: 8009 - DNA, 21 bp, Artificial Sequence
  Synthetic
acgccttggcgtgagcttggg

SEQ ID NO: 8010 - DNA, 21 bp, Artificial Sequence
  Synthetic
tttggtgttcgtcttgctgtg

SEQ ID NO: 8011 - DNA, 21 bp, Artificial Sequence
  Synthetic
cagagtaagtttgagagtatt

SEQ ID NO: 8012 - DNA, 21 bp, Artificial Sequence
  Synthetic
ctgcctgatcggcagtggctg

SEQ ID NO: 8013 - DNA, 21 bp, Artificial Sequence
  Synthetic
agtgcgtgggggtcgcatcat

SEQ ID NO: 8014 - DNA, 21 bp, Artificial Sequence
  Synthetic
acgactgcgatgccttttcgg

SEQ ID NO: 8015 - DNA, 21 bp, Artificial Sequence
  Synthetic
gttcctagttcgctttcgtgg

SEQ ID NO: 8016 - DNA, 21 bp, Artificial Sequence
  Synthetic
gtggggactttttgtattagt

SEQ ID NO: 8017 - DNA, 21 bp, Artificial Sequence
  Synthetic
actgttgggcggccttttacg

SEQ ID NO: 8018 - DNA, 21 bp, Artificial Sequence
  Synthetic
agtgttttggggtggactgcg

SEQ ID NO: 8019 - DNA, 21 bp, Artificial Sequence
  Synthetic
tatgctgggcagtattttaag

SEQ ID NO: 8020 - DNA, 21 bp, Artificial Sequence
  Synthetic
ccgatgcatagtacgtcgtgg

SEQ ID NO: 8021 - DNA, 21 bp, Artificial Sequence
  Synthetic
gttggtgtggctcttgggcgt

SEQ ID NO: 8022 - DNA, 21 bp, Artificial Sequence
  Synthetic
ggggctgagatgtatcttcgt

SEQ ID NO: 8023 - DNA, 21 bp, Artificial Sequence
  Synthetic
gtgaagccgatgggtgtttgg

SEQ ID NO: 8024 - DNA, 21 bp, Artificial Sequence
  Synthetic
cttagtatgcggacttcggtg

SEQ ID NO: 8025 - DNA, 21 bp, Artificial Sequence
  Synthetic
gttgggccgcttaaggggtgg

SEQ ID NO: 8026 - DNA, 21 bp, Artificial Sequence
  Synthetic
ggtacgtgggttccgccgatg

SEQ ID NO: 8027 - DNA, 21 bp, Artificial Sequence
  Synthetic
caggttacgtttgagaaggtg

SEQ ID NO: 8028 - DNA, 21 bp, Artificial Sequence
  Synthetic
tatcagcggatgtggtttcag

SEQ ID NO: 8029 - DNA, 21 bp, Artificial Sequence
  Synthetic
cctcgggctgattggcttgcg

SEQ ID NO: 8030 - DNA, 21 bp, Artificial Sequence
  Synthetic
ggtccgaatcttccttttagg

SEQ ID NO: 8031 - DNA, 21 bp, Artificial Sequence
  Synthetic
tctaggatttttggtgagttt

SEQ ID NO: 8032 - DNA, 21 bp, Artificial Sequence
  Synthetic
gatcggatttttgggttgtct

SEQ ID NO: 8033 - DNA, 21 bp, Artificial Sequence
  Synthetic
gggatttggtctgggggtggg

SEQ ID NO: 8034 - DNA, 21 bp, Artificial Sequence
  Synthetic
gggggtgatggtcggggtaat

SEQ ID NO: 8035 - DNA, 21 bp, Artificial Sequence
  Synthetic
gttccgggttggtatgttgct

SEQ ID NO: 8036 - DNA, 21 bp, Artificial Sequence
  Synthetic
ccgattattggtatgcgtttg

SEQ ID NO: 8037 - DNA, 21 bp, Artificial Sequence
  Synthetic
cctttgattgggacgttgctg

SEQ ID NO: 8038 - DNA, 21 bp, Artificial Sequence
  Synthetic
agtgtgaataatccgtttaag

SEQ ID NO: 8039 - DNA, 21 bp, Artificial Sequence
  Synthetic
tggggtcagtggccgcatggg

SEQ ID NO: 8040 - DNA, 21 bp, Artificial Sequence
  Synthetic
atttctatgtcgagtaggcat

SEQ ID NO: 8041 - DNA, 21 bp, Artificial Sequence
  Synthetic
tatggggatcagatgtggaag

SEQ ID NO: 8042 - DNA, 21 bp, Artificial Sequence
  Synthetic
ggtaattttgtgcctccgagt

SEQ ID NO: 8043 - DNA, 21 bp, Artificial Sequence
  Synthetic
gcggggctgggttgggtggct

SEQ ID NO: 8044 - DNA, 21 bp, Artificial Sequence
  Synthetic
cagattgatcgtccttttcgg

SEQ ID NO: 8045 - DNA, 21 bp, Artificial Sequence
  Synthetic
aatattagggggtgggttgcg

SEQ ID NO: 8046 - DNA, 21 bp, Artificial Sequence
  Synthetic
gatcctcataatactagttgg

SEQ ID NO: 8047 - DNA, 21 bp, Artificial Sequence
  Synthetic
aaggagtggcatggtggtggg

SEQ ID NO: 8048 - DNA, 21 bp, Artificial Sequence
  Synthetic
gtgtcgttttctccgccgttt

SEQ ID NO: 8049 - DNA, 21 bp, Artificial Sequence
  Synthetic
acgctggtgatgccttttcat

SEQ ID NO: 8050 - DNA, 21 bp, Artificial Sequence
  Synthetic
ttgttgtcgaggccgttttct

SEQ ID NO: 8051 - DNA, 21 bp, Artificial Sequence
  Synthetic
agtttgacgaatcctttttat

SEQ ID NO: 8052 - DNA, 21 bp, Artificial Sequence
  Synthetic
gctatgccttataagaatggg

SEQ ID NO: 8053 - DNA, 21 bp, Artificial Sequence
  Synthetic
gctaaggagggttggacggct

SEQ ID NO: 8054 - DNA, 21 bp, Artificial Sequence
  Synthetic
tatggtgagttttgtatggtg

SEQ ID NO: 8055 - DNA, 21 bp, Artificial Sequence
  Synthetic
attaagggtttttgtgagttg

SEQ ID NO: 8056 - DNA, 21 bp, Artificial Sequence
  Synthetic
cttccgccgcatccttggact

SEQ ID NO: 8057 - DNA, 21 bp, Artificial Sequence
  Synthetic
tttactccttattatgcgatg

SEQ ID NO: 8058 - DNA, 21 bp, Artificial Sequence
  Synthetic
gggtctttgccttgggtggct

SEQ ID NO: 8059 - DNA, 21 bp, Artificial Sequence
  Synthetic
tatagtgcgcatatttttcgt

SEQ ID NO: 8060 - DNA, 21 bp, Artificial Sequence
  Synthetic
tcgctggttgggtgggctgcg

SEQ ID NO: 8061 - DNA, 21 bp, Artificial Sequence
  Synthetic
tctgttgtttttgcttctgtg

SEQ ID NO: 8062 - DNA, 21 bp, Artificial Sequence
  Synthetic
gataagttgggttggagtgct

SEQ ID NO: 8063 - DNA, 21 bp, Artificial Sequence
  Synthetic
agtagttctcggccgtttcag

SEQ ID NO: 8064 - DNA, 21 bp, Artificial Sequence
  Synthetic
ccgcggattgcttcggtgctg

SEQ ID NO: 8065 - DNA, 21 bp, Artificial Sequence
  Synthetic
tgggagttttctccgcctaag

SEQ ID NO: 8066 - DNA, 21 bp, Artificial Sequence
  Synthetic
gttggtcttgcgccgcctagg

SEQ ID NO: 8067 - DNA, 21 bp, Artificial Sequence
  Synthetic
tttgttggtgggggtccttat

SEQ ID NO: 8068 - DNA, 21 bp, Artificial Sequence
  Synthetic
aatttgtttcttgaggggatg

SEQ ID NO: 8069 - DNA, 21 bp, Artificial Sequence
  Synthetic
atggtgaattttgcttcggtt

SEQ ID NO: 8070 - DNA, 21 bp, Artificial Sequence
  Synthetic
ctgactatgaatactagtatt

SEQ ID NO: 8071 - DNA, 21 bp, Artificial Sequence
  Synthetic
actccttggcatgattctggt

SEQ ID NO: 8072 - DNA, 21 bp, Artificial Sequence
  Synthetic
cgtgtgaatcatgcggattat

SEQ ID NO: 8073 - DNA, 21 bp, Artificial Sequence
  Synthetic
tcggttgttaggccgtttccg

SEQ ID NO: 8074 - DNA, 21 bp, Artificial Sequence
  Synthetic
tctcgggagttttgtagtcct

SEQ ID NO: 8075 - DNA, 21 bp, Artificial Sequence
  Synthetic
tatgtgggtagtatttttctt

SEQ ID NO: 8076 - DNA, 21 bp, Artificial Sequence
  Synthetic
gttgggcttccttttgcttat

SEQ ID NO: 8077 - DNA, 21 bp, Artificial Sequence
  Synthetic
tggcatagtacggatcatcgt

SEQ ID NO: 8078 - DNA, 21 bp, Artificial Sequence
  Synthetic
ttgttgagtaggccgtttgcg

SEQ ID NO: 8079 - DNA, 21 bp, Artificial Sequence
  Synthetic
gtgggtgctttgccttggtcg

SEQ ID NO: 8080 - DNA, 21 bp, Artificial Sequence
  Synthetic
ggtcggtttattcctcctacg

SEQ ID NO: 8081 - DNA, 21 bp, Artificial Sequence
  Synthetic
actgttgagagggtttttctg

SEQ ID NO: 8082 - DNA, 21 bp, Artificial Sequence
  Synthetic
tttactcttagtagtagtatt

SEQ ID NO: 8083 - DNA, 21 bp, Artificial Sequence
  Synthetic
agtgggcagttttgtgcgatt

SEQ ID NO: 8084 - DNA, 21 bp, Artificial Sequence
  Synthetic
agtgcttcgttttgtactgcg

SEQ ID NO: 8085 - DNA, 21 bp, Artificial Sequence
  Synthetic
gttggggtggcgttggggctg

SEQ ID NO: 8086 - DNA, 21 bp, Artificial Sequence
  Synthetic
agtgctgcgcgtccgtttatg

SEQ ID NO: 8087 - DNA, 21 bp, Artificial Sequence
  Synthetic
ggtgagctgaggccttttctg

SEQ ID NO: 8088 - DNA, 21 bp, Artificial Sequence
  Synthetic
ggttcttggtctcctcctcat

SEQ ID NO: 8089 - DNA, 21 bp, Artificial Sequence
  Synthetic
gtttcttggctttctgatctg

SEQ ID NO: 8090 - DNA, 21 bp, Artificial Sequence
  Synthetic
acgtctcggttgccttttatt

SEQ ID NO: 8091 - DNA, 21 bp, Artificial Sequence
  Synthetic
tcgttgtatgctctgacgggt

SEQ ID NO: 8092 - DNA, 21 bp, Artificial Sequence
  Synthetic
tttagtctgtcgacgagtgtt

SEQ ID NO: 8093 - DNA, 21 bp, Artificial Sequence
  Synthetic
tatctgactggttcgcattat

SEQ ID NO: 8094 - DNA, 21 bp, Artificial Sequence
  Synthetic
gcgggtattcagctgggtaag

SEQ ID NO: 8095 - DNA, 21 bp, Artificial Sequence
  Synthetic
agtctgcatcttccttttaag

SEQ ID NO: 8096 - DNA, 21 bp, Artificial Sequence
  Synthetic
tatgcggatcgtccttttatt

SEQ ID NO: 8097 - DNA, 21 bp, Artificial Sequence
  Synthetic
gcgaaggagcatccttctagg

SEQ ID NO: 8098 - DNA, 21 bp, Artificial Sequence
  Synthetic
gggaattgggtgcctcctaat

SEQ ID NO: 8099 - DNA, 21 bp, Artificial Sequence
  Synthetic
aggcaggttcttcggggggat

SEQ ID NO: 8100 - DNA, 21 bp, Artificial Sequence
  Synthetic
cgggagcttccttttctgcat

SEQ ID NO: 8101 - DNA, 21 bp, Artificial Sequence
  Synthetic
gttgcgcagtgggctcagttt

SEQ ID NO: 8102 - DNA, 21 bp, Artificial Sequence
  Synthetic
atgacgaagtttttgagtgtt

SEQ ID NO: 8103 - DNA, 21 bp, Artificial Sequence
  Synthetic
cctctgtcgactactagttgg

SEQ ID NO: 8104 - DNA, 21 bp, Artificial Sequence
  Synthetic
cctgttgatcgggtgtcgtgg

SEQ ID NO: 8105 - DNA, 21 bp, Artificial Sequence
  Synthetic
tctttggagaggccttttttt

SEQ ID NO: 8106 - DNA, 21 bp, Artificial Sequence
  Synthetic
ggtattagtttttgtacggag

SEQ ID NO: 8107 - DNA, 21 bp, Artificial Sequence
  Synthetic
aatgatattacgatttttcgg

SEQ ID NO: 8108 - DNA, 21 bp, Artificial Sequence
  Synthetic
gggattgcggtgattacttcg

SEQ ID NO: 8109 - DNA, 21 bp, Artificial Sequence
  Synthetic
agtgtgacgtatggtgtgttt

SEQ ID NO: 8110 - DNA, 21 bp, Artificial Sequence
  Synthetic
aatcataggttgcgtgagggt

SEQ ID NO: 8111 - DNA, 21 bp, Artificial Sequence
  Synthetic
actccgagtttttgttctgtt

SEQ ID NO: 8112 - DNA, 21 bp, Artificial Sequence
  Synthetic
actgtttggtcgagtaatggt

SEQ ID NO: 8113 - DNA, 21 bp, Artificial Sequence
  Synthetic
ggtgtgtggactcctccggct

SEQ ID NO: 8114 - DNA, 21 bp, Artificial Sequence
  Synthetic
gttggttttattaatccgaag

SEQ ID NO: 8115 - DNA, 21 bp, Artificial Sequence
  Synthetic
aagtttgcgcagagtgcgggg

SEQ ID NO: 8116 - DNA, 21 bp, Artificial Sequence
  Synthetic
acgcttgcgaatccgtttttt

SEQ ID NO: 8117 - DNA, 21 bp, Artificial Sequence
  Synthetic
agttatgtggttccttttcat

SEQ ID NO: 8118 - DNA, 21 bp, Artificial Sequence
  Synthetic
acgttgcataggccgtttgct

SEQ ID NO: 8119 - DNA, 21 bp, Artificial Sequence
  Synthetic
tatgagaatttttgtagggag

SEQ ID NO: 8120 - DNA, 21 bp, Artificial Sequence
  Synthetic
gtttatgttgtgagtagtgtt

SEQ ID NO: 8121 - DNA, 21 bp, Artificial Sequence
  Synthetic
gcgacggtgccgtgggcggag

SEQ ID NO: 8122 - DNA, 21 bp, Artificial Sequence
  Synthetic
atgacgtctaagtttcaggtt

SEQ ID NO: 8123 - DNA, 21 bp, Artificial Sequence
  Synthetic
agtgttaattttgtgaatatt

SEQ ID NO: 8124 - DNA, 21 bp, Artificial Sequence
  Synthetic
tctgtgtggagtgcggttggt

SEQ ID NO: 8125 - DNA, 21 bp, Artificial Sequence
  Synthetic
acgccgtggagtttgacgggg

SEQ ID NO: 8126 - DNA, 21 bp, Artificial Sequence
  Synthetic
ggtggtctgagtagtatttgg

SEQ ID NO: 8127 - DNA, 21 bp, Artificial Sequence
  Synthetic
tctctgatggggtttattgct

SEQ ID NO: 8128 - DNA, 21 bp, Artificial Sequence
  Synthetic
gatgtgtggcgtcgggatggg

SEQ ID NO: 8129 - DNA, 21 bp, Artificial Sequence
  Synthetic
atgactatgagtttgtatcct

SEQ ID NO: 8130 - DNA, 21 bp, Artificial Sequence
  Synthetic
ctgatgaggtttgagcaggtt

SEQ ID NO: 8131 - DNA, 21 bp, Artificial Sequence
  Synthetic
tggggtgagtctccttttcgg

SEQ ID NO: 8132 - DNA, 21 bp, Artificial Sequence
  Synthetic
cagcgtgagtttattaatgtt

SEQ ID NO: 8133 - DNA, 21 bp, Artificial Sequence
  Synthetic
aggagtcagcgtccgacgatg

SEQ ID NO: 8134 - DNA, 21 bp, Artificial Sequence
  Synthetic
acgtttgataagccttttttg

SEQ ID NO: 8135 - DNA, 21 bp, Artificial Sequence
  Synthetic
gggtctctgggttgggctgcg

SEQ ID NO: 8136 - DNA, 21 bp, Artificial Sequence
  Synthetic
attttggcgtattttgatggg

SEQ ID NO: 8137 - DNA, 21 bp, Artificial Sequence
  Synthetic
gagaagtctttttgtagtcat

SEQ ID NO: 8138 - DNA, 21 bp, Artificial Sequence
  Synthetic
gaggtttttgttccgccgcgg

SEQ ID NO: 8139 - DNA, 21 bp, Artificial Sequence
  Synthetic
gatttgtttaggatgacgggt

SEQ ID NO: 8140 - DNA, 21 bp, Artificial Sequence
  Synthetic
tcgcttgtggggtgggcgcct

SEQ ID NO: 8141 - DNA, 21 bp, Artificial Sequence
  Synthetic
atgccgatgcatactacttgg

SEQ ID NO: 8142 - DNA, 21 bp, Artificial Sequence
  Synthetic
cttgatggtccttgggtgcct

SEQ ID NO: 8143 - DNA, 21 bp, Artificial Sequence
  Synthetic
gctctgattgctatgaagttg

SEQ ID NO: 8144 - DNA, 21 bp, Artificial Sequence
  Synthetic
cctattaatagtttgagttgg

SEQ ID NO: 8145 - DNA, 21 bp, Artificial Sequence
  Synthetic
aatgatttgcagttttttaag

SEQ ID NO: 8146 - DNA, 21 bp, Artificial Sequence
  Synthetic
attgggctgttgcctttttcg

SEQ ID NO: 8147 - DNA, 21 bp, Artificial Sequence
  Synthetic
ggggatgagcgttattgggat

SEQ ID NO: 8148 - DNA, 21 bp, Artificial Sequence
  Synthetic
actgcgactagtccttggatt

SEQ ID NO: 8149 - DNA, 21 bp, Artificial Sequence
  Synthetic
gggcagactcggccgtttctg

SEQ ID NO: 8150 - DNA, 21 bp, Artificial Sequence
  Synthetic
ttggggatgcggcttggtttt

SEQ ID NO: 8151 - DNA, 21 bp, Artificial Sequence
  Synthetic
gctagtactgttgagtggctg

SEQ ID NO: 8152 - DNA, 21 bp, Artificial Sequence
  Synthetic
gaggctccgaagctttggctt

SEQ ID NO: 8153 - DNA, 21 bp, Artificial Sequence
  Synthetic
attgttaatttttgttctggt

SEQ ID NO: 8154 - DNA, 21 bp, Artificial Sequence
  Synthetic
agtgcgactggttgggttgct

SEQ ID NO: 8155 - DNA, 21 bp, Artificial Sequence
  Synthetic
ggtttgagtttttgtccgatt

SEQ ID NO: 8156 - DNA, 21 bp, Artificial Sequence
  Synthetic
tctggtattcaggctatttgg

SEQ ID NO: 8157 - DNA, 21 bp, Artificial Sequence
  Synthetic
actaataatggttggatggcg

SEQ ID NO: 8158 - DNA, 21 bp, Artificial Sequence
  Synthetic
ctgccttcttggctggagccg

SEQ ID NO: 8159 - DNA, 21 bp, Artificial Sequence
  Synthetic
tcgagttggggtgagcgtatg

SEQ ID NO: 8160 - DNA, 21 bp, Artificial Sequence
  Synthetic
cagtttaagtttgatcaggtg

SEQ ID NO: 8161 - DNA, 21 bp, Artificial Sequence
  Synthetic
gcgtcttgggcgccgccgcag

SEQ ID NO: 8162 - DNA, 21 bp, Artificial Sequence
  Synthetic
tctcggttgattccttttacg

SEQ ID NO: 8163 - DNA, 21 bp, Artificial Sequence
  Synthetic
caggctgagtgggggaagtat

SEQ ID NO: 8164 - DNA, 21 bp, Artificial Sequence
  Synthetic
gtggatgggtggtatagtgcg

SEQ ID NO: 8165 - DNA, 21 bp, Artificial Sequence
  Synthetic
aatccgtttagggagtcgctt

SEQ ID NO: 8166 - DNA, 21 bp, Artificial Sequence
  Synthetic
tcgttgttgcgtcaggcggtg

SEQ ID NO: 8167 - DNA, 21 bp, Artificial Sequence
  Synthetic
aatttggctatgccgtttttg

SEQ ID NO: 8168 - DNA, 21 bp, Artificial Sequence
  Synthetic
agtcttcagaagttgtttagt

SEQ ID NO: 8169 - DNA, 21 bp, Artificial Sequence
  Synthetic
tttgatctggagtatccgagg

SEQ ID NO: 8170 - DNA, 21 bp, Artificial Sequence
  Synthetic
gagaggtgtgggtttgtttgt

SEQ ID NO: 8171 - DNA, 21 bp, Artificial Sequence
  Synthetic
cgttcgtgtggttatgtgtgt

SEQ ID NO: 8172 - DNA, 21 bp, Artificial Sequence
  Synthetic
ttttttggggctgcttttcat

SEQ ID NO: 8173 - DNA, 21 bp, Artificial Sequence
  Synthetic
tctccgtcgtcgctgagttgg

SEQ ID NO: 8174 - DNA, 21 bp, Artificial Sequence
  Synthetic
tctgtgaagttttctgctgtt

SEQ ID NO: 8175 - DNA, 21 bp, Artificial Sequence
  Synthetic
tatagtcatcatttgtttaag

SEQ ID NO: 8176 - DNA, 21 bp, Artificial Sequence
  Synthetic
acgcctaatgctccgtttctt

SEQ ID NO: 8177 - DNA, 21 bp, Artificial Sequence
  Synthetic
catccgcttggttgggttggt

SEQ ID NO: 8178 - DNA, 21 bp, Artificial Sequence
  Synthetic
tcgcttgagcagctttttcgt

SEQ ID NO: 8179 - DNA, 21 bp, Artificial Sequence
  Synthetic
gtgggtaataggtcgtcttgt

SEQ ID NO: 8180 - DNA, 21 bp, Artificial Sequence
  Synthetic
tcgaaggagggttgggtgagt

SEQ ID NO: 8181 - DNA, 21 bp, Artificial Sequence
  Synthetic
cagaaggcttttgcggatgtt

SEQ ID NO: 8182 - DNA, 21 bp, Artificial Sequence
  Synthetic
atggattttagtcatcctcgg

SEQ ID NO: 8183 - DNA, 21 bp, Artificial Sequence
  Synthetic
gtgccggtgtgggggttgttt

SEQ ID NO: 8184 - DNA, 21 bp, Artificial Sequence
  Synthetic
tctgtgaataggccgtttgtt

SEQ ID NO: 8185 - DNA, 21 bp, Artificial Sequence
  Synthetic
acgccggctaagcctttttgg

SEQ ID NO: 8186 - DNA, 21 bp, Artificial Sequence
  Synthetic
gtggggtcgctgccttttcat

SEQ ID NO: 8187 - DNA, 21 bp, Artificial Sequence
  Synthetic
gagtataatcgtccgtttatg

SEQ ID NO: 8188 - DNA, 21 bp, Artificial Sequence
  Synthetic
acgtcggtgcattgggtggcg

SEQ ID NO: 8189 - DNA, 21 bp, Artificial Sequence
  Synthetic
gttgattttgctacgatgtat

SEQ ID NO: 8190 - DNA, 21 bp, Artificial Sequence
  Synthetic
tggggtgcggctgagattatg

SEQ ID NO: 8191 - DNA, 21 bp, Artificial Sequence
  Synthetic
tattcgtcgcatatgtttctt

SEQ ID NO: 8192 - DNA, 21 bp, Artificial Sequence
  Synthetic
gttcctaataatttgtcttgg

SEQ ID NO: 8193 - DNA, 21 bp, Artificial Sequence
  Synthetic
acgagtattgggtttgttgct

SEQ ID NO: 8194 - DNA, 21 bp, Artificial Sequence
  Synthetic
tcggttttttgtaggattgag

SEQ ID NO: 8195 - DNA, 21 bp, Artificial Sequence
  Synthetic
aatattgataagatttggctg

SEQ ID NO: 8196 - DNA, 21 bp, Artificial Sequence
  Synthetic
aatactttgtcggtttcgcgg

SEQ ID NO: 8197 - DNA, 21 bp, Artificial Sequence
  Synthetic
cagattccggggtgggctgcg

SEQ ID NO: 8198 - DNA, 21 bp, Artificial Sequence
  Synthetic
aatgcgtggggggagattcat

SEQ ID NO: 8199 - DNA, 21 bp, Artificial Sequence
  Synthetic
cagattcagttttctaatatt

SEQ ID NO: 8200 - DNA, 21 bp, Artificial Sequence
  Synthetic
gaggttcggtttggggtgttt

SEQ ID NO: 8201 - DNA, 21 bp, Artificial Sequence
  Synthetic
cgttcgtttcatgtgggggat

SEQ ID NO: 8202 - DNA, 21 bp, Artificial Sequence
  Synthetic
acggctgggatgccttttttg

SEQ ID NO: 8203 - DNA, 21 bp, Artificial Sequence
  Synthetic
tctgctcggattccttttgtt

SEQ ID NO: 8204 - DNA, 21 bp, Artificial Sequence
  Synthetic
gtgcttgagaggccttgggtt

SEQ ID NO: 8205 - DNA, 21 bp, Artificial Sequence
  Synthetic
gatatgacgaggccgtttcag

SEQ ID NO: 8206 - DNA, 21 bp, Artificial Sequence
  Synthetic
ggtccgagtaggttgtttcag

SEQ ID NO: 8207 - DNA, 21 bp, Artificial Sequence
  Synthetic
ttgatgctgcctgcgtgggct

SEQ ID NO: 8208 - DNA, 21 bp, Artificial Sequence
  Synthetic
tttactgtggcttatccgaag

SEQ ID NO: 8209 - DNA, 21 bp, Artificial Sequence
  Synthetic
acggcgtattatcctattccg

SEQ ID NO: 8210 - DNA, 21 bp, Artificial Sequence
  Synthetic
tcgggtgggtgggggtctccg

SEQ ID NO: 8211 - DNA, 21 bp, Artificial Sequence
  Synthetic
gctgggggtccgtgggttccg

SEQ ID NO: 8212 - DNA, 21 bp, Artificial Sequence
  Synthetic
gctacgtttgttccgcctcag

SEQ ID NO: 8213 - DNA, 21 bp, Artificial Sequence
  Synthetic
attgatactccttgggtggcg

SEQ ID NO: 8214 - DNA, 21 bp, Artificial Sequence
  Synthetic
gctgcggtggggtggatgccg

SEQ ID NO: 8215 - DNA, 21 bp, Artificial Sequence
  Synthetic
ttggggcagcgtttggggttt

SEQ ID NO: 8216 - DNA, 21 bp, Artificial Sequence
  Synthetic
cagattaagtttagtactatt

SEQ ID NO: 8217 - DNA, 21 bp, Artificial Sequence
  Synthetic
cctgcgcatgctacgagttgg

SEQ ID NO: 8218 - DNA, 21 bp, Artificial Sequence
  Synthetic
aatgcgtggtctaagacgggg

SEQ ID NO: 8219 - DNA, 21 bp, Artificial Sequence
  Synthetic
ctgtatggttgttgtcttgag

SEQ ID NO: 8220 - DNA, 21 bp, Artificial Sequence
  Synthetic
ttgggtcctttgttggtgaag

SEQ ID NO: 8221 - DNA, 21 bp, Artificial Sequence
  Synthetic
aaggagatgtcgattagttgg

SEQ ID NO: 8222 - DNA, 21 bp, Artificial Sequence
  Synthetic
gctttgccgaaggagtggctg

SEQ ID NO: 8223 - DNA, 21 bp, Artificial Sequence
  Synthetic
tctggtttgagtgctatttgg

SEQ ID NO: 8224 - DNA, 21 bp, Artificial Sequence
  Synthetic
ttgagtactgatcttaagtgt

SEQ ID NO: 8225 - DNA, 21 bp, Artificial Sequence
  Synthetic
gtgcctatgactcttagtttt

SEQ ID NO: 8226 - DNA, 21 bp, Artificial Sequence
  Synthetic
gcgagttggagtcctcctgag

SEQ ID NO: 8227 - DNA, 21 bp, Artificial Sequence
  Synthetic
gatccgatttggccttatcct

SEQ ID NO: 8228 - DNA, 21 bp, Artificial Sequence
  Synthetic
cttttgatgaatgtgtttggt

SEQ ID NO: 8229 - DNA, 21 bp, Artificial Sequence
  Synthetic
atgaaggagttttgtactctg

SEQ ID NO: 8230 - DNA, 21 bp, Artificial Sequence
  Synthetic
gtttattttggtgagtcttat

SEQ ID NO: 8231 - DNA, 21 bp, Artificial Sequence
  Synthetic
gggcattgggggccgcatctg

SEQ ID NO: 8232 - DNA, 21 bp, Artificial Sequence
  Synthetic
gcgggtgctgtttttaattgg

SEQ ID NO: 8233 - DNA, 21 bp, Artificial Sequence
  Synthetic
tctgttgagcggccttttcat

SEQ ID NO: 8234 - DNA, 21 bp, Artificial Sequence
  Synthetic
gtggggcttcttccgttttcg

SEQ ID NO: 8235 - DNA, 21 bp, Artificial Sequence
  Synthetic
gttcctatgaatcgtacgttt

SEQ ID NO: 8236 - DNA, 21 bp, Artificial Sequence
  Synthetic
gttgagtttgttcctccgatg

SEQ ID NO: 8237 - DNA, 21 bp, Artificial Sequence
  Synthetic
actaggctgggttttacggcg

SEQ ID NO: 8238 - DNA, 21 bp, Artificial Sequence
  Synthetic
gataaggatcatctgtttagg

SEQ ID NO: 8239 - DNA, 21 bp, Artificial Sequence
  Synthetic
tcgatgcttggttttagtccg

SEQ ID NO: 8240 - DNA, 21 bp, Artificial Sequence
  Synthetic
ggtctggataagccttttctt

SEQ ID NO: 8241 - DNA, 21 bp, Artificial Sequence
  Synthetic
gtgccggttaggggttgggtg

SEQ ID NO: 8242 - DNA, 21 bp, Artificial Sequence
  Synthetic
actatttggttgagtaatggt

SEQ ID NO: 8243 - DNA, 21 bp, Artificial Sequence
  Synthetic
gatgttcggcctttgttgcgt

SEQ ID NO: 8244 - DNA, 21 bp, Artificial Sequence
  Synthetic
tgggatatggtgggtgcgcgg

SEQ ID NO: 8245 - DNA, 21 bp, Artificial Sequence
  Synthetic
ctgatggggtgtccgtcttgt

SEQ ID NO: 8246 - DNA, 21 bp, Artificial Sequence
  Synthetic
tcgcggcagttttcggatgtg

SEQ ID NO: 8247 - DNA, 21 bp, Artificial Sequence
  Synthetic
tggactgagcattttcctcgg

SEQ ID NO: 8248 - DNA, 21 bp, Artificial Sequence
  Synthetic
ttggagactttttgtcgtgct

SEQ ID NO: 8249 - DNA, 21 bp, Artificial Sequence
  Synthetic
tatcgtaatccgatggtggct

SEQ ID NO: 8250 - DNA, 21 bp, Artificial Sequence
  Synthetic
cgggcggctggggctcatttg

SEQ ID NO: 8251 - DNA, 21 bp, Artificial Sequence
  Synthetic
gttattagtcggccttttgcg

SEQ ID NO: 8252 - DNA, 21 bp, Artificial Sequence
  Synthetic
ctgtcgcagttttgtactccg

SEQ ID NO: 8253 - DNA, 21 bp, Artificial Sequence
  Synthetic
agtccggttgctccttttagg

SEQ ID NO: 8254 - DNA, 21 bp, Artificial Sequence
  Synthetic
cagcgtctttttaatgttgtg

SEQ ID NO: 8255 - DNA, 21 bp, Artificial Sequence
  Synthetic
cattatgatgtgaagcctaag

SEQ ID NO: 8256 - DNA, 21 bp, Artificial Sequence
  Synthetic
gatccgacgcatccgtttcgt

SEQ ID NO: 8257 - DNA, 21 bp, Artificial Sequence
  Synthetic
agtaatgagtggggggttttt

SEQ ID NO: 8258 - DNA, 21 bp, Artificial Sequence
  Synthetic
ttgtttgattgttctaattgt

SEQ ID NO: 8259 - DNA, 21 bp, Artificial Sequence
  Synthetic
acgtttgagcgtccttggact

SEQ ID NO: 8260 - DNA, 21 bp, Artificial Sequence
  Synthetic
cttattgagaggccgtttcag

SEQ ID NO: 8261 - DNA, 21 bp, Artificial Sequence
  Synthetic
tggattacgtttgcggaggtg

SEQ ID NO: 8262 - DNA, 21 bp, Artificial Sequence
  Synthetic
aagcagacgaattgggtggat

SEQ ID NO: 8263 - DNA, 21 bp, Artificial Sequence
  Synthetic
ggtaagctgcctattgtgccg

SEQ ID NO: 8264 - DNA, 21 bp, Artificial Sequence
  Synthetic
atgttgacgcggccgttttct

SEQ ID NO: 8265 - DNA, 21 bp, Artificial Sequence
  Synthetic
attgatttttttcggcctttg

SEQ ID NO: 8266 - DNA, 21 bp, Artificial Sequence
  Synthetic
acggtgacttatcctattccg

SEQ ID NO: 8267 - DNA, 21 bp, Artificial Sequence
  Synthetic
actgcggtggcgctgtttaag

SEQ ID NO: 8268 - DNA, 21 bp, Artificial Sequence
  Synthetic
gagattacgaagcctttttgg

SEQ ID NO: 8269 - DNA, 21 bp, Artificial Sequence
  Synthetic
tatcagatgaagtggtttgag

SEQ ID NO: 8270 - DNA, 21 bp, Artificial Sequence
  Synthetic
gatgtgcgtgggtgggtgccg

SEQ ID NO: 8271 - DNA, 21 bp, Artificial Sequence
  Synthetic
gtttcgagttttggtcagtat

SEQ ID NO: 8272 - DNA, 21 bp, Artificial Sequence
  Synthetic
tattctggtcgtccgtttctt

SEQ ID NO: 8273 - DNA, 21 bp, Artificial Sequence
  Synthetic
gagaatattaagtatacgcat

SEQ ID NO: 8274 - DNA, 21 bp, Artificial Sequence
  Synthetic
gatccgtggcggcctgttggg

SEQ ID NO: 8275 - DNA, 21 bp, Artificial Sequence
  Synthetic
tatgtggctgggccgcctcgg

SEQ ID NO: 8276 - DNA, 21 bp, Artificial Sequence
  Synthetic
ttgcctgagtctccgtttagg

SEQ ID NO: 8277 - DNA, 21 bp, Artificial Sequence
  Synthetic
acggtgtggatgccggggggg

SEQ ID NO: 8278 - DNA, 21 bp, Artificial Sequence
  Synthetic
cggcatgtgaatcatgctggt

SEQ ID NO: 8279 - DNA, 21 bp, Artificial Sequence
  Synthetic
tcggcgcttggttttgttccg

SEQ ID NO: 8280 - DNA, 21 bp, Artificial Sequence
  Synthetic
tctactaagttttcggctatt

SEQ ID NO: 8281 - DNA, 21 bp, Artificial Sequence
  Synthetic
gttaaggagcggctgtttcag

SEQ ID NO: 8282 - DNA, 21 bp, Artificial Sequence
  Synthetic
ggtcagacttggggggctttt

SEQ ID NO: 8283 - DNA, 21 bp, Artificial Sequence
  Synthetic
tcgttgatgaagctttttcct

SEQ ID NO: 8284 - DNA, 21 bp, Artificial Sequence
  Synthetic
gatgtgtggcgtgatgatggt

SEQ ID NO: 8285 - DNA, 21 bp, Artificial Sequence
  Synthetic
gtgctggggcatacgtttttg

SEQ ID NO: 8286 - DNA, 21 bp, Artificial Sequence
  Synthetic
ggtatttatggttttgcgagt

SEQ ID NO: 8287 - DNA, 21 bp, Artificial Sequence
  Synthetic
agggaggctaggcatattggg

SEQ ID NO: 8288 - DNA, 21 bp, Artificial Sequence
  Synthetic
tattctgagaggccttggcct

SEQ ID NO: 8289 - DNA, 21 bp, Artificial Sequence
  Synthetic
cgggtggctcaggagggtcgt

SEQ ID NO: 8290 - DNA, 21 bp, Artificial Sequence
  Synthetic
tatcaggagatgtttttttcg

SEQ ID NO: 8291 - DNA, 21 bp, Artificial Sequence
  Synthetic
ctgcgggagtttatttttggt

SEQ ID NO: 8292 - DNA, 21 bp, Artificial Sequence
  Synthetic
cagtataatcatagggcgaat

SEQ ID NO: 8293 - DNA, 21 bp, Artificial Sequence
  Synthetic
gcgggtgttcagctgggttgt

SEQ ID NO: 8294 - DNA, 21 bp, Artificial Sequence
  Synthetic
cggaataggtttgaggatatt

SEQ ID NO: 8295 - DNA, 21 bp, Artificial Sequence
  Synthetic
agttcgcttggttgggctgct

SEQ ID NO: 8296 - DNA, 21 bp, Artificial Sequence
  Synthetic
ccgaatcagcagtatcatctt

SEQ ID NO: 8297 - DNA, 21 bp, Artificial Sequence
  Synthetic
attcatgcgcgtggtctggtt

SEQ ID NO: 8298 - DNA, 21 bp, Artificial Sequence
  Synthetic
actcttaagttgccttttatg

SEQ ID NO: 8299 - DNA, 21 bp, Artificial Sequence
  Synthetic
gctagttggactcctcctgtt

SEQ ID NO: 8300 - DNA, 21 bp, Artificial Sequence
  Synthetic
gctaaggtgccgtggcaggct

SEQ ID NO: 8301 - DNA, 21 bp, Artificial Sequence
  Synthetic
aatgagcgtcatccgtttctt

SEQ ID NO: 8302 - DNA, 21 bp, Artificial Sequence
  Synthetic
ggtgatagtccgtgggtggct

SEQ ID NO: 8303 - DNA, 21 bp, Artificial Sequence
  Synthetic
tggggtgctgctgagaggctg

SEQ ID NO: 8304 - DNA, 21 bp, Artificial Sequence
  Synthetic
actgtttggaatcctccttct

SEQ ID NO: 8305 - DNA, 21 bp, Artificial Sequence
  Synthetic
catgagggtaggccgtgggtg

SEQ ID NO: 8306 - DNA, 21 bp, Artificial Sequence
  Synthetic
cagacgaattttgctcatatt

SEQ ID NO: 8307 - DNA, 21 bp, Artificial Sequence
  Synthetic
tggtggcctggtgcttgggag

SEQ ID NO: 8308 - DNA, 21 bp, Artificial Sequence
  Synthetic
tcgtttcggactccgtttatt

SEQ ID NO: 8309 - DNA, 21 bp, Artificial Sequence
  Synthetic
caggcgaagtttcaggatatt

SEQ ID NO: 8310 - DNA, 21 bp, Artificial Sequence
  Synthetic
gttcttaagtttggtacgtat

SEQ ID NO: 8311 - DNA, 21 bp, Artificial Sequence
  Synthetic
gcggtgcggtttgattgtgtg

SEQ ID NO: 8312 - DNA, 21 bp, Artificial Sequence
  Synthetic
agggcgcctttttttctgtct

SEQ ID NO: 8313 - DNA, 21 bp, Artificial Sequence
  Synthetic
tcgttgaagttttctagtgtt

SEQ ID NO: 8314 - DNA, 21 bp, Artificial Sequence
  Synthetic
tggaatgttaattgtagtgtt

SEQ ID NO: 8315 - DNA, 21 bp, Artificial Sequence
  Synthetic
tggtgtaaggcggctaaggat

SEQ ID NO: 8316 - DNA, 21 bp, Artificial Sequence
  Synthetic
agtattgagattccgtttcag

SEQ ID NO: 8317 - DNA, 21 bp, Artificial Sequence
  Synthetic
actctggagagggtgtttatt

SEQ ID NO: 8318 - DNA, 21 bp, Artificial Sequence
  Synthetic
caggttaggtttgctttgcag

SEQ ID NO: 8319 - DNA, 21 bp, Artificial Sequence
  Synthetic
cgggctgaggttggtgcgcgg

SEQ ID NO: 8320 - DNA, 21 bp, Artificial Sequence
  Synthetic
acgacgcagaagccttttgtt

SEQ ID NO: 8321 - DNA, 21 bp, Artificial Sequence
  Synthetic
gctgagactttttgtcggggg

SEQ ID NO: 8322 - DNA, 21 bp, Artificial Sequence
  Synthetic
gggtttgagcgtccgtttttg

SEQ ID NO: 8323 - DNA, 21 bp, Artificial Sequence
  Synthetic
ggtaattggcgtcctccggct

SEQ ID NO: 8324 - DNA, 21 bp, Artificial Sequence
  Synthetic
attcttggttggagtgatttg

SEQ ID NO: 8325 - DNA, 21 bp, Artificial Sequence
  Synthetic
tcgtatgagttttctcgggtg

SEQ ID NO: 8326 - DNA, 21 bp, Artificial Sequence
  Synthetic
tttactatgagtgggccgaag

SEQ ID NO: 8327 - DNA, 21 bp, Artificial Sequence
  Synthetic
tgggaggagtttaagcgtgtg

SEQ ID NO: 8328 - DNA, 21 bp, Artificial Sequence
  Synthetic
agtctgattaatccgttttcg

SEQ ID NO: 8329 - DNA, 21 bp, Artificial Sequence
  Synthetic
ggtgggaattctggtatgcgt

SEQ ID NO: 8330 - DNA, 21 bp, Artificial Sequence
  Synthetic
atgcctaaggggtcgggttgg

SEQ ID NO: 8331 - DNA, 21 bp, Artificial Sequence
  Synthetic
gctttgtggagtgatgtgtcg

SEQ ID NO: 8332 - DNA, 21 bp, Artificial Sequence
  Synthetic
acgtttcagaatccgtttttg

SEQ ID NO: 8333 - DNA, 21 bp, Artificial Sequence
  Synthetic
actgagattcattggtctcct

SEQ ID NO: 8334 - DNA, 21 bp, Artificial Sequence
  Synthetic
tatccggggatgcttttttat

SEQ ID NO: 8335 - DNA, 21 bp, Artificial Sequence
  Synthetic
ccgctgctgtttcagaatgtt

SEQ ID NO: 8336 - DNA, 21 bp, Artificial Sequence
  Synthetic
attcagtttaataatcctcgg

SEQ ID NO: 8337 - DNA, 21 bp, Artificial Sequence
  Synthetic
actgtgtggagtttgtcgggt

SEQ ID NO: 8338 - DNA, 21 bp, Artificial Sequence
  Synthetic
agtccgacgcttccttttctt

SEQ ID NO: 8339 - DNA, 21 bp, Artificial Sequence
  Synthetic
gcggcggagggttggattgct

SEQ ID NO: 8340 - DNA, 21 bp, Artificial Sequence
  Synthetic
ggtacgtttcatcctcctcgg

SEQ ID NO: 8341 - DNA, 21 bp, Artificial Sequence
  Synthetic
ctggggattcagtcgattttt

SEQ ID NO: 8342 - DNA, 21 bp, Artificial Sequence
  Synthetic
atgccggagtggggtaagttt

SEQ ID NO: 8343 - DNA, 21 bp, Artificial Sequence
  Synthetic
attcctagtaatacgtcttgg

SEQ ID NO: 8344 - DNA, 21 bp, Artificial Sequence
  Synthetic
tatgcgggttatttttttgcg

SEQ ID NO: 8345 - DNA, 21 bp, Artificial Sequence
  Synthetic
gaggtgtttaggcctcatctt

SEQ ID NO: 8346 - DNA, 21 bp, Artificial Sequence
  Synthetic
cagctgaggtttgagagtatt

SEQ ID NO: 8347 - DNA, 21 bp, Artificial Sequence
  Synthetic
ttgcctagttggcttgatcct

SEQ ID NO: 8348 - DNA, 21 bp, Artificial Sequence
  Synthetic
cgtacgtcttttgcgactatt

SEQ ID NO: 8349 - DNA, 21 bp, Artificial Sequence
  Synthetic
tctgaggtggggtgggctgct

SEQ ID NO: 8350 - DNA, 21 bp, Artificial Sequence
  Synthetic
tctgtttggggtgcggtgcat

SEQ ID NO: 8351 - DNA, 21 bp, Artificial Sequence
  Synthetic
tggactatgattgggtcggtg

SEQ ID NO: 8352 - DNA, 21 bp, Artificial Sequence
  Synthetic
cggaataataatcctgggttg

SEQ ID NO: 8353 - DNA, 21 bp, Artificial Sequence
  Synthetic
agttctcctggttgggttgcg

SEQ ID NO: 8354 - DNA, 21 bp, Artificial Sequence
  Synthetic
catgttattggttggactcag

SEQ ID NO: 8355 - DNA, 21 bp, Artificial Sequence
  Synthetic
gttcggcataatctgaatggt

SEQ ID NO: 8356 - DNA, 21 bp, Artificial Sequence
  Synthetic
ggtgttccgcgtactcatgtg

SEQ ID NO: 8357 - DNA, 21 bp, Artificial Sequence
  Synthetic
catgaggctgctcggccgagg

SEQ ID NO: 8358 - DNA, 21 bp, Artificial Sequence
  Synthetic
atgccgatgaatatttcgtat

SEQ ID NO: 8359 - DNA, 21 bp, Artificial Sequence
  Synthetic
acgccttggcgggttgagggt

SEQ ID NO: 8360 - DNA, 21 bp, Artificial Sequence
  Synthetic
gggagtgttggttgggttgct

SEQ ID NO: 8361 - DNA, 21 bp, Artificial Sequence
  Synthetic
atgtcttttgctactcatctt

SEQ ID NO: 8362 - DNA, 21 bp, Artificial Sequence
  Synthetic
ctgatgcagctgtgtacggtt

SEQ ID NO: 8363 - DNA, 21 bp, Artificial Sequence
  Synthetic
tgtgctgtgagtgcgcgttat

SEQ ID NO: 8364 - DNA, 21 bp, Artificial Sequence
  Synthetic
agttatacgagtccttttatg

SEQ ID NO: 8365 - DNA, 21 bp, Artificial Sequence
  Synthetic
aatagttggggtgaggctaag

SEQ ID NO: 8366 - DNA, 21 bp, Artificial Sequence
  Synthetic
gatgtgtggaggagttcgggg

SEQ ID NO: 8367 - DNA, 21 bp, Artificial Sequence
  Synthetic
cagtataggtttgaggatgtt

SEQ ID NO: 8368 - DNA, 21 bp, Artificial Sequence
  Synthetic
gtggctgggtggagtcagtat

SEQ ID NO: 8369 - DNA, 21 bp, Artificial Sequence
  Synthetic
ttgttgcctgagcattggctt

SEQ ID NO: 8370 - DNA, 21 bp, Artificial Sequence
  Synthetic
acggtgacgatgttgtttgct

SEQ ID NO: 8371 - DNA, 21 bp, Artificial Sequence
  Synthetic
attcctcctgggttttatccg

SEQ ID NO: 8372 - DNA, 21 bp, Artificial Sequence
  Synthetic
tcgcctacgcatatttttcag

SEQ ID NO: 8373 - DNA, 21 bp, Artificial Sequence
  Synthetic
gttggtgtgaagcttgggtgt

SEQ ID NO: 8374 - DNA, 21 bp, Artificial Sequence
  Synthetic
ttgagtgatcggccttgggtt

SEQ ID NO: 8375 - DNA, 21 bp, Artificial Sequence
  Synthetic
acgcttgctactccttttact

SEQ ID NO: 8376 - DNA, 21 bp, Artificial Sequence
  Synthetic
ggtgcttttgctttttttgag

SEQ ID NO: 8377 - DNA, 21 bp, Artificial Sequence
  Synthetic
cttcagcgtgggcttgagcgt

SEQ ID NO: 8378 - DNA, 21 bp, Artificial Sequence
  Synthetic
tgtattttgggtctgggttgt

SEQ ID NO: 8379 - DNA, 21 bp, Artificial Sequence
  Synthetic
ggtgcttggggttttgtggcg

SEQ ID NO: 8380 - DNA, 21 bp, Artificial Sequence
  Synthetic
tgggggtttgagggtcctagg

SEQ ID NO: 8381 - DNA, 21 bp, Artificial Sequence
  Synthetic
gcgctgcggttttctgctgtg

SEQ ID NO: 8382 - DNA, 21 bp, Artificial Sequence
  Synthetic
ggtgtgtttaatccgcctgag

SEQ ID NO: 8383 - DNA, 21 bp, Artificial Sequence
  Synthetic
tctcgggagttttgtgaggtg

SEQ ID NO: 8384 - DNA, 21 bp, Artificial Sequence
  Synthetic
gagcctcattggcatgatagt

SEQ ID NO: 8385 - DNA, 21 bp, Artificial Sequence
  Synthetic
gtggagggttggtatcttgcg

SEQ ID NO: 8386 - DNA, 21 bp, Artificial Sequence
  Synthetic
tcgccgagtcagcctttttgg

SEQ ID NO: 8387 - DNA, 21 bp, Artificial Sequence
  Synthetic
gatccgttgtttaggattgct

SEQ ID NO: 8388 - DNA, 21 bp, Artificial Sequence
  Synthetic
actggggtggcgcttgggcgt

SEQ ID NO: 8389 - DNA, 21 bp, Artificial Sequence
  Synthetic
cagacgcgtttttctgagttt

SEQ ID NO: 8390 - DNA, 21 bp, Artificial Sequence
  Synthetic
gattgtcggattaagaatccg

SEQ ID NO: 8391 - DNA, 21 bp, Artificial Sequence
  Synthetic
gtgggtgtgccgtggttggcg

SEQ ID NO: 8392 - DNA, 21 bp, Artificial Sequence
  Synthetic
ggtgggtggatttatgaggcg

SEQ ID NO: 8393 - DNA, 21 bp, Artificial Sequence
  Synthetic
cgtgagttggataggcagcgt

SEQ ID NO: 8394 - DNA, 21 bp, Artificial Sequence
  Synthetic
cagaggcaggaggaggattgg

SEQ ID NO: 8395 - DNA, 21 bp, Artificial Sequence
  Synthetic
ggtcattttacgccgccggtg

SEQ ID NO: 8396 - DNA, 21 bp, Artificial Sequence
  Synthetic
tatggtatgcggttgggtgtg

SEQ ID NO: 8397 - DNA, 21 bp, Artificial Sequence
  Synthetic
tcgaatgcgtggggggagtat

SEQ ID NO: 8398 - DNA, 21 bp, Artificial Sequence
  Synthetic
agtacgcatcgtactgcgtgt

SEQ ID NO: 8399 - DNA, 21 bp, Artificial Sequence
  Synthetic
ttgaagggtattcctattgtg

SEQ ID NO: 8400 - DNA, 21 bp, Artificial Sequence
  Synthetic
tttaggttgaatcctagtgtg

SEQ ID NO: 8401 - DNA, 21 bp, Artificial Sequence
  Synthetic
agtgttgagttttgtactatg

SEQ ID NO: 8402 - DNA, 21 bp, Artificial Sequence
  Synthetic
ggtcatcctaatcagaggttg

SEQ ID NO: 8403 - DNA, 21 bp, Artificial Sequence
  Synthetic
gttagtgggtggtatgttgag

SEQ ID NO: 8404 - DNA, 21 bp, Artificial Sequence
  Synthetic
ggtagttcgggttgggtggct

SEQ ID NO: 8405 - DNA, 21 bp, Artificial Sequence
  Synthetic
ttgcctattcagacttggctg

SEQ ID NO: 8406 - DNA, 21 bp, Artificial Sequence
  Synthetic
acggtgtttggtacggtgtat

SEQ ID NO: 8407 - DNA, 21 bp, Artificial Sequence
  Synthetic
gttgggacgatgccttttact

SEQ ID NO: 8408 - DNA, 21 bp, Artificial Sequence
  Synthetic
tttatggataagccgtggtat

SEQ ID NO: 8409 - DNA, 21 bp, Artificial Sequence
  Synthetic
tcggatcctcattgggtgagg

SEQ ID NO: 8410 - DNA, 21 bp, Artificial Sequence
  Synthetic
gtggataagccttgggttccg

SEQ ID NO: 8411 - DNA, 21 bp, Artificial Sequence
  Synthetic
acgcaggttcagctttttaag

SEQ ID NO: 8412 - DNA, 21 bp, Artificial Sequence
  Synthetic
tttgatctgagtagtcctagg

SEQ ID NO: 8413 - DNA, 21 bp, Artificial Sequence
  Synthetic
actgagagtccttctgagcat

SEQ ID NO: 8414 - DNA, 21 bp, Artificial Sequence
  Synthetic
cagattgatcatccgtggctt

SEQ ID NO: 8415 - DNA, 21 bp, Artificial Sequence
  Synthetic
gatattagtcggccgtttatg

SEQ ID NO: 8416 - DNA, 21 bp, Artificial Sequence
  Synthetic
gggagttatggttttgtgcct

SEQ ID NO: 8417 - DNA, 21 bp, Artificial Sequence
  Synthetic
tttaattcttggcctatgccg

SEQ ID NO: 8418 - DNA, 21 bp, Artificial Sequence
  Synthetic
gtgcgtgatatgggtctttgg

SEQ ID NO: 8419 - DNA, 21 bp, Artificial Sequence
  Synthetic
gagcctattcgtgggtggatt

SEQ ID NO: 8420 - DNA, 21 bp, Artificial Sequence
  Synthetic
acgaaggagtttgctatgatt

SEQ ID NO: 8421 - DNA, 21 bp, Artificial Sequence
  Synthetic
gttcatccgttttggcaggcg

SEQ ID NO: 8422 - DNA, 21 bp, Artificial Sequence
  Synthetic
tatacgggggcgccgtttcat

SEQ ID NO: 8423 - DNA, 21 bp, Artificial Sequence
  Synthetic
caggttgtttttgctaatgtt

SEQ ID NO: 8424 - DNA, 21 bp, Artificial Sequence
  Synthetic
tctactgagaatccgtttcgt

SEQ ID NO: 8425 - DNA, 21 bp, Artificial Sequence
  Synthetic
atgcttcctcggtggccgcct

SEQ ID NO: 8426 - DNA, 21 bp, Artificial Sequence
  Synthetic
gggttgtttggttttgtggct

SEQ ID NO: 8427 - DNA, 21 bp, Artificial Sequence
  Synthetic
tttatgcagtcgacgaagaat

SEQ ID NO: 8428 - DNA, 21 bp, Artificial Sequence
  Synthetic
ctgtttgctaaggagtggttg

SEQ ID NO: 8429 - DNA, 21 bp, Artificial Sequence
  Synthetic
cagggtgctttttgtaatccg

SEQ ID NO: 8430 - DNA, 21 bp, Artificial Sequence
  Synthetic
tgggtgtttgatggtgggggg

SEQ ID NO: 8431 - DNA, 21 bp, Artificial Sequence
  Synthetic
agtaaggagttttgtgagatt

SEQ ID NO: 8432 - DNA, 21 bp, Artificial Sequence
  Synthetic
cgtccggcgtctactagttgg

SEQ ID NO: 8433 - DNA, 21 bp, Artificial Sequence
  Synthetic
aaggagcgtgtgaatacgcat

SEQ ID NO: 8434 - DNA, 21 bp, Artificial Sequence
  Synthetic
gtggtggcggattggactaag

SEQ ID NO: 8435 - DNA, 21 bp, Artificial Sequence
  Synthetic
aataaggatggtgggcgtgcg

SEQ ID NO: 8436 - DNA, 21 bp, Artificial Sequence
  Synthetic
gtgactggttggtatggggag

SEQ ID NO: 8437 - DNA, 21 bp, Artificial Sequence
  Synthetic
aggtgggaggagaatagttat

SEQ ID NO: 8438 - DNA, 21 bp, Artificial Sequence
  Synthetic
tctcgggaggctcagtcgaag

SEQ ID NO: 8439 - DNA, 21 bp, Artificial Sequence
  Synthetic
cagggggttaagcttgggtgt

SEQ ID NO: 8440 - DNA, 21 bp, Artificial Sequence
  Synthetic
gctatgcataatattgtggcg

SEQ ID NO: 8441 - DNA, 21 bp, Artificial Sequence
  Synthetic
ggtattctgggtaatcgtggt

SEQ ID NO: 8442 - DNA, 21 bp, Artificial Sequence
  Synthetic
atgggtgcgtctttttgtccg

SEQ ID NO: 8443 - DNA, 21 bp, Artificial Sequence
  Synthetic
actagtaataatccttggctg

SEQ ID NO: 8444 - DNA, 21 bp, Artificial Sequence
  Synthetic
actacgttgcgtccgtttgtt

SEQ ID NO: 8445 - DNA, 21 bp, Artificial Sequence
  Synthetic
aatctgtttggggagcatctg

SEQ ID NO: 8446 - DNA, 21 bp, Artificial Sequence
  Synthetic
gttattgtgtctatgcgtccg

SEQ ID NO: 8447 - DNA, 21 bp, Artificial Sequence
  Synthetic
acgaatttttgtgagcttatt

SEQ ID NO: 8448 - DNA, 21 bp, Artificial Sequence
  Synthetic
actgtttgggcttcgcagggg

SEQ ID NO: 8449 - DNA, 21 bp, Artificial Sequence
  Synthetic
attggttcgctgccgtggatg

SEQ ID NO: 8450 - DNA, 21 bp, Artificial Sequence
  Synthetic
cagattaggtttgagcaggtt

SEQ ID NO: 8451 - DNA, 21 bp, Artificial Sequence
  Synthetic
tatcatgatcatccgtttgtg

SEQ ID NO: 8452 - DNA, 21 bp, Artificial Sequence
  Synthetic
gtttctccgttttatattaat

SEQ ID NO: 8453 - DNA, 21 bp, Artificial Sequence
  Synthetic
acgctgcagcttccgtttatt

SEQ ID NO: 8454 - DNA, 21 bp, Artificial Sequence
  Synthetic
gtgggtggggtgccgtttagg

SEQ ID NO: 8455 - DNA, 21 bp, Artificial Sequence
  Synthetic
caggtgaggctgattgatgtg

SEQ ID NO: 8456 - DNA, 21 bp, Artificial Sequence
  Synthetic
gtgttggcgaatccgtttcgg

SEQ ID NO: 8457 - DNA, 21 bp, Artificial Sequence
  Synthetic
actatgagtttgccttttctt

SEQ ID NO: 8458 - DNA, 21 bp, Artificial Sequence
  Synthetic
gggatgtgggagagtgggggg

SEQ ID NO: 8459 - DNA, 21 bp, Artificial Sequence
  Synthetic
tatgatcttgttgggccgcgg

SEQ ID NO: 8460 - DNA, 21 bp, Artificial Sequence
  Synthetic
ctgccggagcttccgtttcgt

SEQ ID NO: 8461 - DNA, 21 bp, Artificial Sequence
  Synthetic
acggttggtcgtatgtttgtt

SEQ ID NO: 8462 - DNA, 21 bp, Artificial Sequence
  Synthetic
attactattaatacgtctagg

SEQ ID NO: 8463 - DNA, 21 bp, Artificial Sequence
  Synthetic
agtagtgctaatccttttaag

SEQ ID NO: 8464 - DNA, 21 bp, Artificial Sequence
  Synthetic
ttggatccgattccttttagt

SEQ ID NO: 8465 - DNA, 21 bp, Artificial Sequence
  Synthetic
tatattgggcggttgtttgcg

SEQ ID NO: 8466 - DNA, 21 bp, Artificial Sequence
  Synthetic
tcggttaagtttagtgcgatt

SEQ ID NO: 8467 - DNA, 21 bp, Artificial Sequence
  Synthetic
gtgatggatcctatgttgttt

SEQ ID NO: 8468 - DNA, 21 bp, Artificial Sequence
  Synthetic
attggtgtggtggtgagtctt

SEQ ID NO: 8469 - DNA, 21 bp, Artificial Sequence
  Synthetic
cctatgatgactactgcgtgg

SEQ ID NO: 8470 - DNA, 21 bp, Artificial Sequence
  Synthetic
gggaagagtgcgctgaaggct

SEQ ID NO: 8471 - DNA, 21 bp, Artificial Sequence
  Synthetic
cgtgttgggggtacggagagt

SEQ ID NO: 8472 - DNA, 21 bp, Artificial Sequence
  Synthetic
gtttctagtcagctgcatagg

SEQ ID NO: 8473 - DNA, 21 bp, Artificial Sequence
  Synthetic
tctactcagttttgtgcgctt

SEQ ID NO: 8474 - DNA, 21 bp, Artificial Sequence
  Synthetic
gagtatacgacgttgtttcgg

SEQ ID NO: 8475 - DNA, 21 bp, Artificial Sequence
  Synthetic
tttcttgataggccgtttccg

SEQ ID NO: 8476 - DNA, 21 bp, Artificial Sequence
  Synthetic
gttcggtttgagatgcctcag

SEQ ID NO: 8477 - DNA, 21 bp, Artificial Sequence
  Synthetic
tcttatcagactcctgctagg

SEQ ID NO: 8478 - DNA, 21 bp, Artificial Sequence
  Synthetic
gattggcgtggtaataatcat

SEQ ID NO: 8479 - DNA, 21 bp, Artificial Sequence
  Synthetic
agtaagtcgtttgtgtcgatt

SEQ ID NO: 8480 - DNA, 21 bp, Artificial Sequence
  Synthetic
gcgcttgcgaggccgtttcct

SEQ ID NO: 8481 - DNA, 21 bp, Artificial Sequence
  Synthetic
acggttcctggttgggcggcg

SEQ ID NO: 8482 - DNA, 21 bp, Artificial Sequence
  Synthetic
gtgcctgctaagccgtttctg

SEQ ID NO: 8483 - DNA, 21 bp, Artificial Sequence
  Synthetic
agtgtgtggaggacggagggg

SEQ ID NO: 8484 - DNA, 21 bp, Artificial Sequence
  Synthetic
ggttctgggcgtgggcgtgag

SEQ ID NO: 8485 - DNA, 21 bp, Artificial Sequence
  Synthetic
tatcgggagcggctttttagt

SEQ ID NO: 8486 - DNA, 21 bp, Artificial Sequence
  Synthetic
cctgatattgcgaggctttgg

SEQ ID NO: 8487 - DNA, 21 bp, Artificial Sequence
  Synthetic
tatgatcataggccttttcag

SEQ ID NO: 8488 - DNA, 21 bp, Artificial Sequence
  Synthetic
catggtacgggggctcgtatg

SEQ ID NO: 8489 - DNA, 21 bp, Artificial Sequence
  Synthetic
aatacgatgtctagttctcgg

SEQ ID NO: 8490 - DNA, 21 bp, Artificial Sequence
  Synthetic
gatttgtttttgagtggtagg

SEQ ID NO: 8491 - DNA, 21 bp, Artificial Sequence
  Synthetic
ctgcgtcgtgagtggattggt

SEQ ID NO: 8492 - DNA, 21 bp, Artificial Sequence
  Synthetic
gggattaggagtactgagcgt

SEQ ID NO: 8493 - DNA, 21 bp, Artificial Sequence
  Synthetic
ctgggggagaggccgtggctg

SEQ ID NO: 8494 - DNA, 21 bp, Artificial Sequence
  Synthetic
cgtgctgagggtgggaggaat

SEQ ID NO: 8495 - DNA, 21 bp, Artificial Sequence
  Synthetic
ggggagttttatcagcctcgg

SEQ ID NO: 8496 - DNA, 21 bp, Artificial Sequence
  Synthetic
cagaagcattttactctgcag

SEQ ID NO: 8497 - DNA, 21 bp, Artificial Sequence
  Synthetic
ggtgtgtgggggcgttcggtt

SEQ ID NO: 8498 - DNA, 21 bp, Artificial Sequence
  Synthetic
gttaaggcgaatgtttttggt

SEQ ID NO: 8499 - DNA, 21 bp, Artificial Sequence
  Synthetic
catgtttgggatccgcctacg

SEQ ID NO: 8500 - DNA, 21 bp, Artificial Sequence
  Synthetic
gttgggcatgttccttttact

SEQ ID NO: 8501 - DNA, 21 bp, Artificial Sequence
  Synthetic
catgttatgggggcggggcgt

SEQ ID NO: 8502 - DNA, 21 bp, Artificial Sequence
  Synthetic
actactagtttttgtcctgat

SEQ ID NO: 8503 - DNA, 21 bp, Artificial Sequence
  Synthetic
caggttaggtttgcgagtgtt

SEQ ID NO: 8504 - DNA, 21 bp, Artificial Sequence
  Synthetic
cagacttcgttgtgtgcggtg

SEQ ID NO: 8505 - DNA, 21 bp, Artificial Sequence
  Synthetic
cttgagtttgcgtcgcctaag

SEQ ID NO: 8506 - DNA, 21 bp, Artificial Sequence
  Synthetic
cttgggatgggttttgttccg

SEQ ID NO: 8507 - DNA, 21 bp, Artificial Sequence
  Synthetic
cttaagcataggcctgagggt

SEQ ID NO: 8508 - DNA, 21 bp, Artificial Sequence
  Synthetic
gtgttgagtcatttgtttgcg

SEQ ID NO: 8509 - DNA, 21 bp, Artificial Sequence
  Synthetic
tctcgtgcttttaaggatgtt

SEQ ID NO: 8510 - DNA, 21 bp, Artificial Sequence
  Synthetic
actgctaatctgccttttatt

SEQ ID NO: 8511 - DNA, 21 bp, Artificial Sequence
  Synthetic
acgatttggcttgatcatggt

SEQ ID NO: 8512 - DNA, 21 bp, Artificial Sequence
  Synthetic
tggggggcggctgcgcggttg

SEQ ID NO: 8513 - DNA, 21 bp, Artificial Sequence
  Synthetic
tggtctagtaagccgcagctg

SEQ ID NO: 8514 - DNA, 21 bp, Artificial Sequence
  Synthetic
aatggtcggcgggaggggcat

SEQ ID NO: 8515 - DNA, 21 bp, Artificial Sequence
  Synthetic
gggtctggtccttgggttgcg

SEQ ID NO: 8516 - DNA, 21 bp, Artificial Sequence
  Synthetic
agtaagaatttttcggtgatt

SEQ ID NO: 8517 - DNA, 21 bp, Artificial Sequence
  Synthetic
gatatgcggcttgttaattct

SEQ ID NO: 8518 - DNA, 21 bp, Artificial Sequence
  Synthetic
cgtcttcaggtggggcatgct

SEQ ID NO: 8519 - DNA, 21 bp, Artificial Sequence
  Synthetic
agtgtggcgaggccgtttatg

SEQ ID NO: 8520 - DNA, 21 bp, Artificial Sequence
  Synthetic
tctatttcgatgccgtttagt

SEQ ID NO: 8521 - DNA, 21 bp, Artificial Sequence
  Synthetic
tctattgcgtctccgtttatt

SEQ ID NO: 8522 - DNA, 21 bp, Artificial Sequence
  Synthetic
ggtggtgggagggcggggaat

SEQ ID NO: 8523 - DNA, 21 bp, Artificial Sequence
  Synthetic
attacggtgactacgagtaag

SEQ ID NO: 8524 - DNA, 21 bp, Artificial Sequence
  Synthetic
tatcgggataggttgtttgcg

SEQ ID NO: 8525 - DNA, 21 bp, Artificial Sequence
  Synthetic
acgaagatgctggctactgct

SEQ ID NO: 8526 - DNA, 21 bp, Artificial Sequence
  Synthetic
gttgataggcagtattttcat

SEQ ID NO: 8527 - DNA, 21 bp, Artificial Sequence
  Synthetic
tcggcgatttttcgtgatgtg

SEQ ID NO: 8528 - DNA, 21 bp, Artificial Sequence
  Synthetic
aagctggcgcatggtcttgtg

SEQ ID NO: 8529 - DNA, 21 bp, Artificial Sequence
  Synthetic
agggagtttcgggctaattgt

SEQ ID NO: 8530 - DNA, 21 bp, Artificial Sequence
  Synthetic
tgggatcagttgggtccgaag

SEQ ID NO: 8531 - DNA, 21 bp, Artificial Sequence
  Synthetic
actagttctggttgggtggcg

SEQ ID NO: 8532 - DNA, 21 bp, Artificial Sequence
  Synthetic
attcggcatccttctcatatg

SEQ ID NO: 8533 - DNA, 21 bp, Artificial Sequence
  Synthetic
ggggtttgggttcctccgaat

SEQ ID NO: 8534 - DNA, 21 bp, Artificial Sequence
  Synthetic
tttacgttgggtagtgctcgt

SEQ ID NO: 8535 - DNA, 21 bp, Artificial Sequence
  Synthetic
actgcgtcttggccttttagt

SEQ ID NO: 8536 - DNA, 21 bp, Artificial Sequence
  Synthetic
agtgcgatgcgtccttttgtg

SEQ ID NO: 8537 - DNA, 21 bp, Artificial Sequence
  Synthetic
atttttgtgatgggttcggtt

SEQ ID NO: 8538 - DNA, 21 bp, Artificial Sequence
  Synthetic
ttgcgtaagaattggttggat

SEQ ID NO: 8539 - DNA, 21 bp, Artificial Sequence
  Synthetic
catattggtcatctttttgtg

SEQ ID NO: 8540 - DNA, 21 bp, Artificial Sequence
  Synthetic
tatagtaatcatctgtttcgg

SEQ ID NO: 8541 - DNA, 21 bp, Artificial Sequence
  Synthetic
ggttatatggggtgggttgct

SEQ ID NO: 8542 - DNA, 21 bp, Artificial Sequence
  Synthetic
cttctgcctgattattggctt

SEQ ID NO: 8543 - DNA, 21 bp, Artificial Sequence
  Synthetic
agtgtgtatgttccgtttgtt

SEQ ID NO: 8544 - DNA, 21 bp, Artificial Sequence
  Synthetic
gtgccttcttctgtttcgtgg

SEQ ID NO: 8545 - DNA, 21 bp, Artificial Sequence
  Synthetic
gaggtgtcgttggggcatagg

SEQ ID NO: 8546 - DNA, 21 bp, Artificial Sequence
  Synthetic
agttcttctaagccttttgtt

SEQ ID NO: 8547 - DNA, 21 bp, Artificial Sequence
  Synthetic
ggtcatgtgggttggactccg

SEQ ID NO: 8548 - DNA, 21 bp, Artificial Sequence
  Synthetic
atgaggtcggagaataggagt

SEQ ID NO: 8549 - DNA, 21 bp, Artificial Sequence
  Synthetic
cgggctgagtgggcggcgttt

SEQ ID NO: 8550 - DNA, 21 bp, Artificial Sequence
  Synthetic
gtgcagactaagccgtttttg

SEQ ID NO: 8551 - DNA, 21 bp, Artificial Sequence
  Synthetic
cttgcttttgttccgcctcat

SEQ ID NO: 8552 - DNA, 21 bp, Artificial Sequence
  Synthetic
cgtgggaatttgttggataag

SEQ ID NO: 8553 - DNA, 21 bp, Artificial Sequence
  Synthetic
tgggggtcgtatgagagttat

SEQ ID NO: 8554 - DNA, 21 bp, Artificial Sequence
  Synthetic
aggaatcttacgagggatggt

SEQ ID NO: 8555 - DNA, 21 bp, Artificial Sequence
  Synthetic
ccgctggagtttcggcatgtt

SEQ ID NO: 8556 - DNA, 21 bp, Artificial Sequence
  Synthetic
ccgcagagtaattcgagttgg

SEQ ID NO: 8557 - DNA, 21 bp, Artificial Sequence
  Synthetic
ccttcttcgtctagtacttgg

SEQ ID NO: 8558 - DNA, 21 bp, Artificial Sequence
  Synthetic
tcggttttgcggccgtttatg

SEQ ID NO: 8559 - DNA, 21 bp, Artificial Sequence
  Synthetic
gttcgtgcggctagtgagagg

SEQ ID NO: 8560 - DNA, 21 bp, Artificial Sequence
  Synthetic
gaggtttgggggaagggtcat

SEQ ID NO: 8561 - DNA, 21 bp, Artificial Sequence
  Synthetic
aatagggatctgtcgaatagg

SEQ ID NO: 8562 - DNA, 21 bp, Artificial Sequence
  Synthetic
tcgatgtcgaagccgtttacg

SEQ ID NO: 8563 - DNA, 21 bp, Artificial Sequence
  Synthetic
cagcttcggtttgaggtgatg

SEQ ID NO: 8564 - DNA, 21 bp, Artificial Sequence
  Synthetic
attgctactttttgtcctgtg

SEQ ID NO: 8565 - DNA, 21 bp, Artificial Sequence
  Synthetic
aagaagagttttgaggttatt

SEQ ID NO: 8566 - DNA, 21 bp, Artificial Sequence
  Synthetic
gatttgacgcggccgtttttg

SEQ ID NO: 8567 - DNA, 21 bp, Artificial Sequence
  Synthetic
cggggtcatccgcttactcag

SEQ ID NO: 8568 - DNA, 21 bp, Artificial Sequence
  Synthetic
gggccgtggtttcatactgag

SEQ ID NO: 8569 - DNA, 21 bp, Artificial Sequence
  Synthetic
tggcagaagctgggggaggtt

SEQ ID NO: 8570 - DNA, 21 bp, Artificial Sequence
  Synthetic
tcgtctcatggttggattgct

SEQ ID NO: 8571 - DNA, 21 bp, Artificial Sequence
  Synthetic
gggcctcagacgtatagtgcg

SEQ ID NO: 8572 - DNA, 21 bp, Artificial Sequence
  Synthetic
gtggggacgattccgtttcag

SEQ ID NO: 8573 - DNA, 21 bp, Artificial Sequence
  Synthetic
acgagggattttgggttgttt

SEQ ID NO: 8574 - DNA, 21 bp, Artificial Sequence
  Synthetic
atgcggcatgttgtggtgccg

SEQ ID NO: 8575 - DNA, 21 bp, Artificial Sequence
  Synthetic
tgtgtgtggaatcagaattgt

SEQ ID NO: 8576 - DNA, 21 bp, Artificial Sequence
  Synthetic
agtgagtcgatgccttttagg

SEQ ID NO: 8577 - DNA, 21 bp, Artificial Sequence
  Synthetic
caggtttctaggccttttatg

SEQ ID NO: 8578 - DNA, 21 bp, Artificial Sequence
  Synthetic
aatctttttggtgataggttg

SEQ ID NO: 8579 - DNA, 21 bp, Artificial Sequence
  Synthetic
gcgagtctgcctcgtgatcgg

SEQ ID NO: 8580 - DNA, 21 bp, Artificial Sequence
  Synthetic
attacgagtacgacttcgcgg

SEQ ID NO: 8581 - DNA, 21 bp, Artificial Sequence
  Synthetic
attgagtttaatagtccgcgg

SEQ ID NO: 8582 - DNA, 21 bp, Artificial Sequence
  Synthetic
attcttgtgaattctggtcag

SEQ ID NO: 8583 - DNA, 21 bp, Artificial Sequence
  Synthetic
aggaatccgggttggattgcg

SEQ ID NO: 8584 - DNA, 21 bp, Artificial Sequence
  Synthetic
tttaggaattgtgtgagtgat

SEQ ID NO: 8585 - DNA, 21 bp, Artificial Sequence
  Synthetic
gctaatacggggtgggctccg

SEQ ID NO: 8586 - DNA, 21 bp, Artificial Sequence
  Synthetic
ccgtcgcatcctaatcgtggt

SEQ ID NO: 8587 - DNA, 21 bp, Artificial Sequence
  Synthetic
ttgcttgtgtctacgcgtgtg

SEQ ID NO: 8588 - DNA, 21 bp, Artificial Sequence
  Synthetic
agtccgggttttagtgtggat

SEQ ID NO: 8589 - DNA, 21 bp, Artificial Sequence
  Synthetic
aagtatatggatggtggtact

SEQ ID NO: 8590 - DNA, 21 bp, Artificial Sequence
  Synthetic
gcgccttggtatcctactggt

SEQ ID NO: 8591 - DNA, 21 bp, Artificial Sequence
  Synthetic
gtgattgggaatattcttaat

SEQ ID NO: 8592 - DNA, 21 bp, Artificial Sequence
  Synthetic
tatgagtctaggccgtttact

SEQ ID NO: 8593 - DNA, 21 bp, Artificial Sequence
  Synthetic
cagagtgtgatggtggcggtt

SEQ ID NO: 8594 - DNA, 21 bp, Artificial Sequence
  Synthetic
cggcctccgttttttttggat

SEQ ID NO: 8595 - DNA, 21 bp, Artificial Sequence
  Synthetic
tctattcgttttgggtttcag

SEQ ID NO: 8596 - DNA, 21 bp, Artificial Sequence
  Synthetic
tctattatgcagccttttatg

SEQ ID NO: 8597 - DNA, 21 bp, Artificial Sequence
  Synthetic
cttcggagtgttgctcattgt

SEQ ID NO: 8598 - DNA, 21 bp, Artificial Sequence
  Synthetic
tctggtcctggttgggttgct

SEQ ID NO: 8599 - DNA, 21 bp, Artificial Sequence
  Synthetic
ggtactagggcggctctttat

SEQ ID NO: 8600 - DNA, 21 bp, Artificial Sequence
  Synthetic
atgagttttgcttctatgcat

SEQ ID NO: 8601 - DNA, 21 bp, Artificial Sequence
  Synthetic
tggttgaagtttgctgaggtt

SEQ ID NO: 8602 - DNA, 21 bp, Artificial Sequence
  Synthetic
agtgttaagtttaaggaggtt

SEQ ID NO: 8603 - DNA, 21 bp, Artificial Sequence
  Synthetic
gttatgcgttttgagcagatt

SEQ ID NO: 8604 - DNA, 21 bp, Artificial Sequence
  Synthetic
tggtttaagtttccggaggtt

SEQ ID NO: 8605 - DNA, 21 bp, Artificial Sequence
  Synthetic
gctcatgttggttgggttgct

SEQ ID NO: 8606 - DNA, 21 bp, Artificial Sequence
  Synthetic
acggatacggggtgggttgct

SEQ ID NO: 8607 - DNA, 21 bp, Artificial Sequence
  Synthetic
tctgaggctgttccgtttcgt

SEQ ID NO: 8608 - DNA, 21 bp, Artificial Sequence
  Synthetic
cagactaattttcgtaatgtg

SEQ ID NO: 8609 - DNA, 21 bp, Artificial Sequence
  Synthetic
tcgcattggtatcctcagggt

SEQ ID NO: 8610 - DNA, 21 bp, Artificial Sequence
  Synthetic
ttgacggggtctaggtatgtg

SEQ ID NO: 8611 - DNA, 21 bp, Artificial Sequence
  Synthetic
ttgccggagcgtccgtttagg

SEQ ID NO: 8612 - DNA, 21 bp, Artificial Sequence
  Synthetic
attggtactttgccttttatg

SEQ ID NO: 8613 - DNA, 21 bp, Artificial Sequence
  Synthetic
tttgatgctaattatccgaag

SEQ ID NO: 8614 - DNA, 21 bp, Artificial Sequence
  Synthetic
gtggatcaggtgtattttcgg

SEQ ID NO: 8615 - DNA, 21 bp, Artificial Sequence
  Synthetic
tctaggcttggggatctgcgg

SEQ ID NO: 8616 - DNA, 21 bp, Artificial Sequence
  Synthetic
cagcctatgaatctttctagg

SEQ ID NO: 8617 - DNA, 21 bp, Artificial Sequence
  Synthetic
aagggtagtgagggtctgagg

SEQ ID NO: 8618 - DNA, 21 bp, Artificial Sequence
  Synthetic
acgggtcaggcgccttggatt

SEQ ID NO: 8619 - DNA, 21 bp, Artificial Sequence
  Synthetic
ctgggttctattccgtttcag

SEQ ID NO: 8620 - DNA, 21 bp, Artificial Sequence
  Synthetic
ctggattggccgcggtcggtt

SEQ ID NO: 8621 - DNA, 21 bp, Artificial Sequence
  Synthetic
agtccgaagggtcgtgagagt

SEQ ID NO: 8622 - DNA, 21 bp, Artificial Sequence
  Synthetic
acgattactggttgggcggct

SEQ ID NO: 8623 - DNA, 21 bp, Artificial Sequence
  Synthetic
aaggcgcagtgggctaatgtg

SEQ ID NO: 8624 - DNA, 21 bp, Artificial Sequence
  Synthetic
tataggattcggcttctggat

SEQ ID NO: 8625 - DNA, 21 bp, Artificial Sequence
  Synthetic
tttactcttactacttctaag

SEQ ID NO: 8626 - DNA, 21 bp, Artificial Sequence
  Synthetic
cgtagtcatccggattctaag

SEQ ID NO: 8627 - DNA, 21 bp, Artificial Sequence
  Synthetic
catggtgtgcgtgttgcggat

SEQ ID NO: 8628 - DNA, 21 bp, Artificial Sequence
  Synthetic
gttaatcgtgttcttgagagg

SEQ ID NO: 8629 - DNA, 21 bp, Artificial Sequence
  Synthetic
tttggtgtggggctggcgatt

SEQ ID NO: 8630 - DNA, 21 bp, Artificial Sequence
  Synthetic
tcgcggttggggttttcgccg

SEQ ID NO: 8631 - DNA, 21 bp, Artificial Sequence
  Synthetic
actagggcgaagagtgagggg

SEQ ID NO: 8632 - DNA, 21 bp, Artificial Sequence
  Synthetic
gataagcatcggccgtttttg

SEQ ID NO: 8633 - DNA, 21 bp, Artificial Sequence
  Synthetic
aagcatagtgttttgccgcat

SEQ ID NO: 8634 - DNA, 21 bp, Artificial Sequence
  Synthetic
tggggggcggctcgtgatttg

SEQ ID NO: 8635 - DNA, 21 bp, Artificial Sequence
  Synthetic
tgtgggcgtgatatgaggggt

SEQ ID NO: 8636 - DNA, 21 bp, Artificial Sequence
  Synthetic
catgctactaatccgtttggt

SEQ ID NO: 8637 - DNA, 21 bp, Artificial Sequence
  Synthetic
gagccggtggcttctatggcg

SEQ ID NO: 8638 - DNA, 21 bp, Artificial Sequence
  Synthetic
ccgggtagtgagcgtgttagg

SEQ ID NO: 8639 - DNA, 21 bp, Artificial Sequence
  Synthetic
gataggtcgcatggtcattgg

SEQ ID NO: 8640 - DNA, 21 bp, Artificial Sequence
  Synthetic
ttggtggctctggctactcgt

SEQ ID NO: 8641 - DNA, 21 bp, Artificial Sequence
  Synthetic
gggattaagttgtttactcat

SEQ ID NO: 8642 - DNA, 21 bp, Artificial Sequence
  Synthetic
agtgggtttgttgggacgaag

SEQ ID NO: 8643 - DNA, 21 bp, Artificial Sequence
  Synthetic
agtcggattggtcatattaat

SEQ ID NO: 8644 - DNA, 21 bp, Artificial Sequence
  Synthetic
agtggtcctaagcagttgcat

SEQ ID NO: 8645 - DNA, 21 bp, Artificial Sequence
  Synthetic
aagaagtgggagaatcatgtt

SEQ ID NO: 8646 - DNA, 21 bp, Artificial Sequence
  Synthetic
aatacgatgacgatgtctagg

SEQ ID NO: 8647 - DNA, 21 bp, Artificial Sequence
  Synthetic
tcttttattaatgtgtttgct

SEQ ID NO: 8648 - DNA, 21 bp, Artificial Sequence
  Synthetic
tcggagatgcgtcatcatact

SEQ ID NO: 8649 - DNA, 21 bp, Artificial Sequence
  Synthetic
ttggggatggctcttgggatg

SEQ ID NO: 8650 - DNA, 21 bp, Artificial Sequence
  Synthetic
cttggggagagggctttgcgt

SEQ ID NO: 8651 - DNA, 21 bp, Artificial Sequence
  Synthetic
aagtcgggggctgaggctcgt

SEQ ID NO: 8652 - DNA, 21 bp, Artificial Sequence
  Synthetic
acgccgtggcatgtggatggt

SEQ ID NO: 8653 - DNA, 21 bp, Artificial Sequence
  Synthetic
gggcgttttgtgcctcctcag

SEQ ID NO: 8654 - DNA, 21 bp, Artificial Sequence
  Synthetic
actaatctggcgtttaatcgg

SEQ ID NO: 8655 - DNA, 21 bp, Artificial Sequence
  Synthetic
atgggtcatcattcgtcttgg

SEQ ID NO: 8656 - DNA, 21 bp, Artificial Sequence
  Synthetic
tggtttactgtggggagggat

SEQ ID NO: 8657 - DNA, 21 bp, Artificial Sequence
  Synthetic
gcgctgggttggccgggttcg

SEQ ID NO: 8658 - DNA, 21 bp, Artificial Sequence
  Synthetic
actcatcggtttcatgagatt

SEQ ID NO: 8659 - DNA, 21 bp, Artificial Sequence
  Synthetic
cttcaggggttttgtactccg

SEQ ID NO: 8660 - DNA, 21 bp, Artificial Sequence
  Synthetic
aagtcggagtgggctcatttt

SEQ ID NO: 8661 - DNA, 21 bp, Artificial Sequence
  Synthetic
tataatgctgttccttttcgg

SEQ ID NO: 8662 - DNA, 21 bp, Artificial Sequence
  Synthetic
aagacgtgggagccgccgtct

SEQ ID NO: 8663 - DNA, 21 bp, Artificial Sequence
  Synthetic
tcgttgcctcaggggtgggtg

SEQ ID NO: 8664 - DNA, 21 bp, Artificial Sequence
  Synthetic
catctgcagacggctgggcgt

SEQ ID NO: 8665 - DNA, 21 bp, Artificial Sequence
  Synthetic
gtttggaataataagcttgtt

SEQ ID NO: 8666 - DNA, 21 bp, Artificial Sequence
  Synthetic
tctactcggttttcggctatt

SEQ ID NO: 8667 - DNA, 21 bp, Artificial Sequence
  Synthetic
tggggtgctgcgtcggatttg

SEQ ID NO: 8668 - DNA, 21 bp, Artificial Sequence
  Synthetic
ggtgggaatattagtttttgt

SEQ ID NO: 8669 - DNA, 21 bp, Artificial Sequence
  Synthetic
tttgggggggataaggggcgt

SEQ ID NO: 8670 - DNA, 21 bp, Artificial Sequence
  Synthetic
gttagggattttgggagttat

SEQ ID NO: 8671 - DNA, 21 bp, Artificial Sequence
  Synthetic
ggggttttttcgcgtccgatg

SEQ ID NO: 8672 - DNA, 21 bp, Artificial Sequence
  Synthetic
aaggggaatgggcatgagagg

SEQ ID NO: 8673 - DNA, 21 bp, Artificial Sequence
  Synthetic
cgtgttcagaagtctgattgg

SEQ ID NO: 8674 - DNA, 21 bp, Artificial Sequence
  Synthetic
aaggttaagggtgaggggcag

SEQ ID NO: 8675 - DNA, 21 bp, Artificial Sequence
  Synthetic
gtgcggggtattcctgttacg

SEQ ID NO: 8676 - DNA, 21 bp, Artificial Sequence
  Synthetic
acgttgcgtgggtatgtgacg

SEQ ID NO: 8677 - DNA, 21 bp, Artificial Sequence
  Synthetic
tgtgctgctcgtgggactcat

SEQ ID NO: 8678 - DNA, 21 bp, Artificial Sequence
  Synthetic
gctaggaatcatcagggtcag

SEQ ID NO: 8679 - DNA, 21 bp, Artificial Sequence
  Synthetic
caggttcgtacggcggatgct

SEQ ID NO: 8680 - DNA, 21 bp, Artificial Sequence
  Synthetic
attaggagtgagcttgtgagg

SEQ ID NO: 8681 - DNA, 21 bp, Artificial Sequence
  Synthetic
catctggagtttgctagggtt

SEQ ID NO: 8682 - DNA, 21 bp, Artificial Sequence
  Synthetic
catcagactgggtgggctcct

SEQ ID NO: 8683 - DNA, 21 bp, Artificial Sequence
  Synthetic
tatttgacgaggccttttgcg

SEQ ID NO: 8684 - DNA, 21 bp, Artificial Sequence
  Synthetic
ctggatgttcatgttagggtg

SEQ ID NO: 8685 - DNA, 21 bp, Artificial Sequence
  Synthetic
gggtttgggacggggcgtgct

SEQ ID NO: 8686 - DNA, 21 bp, Artificial Sequence
  Synthetic
ctggtgcagaatctttctagg

SEQ ID NO: 8687 - DNA, 21 bp, Artificial Sequence
  Synthetic
acggttcatggtctggggacg

SEQ ID NO: 8688 - DNA, 21 bp, Artificial Sequence
  Synthetic
tcgagttcggggatttcggtt

SEQ ID NO: 8689 - DNA, 21 bp, Artificial Sequence
  Synthetic
acgcatactggggggaatagg

SEQ ID NO: 8690 - DNA, 21 bp, Artificial Sequence
  Synthetic
gggaagcttcctccgtctcag

SEQ ID NO: 8691 - DNA, 21 bp, Artificial Sequence
  Synthetic
aatcggggtccttctcaggtt

SEQ ID NO: 8692 - DNA, 21 bp, Artificial Sequence
  Synthetic
ggttcgtctggtaatttgcgg

SEQ ID NO: 8693 - DNA, 21 bp, Artificial Sequence
  Synthetic
aatccttggggtattgagcgt

SEQ ID NO: 8694 - DNA, 21 bp, Artificial Sequence
  Synthetic
gtgtcttttcgtactcttcat

SEQ ID NO: 8695 - DNA, 21 bp, Artificial Sequence
  Synthetic
aatcattggtatccgcagggt

SEQ ID NO: 8696 - DNA, 21 bp, Artificial Sequence
  Synthetic
ttgggtgttaggattggtatg

SEQ ID NO: 8697 - DNA, 21 bp, Artificial Sequence
  Synthetic
tatggttctatgttgtggcat

SEQ ID NO: 8698 - DNA, 21 bp, Artificial Sequence
  Synthetic
cctactgtgtttggtgatatg

SEQ ID NO: 8699 - DNA, 21 bp, Artificial Sequence
  Synthetic
ccgcttgctaatcctaataag

SEQ ID NO: 8700 - DNA, 21 bp, Artificial Sequence
  Synthetic
tttgggagtgaggcttggagt

SEQ ID NO: 8701 - DNA, 21 bp, Artificial Sequence
  Synthetic
acgccggcggttccttttcgt

SEQ ID NO: 8702 - DNA, 21 bp, Artificial Sequence
  Synthetic
acgaatagtcagtttcttagg

SEQ ID NO: 8703 - DNA, 21 bp, Artificial Sequence
  Synthetic
aggattggtctggatgttcgg

SEQ ID NO: 8704 - DNA, 21 bp, Artificial Sequence
  Synthetic
aggaatgataataatggtaag

SEQ ID NO: 8705 - DNA, 21 bp, Artificial Sequence
  Synthetic
ggtgtgtcggagaggaggcat

SEQ ID NO: 8706 - DNA, 21 bp, Artificial Sequence
  Synthetic
tgggggcctggttgggcgtcg

SEQ ID NO: 8707 - DNA, 21 bp, Artificial Sequence
  Synthetic
gctgggcgtggtatgactgcg

SEQ ID NO: 8708 - DNA, 21 bp, Artificial Sequence
  Synthetic
cgtggtgatggtccgcggcag

SEQ ID NO: 8709 - DNA, 21 bp, Artificial Sequence
  Synthetic
tttcggagtgggactggtaat

SEQ ID NO: 8710 - DNA, 21 bp, Artificial Sequence
  Synthetic
ttgtctaggatgatgccggtg

SEQ ID NO: 8711 - DNA, 21 bp, Artificial Sequence
  Synthetic
tctcttcattctcagaatcgg

SEQ ID NO: 8712 - DNA, 21 bp, Artificial Sequence
  Synthetic
ggtgcgtctaggccgtttcag

SEQ ID NO: 8713 - DNA, 21 bp, Artificial Sequence
  Synthetic
gtgcttggtcttgcggagttg

SEQ ID NO: 8714 - DNA, 21 bp, Artificial Sequence
  Synthetic
acgcgttctcggatggagggt

SEQ ID NO: 8715 - DNA, 21 bp, Artificial Sequence
  Synthetic
atgtgggagggtggtcatagg

SEQ ID NO: 8716 - DNA, 21 bp, Artificial Sequence
  Synthetic
tcggattcggggtgggtggcg

SEQ ID NO: 8717 - DNA, 21 bp, Artificial Sequence
  Synthetic
cggcttaatccgcatcatgct

SEQ ID NO: 8718 - DNA, 21 bp, Artificial Sequence
  Synthetic
ggtagttgggtgctgacggct

SEQ ID NO: 8719 - DNA, 21 bp, Artificial Sequence
  Synthetic
aatgtttggtcgactcagggg

SEQ ID NO: 8720 - DNA, 21 bp, Artificial Sequence
  Synthetic
gtgcgggattttggtcttttt

SEQ ID NO: 8721 - DNA, 21 bp, Artificial Sequence
  Synthetic
ggggggcttagggataatagg

SEQ ID NO: 8722 - DNA, 21 bp, Artificial Sequence
  Synthetic
tctcgttcggggttggatagg

SEQ ID NO: 8723 - DNA, 21 bp, Artificial Sequence
  Synthetic
tgggttacgaagcatactggt

SEQ ID NO: 8724 - DNA, 21 bp, Artificial Sequence
  Synthetic
ctgggtcatatgtctggtaag

SEQ ID NO: 8725 - DNA, 21 bp, Artificial Sequence
  Synthetic
agtcggcagattcatcctccg

SEQ ID NO: 8726 - DNA, 21 bp, Artificial Sequence
  Synthetic
tttggggaggctaggcagatg

SEQ ID NO: 8727 - DNA, 21 bp, Artificial Sequence
  Synthetic
gagggtcagatttgggcgcgt

SEQ ID NO: 8728 - DNA, 21 bp, Artificial Sequence
  Synthetic
cttgatcggagtggtgataag

SEQ ID NO: 8729 - DNA, 21 bp, Artificial Sequence
  Synthetic
gatgtgaataagccgtggtat

SEQ ID NO: 8730 - DNA, 21 bp, Artificial Sequence
  Synthetic
ttgcatgggtattttgggcct

SEQ ID NO: 8731 - DNA, 21 bp, Artificial Sequence
  Synthetic
gatctgtattgggggaaggag

SEQ ID NO: 8732 - DNA, 21 bp, Artificial Sequence
  Synthetic
tggcgtggtgaggggaagttg

SEQ ID NO: 8733 - DNA, 21 bp, Artificial Sequence
  Synthetic
catagggcgagtgggggggct

SEQ ID NO: 8734 - DNA, 21 bp, Artificial Sequence
  Synthetic
tggggtgctgcttcgtctttt

SEQ ID NO: 8735 - DNA, 21 bp, Artificial Sequence
  Synthetic
ttgaagcatgcttcggctaat

SEQ ID NO: 8736 - DNA, 21 bp, Artificial Sequence
  Synthetic
cgtgctgagagtagtatgagg

SEQ ID NO: 8737 - DNA, 21 bp, Artificial Sequence
  Synthetic
acgacgttgtcgcctcctcgt

SEQ ID NO: 8738 - DNA, 21 bp, Artificial Sequence
  Synthetic
ccggttattgctactaagctt

SEQ ID NO: 8739 - DNA, 21 bp, Artificial Sequence
  Synthetic
gagtggcgtaagggggagtgg

SEQ ID NO: 8740 - DNA, 21 bp, Artificial Sequence
  Synthetic
tctcattttggggcttcgcat

SEQ ID NO: 8741 - DNA, 21 bp, Artificial Sequence
  Synthetic
tcggctcatagtccttttcgg

SEQ ID NO: 8742 - DNA, 21 bp, Artificial Sequence
  Synthetic
gggtctcttgggtggatggct

SEQ ID NO: 8743 - DNA, 21 bp, Artificial Sequence
  Synthetic
cctatgattgcgaatttgatt

SEQ ID NO: 8744 - DNA, 21 bp, Artificial Sequence
  Synthetic
actacgtcttttgcgaatgtt

SEQ ID NO: 8745 - DNA, 21 bp, Artificial Sequence
  Synthetic
atgagtcatagtaatcgtaat

SEQ ID NO: 8746 - DNA, 21 bp, Artificial Sequence
  Synthetic
gtgactgcgacggattttatg

SEQ ID NO: 8747 - DNA, 21 bp, Artificial Sequence
  Synthetic
tctaagagtgataagtcgtgg

SEQ ID NO: 8748 - DNA, 21 bp, Artificial Sequence
  Synthetic
aagggttcggagtggacgaag

SEQ ID NO: 8749 - DNA, 21 bp, Artificial Sequence
  Synthetic
catgttcgtatggctgattgt

SEQ ID NO: 8750 - DNA, 21 bp, Artificial Sequence
  Synthetic
aaggggggtgcttggggtcag

SEQ ID NO: 8751 - DNA, 21 bp, Artificial Sequence
  Synthetic
acttatgcgacggtgtctcag

SEQ ID NO: 8752 - DNA, 21 bp, Artificial Sequence
  Synthetic
aagtgtcgtgatatggtggcg

SEQ ID NO: 8753 - DNA, 21 bp, Artificial Sequence
  Synthetic
gattggtttcatgctgatggg

SEQ ID NO: 8754 - DNA, 21 bp, Artificial Sequence
  Synthetic
catggtcttggtactaggcct

SEQ ID NO: 8755 - DNA, 21 bp, Artificial Sequence
  Synthetic
tgttttcagtcgaataggtct

SEQ ID NO: 8756 - DNA, 21 bp, Artificial Sequence
  Synthetic
agggctggggctcatgtgact

SEQ ID NO: 8757 - DNA, 21 bp, Artificial Sequence
  Synthetic
catgcggctacgaatactcgt

SEQ ID NO: 8758 - DNA, 21 bp, Artificial Sequence
  Synthetic
gatgggaggcatgcggatagg

SEQ ID NO: 8759 - DNA, 21 bp, Artificial Sequence
  Synthetic
agttctaaggtgacgcagatg

SEQ ID NO: 8760 - DNA, 21 bp, Artificial Sequence
  Synthetic
gatatggagcgtccttttcat

SEQ ID NO: 8761 - DNA, 21 bp, Artificial Sequence
  Synthetic
tgtccgtctatgagtcggggt

SEQ ID NO: 8762 - DNA, 21 bp, Artificial Sequence
  Synthetic
tcgggtggggctcgggggttt

SEQ ID NO: 8763 - DNA, 21 bp, Artificial Sequence
  Synthetic
caggggggtcctgctttgcgt

SEQ ID NO: 8764 - DNA, 21 bp, Artificial Sequence
  Synthetic
atgcggcttcgggagggtccg

SEQ ID NO: 8765 - DNA, 21 bp, Artificial Sequence
  Synthetic
attaatgctagggttctgctg

SEQ ID NO: 8766 - DNA, 21 bp, Artificial Sequence
  Synthetic
cgtgggacttcttatgcgatg

SEQ ID NO: 8767 - DNA, 21 bp, Artificial Sequence
  Synthetic
aagccgcatagtattaattct

SEQ ID NO: 8768 - DNA, 21 bp, Artificial Sequence
  Synthetic
gattttaaggagattaggcgg

SEQ ID NO: 8769 - DNA, 21 bp, Artificial Sequence
  Synthetic
gggtttgatcggctgtttgtg

SEQ ID NO: 8770 - DNA, 21 bp, Artificial Sequence
  Synthetic
tgtattgatggtgttgggtgt

SEQ ID NO: 8771 - DNA, 21 bp, Artificial Sequence
  Synthetic
tatgagacgcgggcgtttttg

SEQ ID NO: 8772 - DNA, 21 bp, Artificial Sequence
  Synthetic
agggctggtgctgtggcgtgg

SEQ ID NO: 8773 - DNA, 21 bp, Artificial Sequence
  Synthetic
gttggtgatctgccgtttcgg

SEQ ID NO: 8774 - DNA, 21 bp, Artificial Sequence
  Synthetic
aggatgcatcttctgagtgct

SEQ ID NO: 8775 - DNA, 21 bp, Artificial Sequence
  Synthetic
aggcttgaggttcgtgcgctt

SEQ ID NO: 8776 - DNA, 21 bp, Artificial Sequence
  Synthetic
ggtagggcgagtgctggggtg

SEQ ID NO: 8777 - DNA, 21 bp, Artificial Sequence
  Synthetic
acgacgcttgctgtgagtcgg

SEQ ID NO: 8778 - DNA, 21 bp, Artificial Sequence
  Synthetic
gcgcatgatccgattcgtaag

SEQ ID NO: 8779 - DNA, 21 bp, Artificial Sequence
  Synthetic
atggctcgtgttgttgagcgg

SEQ ID NO: 8780 - DNA, 21 bp, Artificial Sequence
  Synthetic
gcgcttcattttgctaatatt

SEQ ID NO: 8781 - DNA, 21 bp, Artificial Sequence
  Synthetic
aggtcggataatggtctgagg

SEQ ID NO: 8782 - DNA, 21 bp, Artificial Sequence
  Synthetic
gtgctgaggtctgagaatctg

SEQ ID NO: 8783 - DNA, 21 bp, Artificial Sequence
  Synthetic
actgcgggtattgttgtggat

SEQ ID NO: 8784 - DNA, 21 bp, Artificial Sequence
  Synthetic
aggggggcgaatgagaggttg

SEQ ID NO: 8785 - DNA, 21 bp, Artificial Sequence
  Synthetic
cgtagtaatgttcttgatagg

SEQ ID NO: 8786 - DNA, 21 bp, Artificial Sequence
  Synthetic
ggtgcgcgggaggcggcgcgt

SEQ ID NO: 8787 - DNA, 21 bp, Artificial Sequence
  Synthetic
aatgatcgtcctgttgcgcgg

SEQ ID NO: 8788 - DNA, 21 bp, Artificial Sequence
  Synthetic
atgagtgctcattttcaggtt

SEQ ID NO: 8789 - DNA, 21 bp, Artificial Sequence
  Synthetic
cttacgtttgagcgtggtacg

SEQ ID NO: 8790 - DNA, 21 bp, Artificial Sequence
  Synthetic
gattggcgtggggttcatttt

SEQ ID NO: 8791 - DNA, 21 bp, Artificial Sequence
  Synthetic
gagaggaagattccggcgatg

SEQ ID NO: 8792 - DNA, 21 bp, Artificial Sequence
  Synthetic
gggaggggtatttcggttgcg

SEQ ID NO: 8793 - DNA, 21 bp, Artificial Sequence
  Synthetic
tgggtgcgggagcctgttcgg

SEQ ID NO: 8794 - DNA, 21 bp, Artificial Sequence
  Synthetic
gttaagcatattcgtatggag

SEQ ID NO: 8795 - DNA, 21 bp, Artificial Sequence
  Synthetic
cggccttttgggtttgctgct

SEQ ID NO: 8796 - DNA, 21 bp, Artificial Sequence
  Synthetic
tctaaggtttttatggaggtg

SEQ ID NO: 8797 - DNA, 21 bp, Artificial Sequence
  Synthetic
atgccgcctttttggtcgaat

SEQ ID NO: 8798 - DNA, 21 bp, Artificial Sequence
  Synthetic
tggggtgggaggggggcgggt

SEQ ID NO: 8799 - DNA, 21 bp, Artificial Sequence
  Synthetic
aagttgcctatgagggttggg

SEQ ID NO: 8800 - DNA, 21 bp, Artificial Sequence
  Synthetic
agtgcgtggggtactcagtcg

SEQ ID NO: 8801 - DNA, 21 bp, Artificial Sequence
  Synthetic
ttgaatttttctacgtctttg

SEQ ID NO: 8802 - DNA, 21 bp, Artificial Sequence
  Synthetic
cggattccggatacgaatagg

SEQ ID NO: 8803 - DNA, 21 bp, Artificial Sequence
  Synthetic
attacgcctcttgagaggtgg

SEQ ID NO: 8804 - DNA, 21 bp, Artificial Sequence
  Synthetic
cgtgctgataaggtgtggaat

SEQ ID NO: 8805 - DNA, 21 bp, Artificial Sequence
  Synthetic
aggccggatcatactgtgcgg

SEQ ID NO: 8806 - DNA, 21 bp, Artificial Sequence
  Synthetic
atggggatgagggagaatcgt

SEQ ID NO: 8807 - DNA, 21 bp, Artificial Sequence
  Synthetic
cgtttgggggtggatgctaag

SEQ ID NO: 8808 - DNA, 21 bp, Artificial Sequence
  Synthetic
aggtggtctgcggtgggtgat

SEQ ID NO: 8809 - DNA, 21 bp, Artificial Sequence
  Synthetic
aagactaatgctgggcatcat

SEQ ID NO: 8810 - DNA, 21 bp, Artificial Sequence
  Synthetic
aaggggtcgttggaggctcgt

SEQ ID NO: 8811 - DNA, 21 bp, Artificial Sequence
  Synthetic
cgttataatgggggttctgct

SEQ ID NO: 8812 - DNA, 21 bp, Artificial Sequence
  Synthetic
cagaggggtgataagttgttt

SEQ ID NO: 8813 - DNA, 21 bp, Artificial Sequence
  Synthetic
aatggtagggttgagagtagg

SEQ ID NO: 8814 - DNA, 21 bp, Artificial Sequence
  Synthetic
tgtaagggtttgggggaggtg

SEQ ID NO: 8815 - DNA, 21 bp, Artificial Sequence
  Synthetic
gatccgtggcatgcggggggt

SEQ ID NO: 8816 - DNA, 21 bp, Artificial Sequence
  Synthetic
ttggataatcttccttttcgt

SEQ ID NO: 8817 - DNA, 21 bp, Artificial Sequence
  Synthetic
tcgtttcctggttggagtgcg

SEQ ID NO: 8818 - DNA, 21 bp, Artificial Sequence
  Synthetic
agggagcgggtggatcttcgt

SEQ ID NO: 8819 - DNA, 21 bp, Artificial Sequence
  Synthetic
atgccgaggcagagtagtggg

SEQ ID NO: 8820 - DNA, 21 bp, Artificial Sequence
  Synthetic
gatgtgttgaggccgtttcat

SEQ ID NO: 8821 - DNA, 21 bp, Artificial Sequence
  Synthetic
ggggcgatttttgggatgtgg

SEQ ID NO: 8822 - DNA, 21 bp, Artificial Sequence
  Synthetic
agtccttggggtttggctgcg

SEQ ID NO: 8823 - DNA, 21 bp, Artificial Sequence
  Synthetic
tttacgaatagtgagggtcgt

SEQ ID NO: 8824 - DNA, 21 bp, Artificial Sequence
  Synthetic
ggtgctcgtcctgctgatcgt

SEQ ID NO: 8825 - DNA, 21 bp, Artificial Sequence
  Synthetic
attgtggcggttacgagggcg

SEQ ID NO: 8826 - DNA, 21 bp, Artificial Sequence
  Synthetic
tataagcgtcttgtgggggat

SEQ ID NO: 8827 - DNA, 21 bp, Artificial Sequence
  Synthetic
catcgtgttaatgctgggaat

SEQ ID NO: 8828 - DNA, 21 bp, Artificial Sequence
  Synthetic
tcgattagtgggtgggcgccg

SEQ ID NO: 8829 - DNA, 21 bp, Artificial Sequence
  Synthetic
catccggcgcgggagggtagg

SEQ ID NO: 8830 - DNA, 21 bp, Artificial Sequence
  Synthetic
ggggcttttggttttagtccg

SEQ ID NO: 8831 - DNA, 21 bp, Artificial Sequence
  Synthetic
gctaagagtcatgggcgggag

SEQ ID NO: 8832 - DNA, 21 bp, Artificial Sequence
  Synthetic
tttactactttttgtaaggag

SEQ ID NO: 8833 - DNA, 21 bp, Artificial Sequence
  Synthetic
ggtgagtggggttttactcct

SEQ ID NO: 8834 - DNA, 21 bp, Artificial Sequence
  Synthetic
ttgcatagtaagcctgagcgg

SEQ ID NO: 8835 - DNA, 21 bp, Artificial Sequence
  Synthetic
tgttggccttctagtacggct

SEQ ID NO: 8836 - DNA, 21 bp, Artificial Sequence
  Synthetic
gtgaggggtacggtgagtgcg

SEQ ID NO: 8837 - DNA, 21 bp, Artificial Sequence
  Synthetic
tcgaatcgtgggccggggcat

SEQ ID NO: 8838 - DNA, 21 bp, Artificial Sequence
  Synthetic
actagtaagtttgctaatgtt

SEQ ID NO: 8839 - DNA, 21 bp, Artificial Sequence
  Synthetic
tatggtgatgtgattcatcgt

SEQ ID NO: 8840 - DNA, 21 bp, Artificial Sequence
  Synthetic
ggttcgccggctcttggtact

SEQ ID NO: 8841 - DNA, 21 bp, Artificial Sequence
  Synthetic
tgttatgcgacggatgttctg

SEQ ID NO: 8842 - DNA, 21 bp, Artificial Sequence
  Synthetic
ggtgttgatcgtatttttaag

SEQ ID NO: 8843 - DNA, 21 bp, Artificial Sequence
  Synthetic
ggtcggctgggtgtggggtct

SEQ ID NO: 8844 - DNA, 21 bp, Artificial Sequence
  Synthetic
cggaagacggaggggagtcat

SEQ ID NO: 8845 - DNA, 21 bp, Artificial Sequence
  Synthetic
tctttttcgatgggtggtttg

SEQ ID NO: 8846 - DNA, 21 bp, Artificial Sequence
  Synthetic
gttcgtgggactctgcatggg

SEQ ID NO: 8847 - DNA, 21 bp, Artificial Sequence
  Synthetic
gagcgtaatgctcgttttcct

SEQ ID NO: 8848 - DNA, 21 bp, Artificial Sequence
  Synthetic
gatcggcgtgttgtgggtgcg

SEQ ID NO: 8849 - DNA, 21 bp, Artificial Sequence
  Synthetic
atgaggttggcgagtgatagg

SEQ ID NO: 8850 - DNA, 21 bp, Artificial Sequence
  Synthetic
agtaggccggatcagtataag

SEQ ID NO: 8851 - DNA, 21 bp, Artificial Sequence
  Synthetic
acttctaatcagtggcgtgat

SEQ ID NO: 8852 - DNA, 21 bp, Artificial Sequence
  Synthetic
catattcatggtcggattggg

SEQ ID NO: 8853 - DNA, 21 bp, Artificial Sequence
  Synthetic
cggatggctgggccgaatcat

SEQ ID NO: 8854 - DNA, 21 bp, Artificial Sequence
  Synthetic
aggggtgagctggtgaatcgg

SEQ ID NO: 8855 - DNA, 21 bp, Artificial Sequence
  Synthetic
ggtcggcttcatcagggtggg

SEQ ID NO: 8856 - DNA, 21 bp, Artificial Sequence
  Synthetic
atgaatttgcatgttaagctt

SEQ ID NO: 8857 - DNA, 21 bp, Artificial Sequence
  Synthetic
gctcggacgcaggatattagg

SEQ ID NO: 8858 - DNA, 21 bp, Artificial Sequence
  Synthetic
ggtaatgctgctagtttgcgg

SEQ ID NO: 8859 - DNA, 21 bp, Artificial Sequence
  Synthetic
cggcgtgatcctcttatggat

SEQ ID NO: 8860 - DNA, 21 bp, Artificial Sequence
  Synthetic
gtgatgtcgctgtatgctaag

SEQ ID NO: 8861 - DNA, 21 bp, Artificial Sequence
  Synthetic
gcgggtcatcatatgggtcat

SEQ ID NO: 8862 - DNA, 21 bp, Artificial Sequence
  Synthetic
cataggcctgctatgactacg

SEQ ID NO: 8863 - DNA, 21 bp, Artificial Sequence
  Synthetic
gtgccgatgacgcaggctatg

SEQ ID NO: 8864 - DNA, 21 bp, Artificial Sequence
  Synthetic
ctgtcgtttaagtcgattctt

SEQ ID NO: 8865 - DNA, 21 bp, Artificial Sequence
  Synthetic
ttgtctggtggtgggcagagg

SEQ ID NO: 8866 - DNA, 21 bp, Artificial Sequence
  Synthetic
gtgccgcggatggaggcgcgt

SEQ ID NO: 8867 - DNA, 21 bp, Artificial Sequence
  Synthetic
catatgatgcgtaataatatt

SEQ ID NO: 8868 - DNA, 21 bp, Artificial Sequence
  Synthetic
tctgttcatgcgccgtttatt

SEQ ID NO: 8869 - DNA, 21 bp, Artificial Sequence
  Synthetic
tatttggatatgaaggagttg

SEQ ID NO: 8870 - DNA, 21 bp, Artificial Sequence
  Synthetic
catgatcgtgggtgggtggcg

SEQ ID NO: 8871 - DNA, 21 bp, Artificial Sequence
  Synthetic
tgtcatctgggtctgtcgaag

SEQ ID NO: 8872 - DNA, 21 bp, Artificial Sequence
  Synthetic
aggtctgaggatcatcggtgg

SEQ ID NO: 8873 - DNA, 21 bp, Artificial Sequence
  Synthetic
attagtcttcgttctcagtat

SEQ ID NO: 8874 - DNA, 21 bp, Artificial Sequence
  Synthetic
agtgattggacgaatcgtacg

SEQ ID NO: 8875 - DNA, 21 bp, Artificial Sequence
  Synthetic
cggcatagtgtggaggtgggg

SEQ ID NO: 8876 - DNA, 21 bp, Artificial Sequence
  Synthetic
ccgcctattgctcgtacgctg

SEQ ID NO: 8877 - DNA, 21 bp, Artificial Sequence
  Synthetic
cctgatacttttcggcttgtg

SEQ ID NO: 8878 - DNA, 21 bp, Artificial Sequence
  Synthetic
tcgagggttcagccttttctg

SEQ ID NO: 8879 - DNA, 21 bp, Artificial Sequence
  Synthetic
agggctgcggaggggttgcgg

SEQ ID NO: 8880 - DNA, 21 bp, Artificial Sequence
  Synthetic
gttggtaaggcgttgggtcat

SEQ ID NO: 8881 - DNA, 21 bp, Artificial Sequence
  Synthetic
ggtcgtggtggtgaggctaat

SEQ ID NO: 8882 - DNA, 21 bp, Artificial Sequence
  Synthetic
tttacgtctagttatccttat

SEQ ID NO: 8883 - DNA, 21 bp, Artificial Sequence
  Synthetic
acggatgatcggttttttaag

SEQ ID NO: 8884 - DNA, 21 bp, Artificial Sequence
  Synthetic
agtactgatgtgcagcggggg

SEQ ID NO: 8885 - DNA, 21 bp, Artificial Sequence
  Synthetic
tggggtaatttgtcgctgacg

SEQ ID NO: 8886 - DNA, 21 bp, Artificial Sequence
  Synthetic
atgaatcagcagaatagtagg

SEQ ID NO: 8887 - DNA, 21 bp, Artificial Sequence
  Synthetic
tatacgaagagtgatagtctt

SEQ ID NO: 8888 - DNA, 21 bp, Artificial Sequence
  Synthetic
ggtaatggtatgtggatttct

SEQ ID NO: 8889 - DNA, 21 bp, Artificial Sequence
  Synthetic
actcagaatccttctttgtgg

SEQ ID NO: 8890 - DNA, 21 bp, Artificial Sequence
  Synthetic
ggtgcgtttcgttctgtgccg

SEQ ID NO: 8891 - DNA, 21 bp, Artificial Sequence
  Synthetic
tggcgtacgttgggtagtgtt

SEQ ID NO: 8892 - DNA, 21 bp, Artificial Sequence
  Synthetic
ctgagtgtgcataatgtgatg

SEQ ID NO: 8893 - DNA, 21 bp, Artificial Sequence
  Synthetic
aataatcgggcttatcagggg

SEQ ID NO: 8894 - DNA, 21 bp, Artificial Sequence
  Synthetic
catggtgttcgtatgacggct

SEQ ID NO: 8895 - DNA, 21 bp, Artificial Sequence
  Synthetic
tttagtcttcaggggtcgcgg

SEQ ID NO: 8896 - DNA, 21 bp, Artificial Sequence
  Synthetic
actaagtgggttggtaaggag

SEQ ID NO: 8897 - DNA, 21 bp, Artificial Sequence
  Synthetic
ggggtggctatgatttcgatg

SEQ ID NO: 8898 - DNA, 21 bp, Artificial Sequence
  Synthetic
tgggcggagtttcatcgtgtg

SEQ ID NO: 8899 - DNA, 21 bp, Artificial Sequence
  Synthetic
ggtgagaagcatgataggttt

SEQ ID NO: 8900 - DNA, 21 bp, Artificial Sequence
  Synthetic
catggtcctcaggggcgtatt

SEQ ID NO: 8901 - DNA, 21 bp, Artificial Sequence
  Synthetic
cgttggggtgatgatgggagg

SEQ ID NO: 8902 - DNA, 21 bp, Artificial Sequence
  Synthetic
cagcatgggcatgttagggat

SEQ ID NO: 8903 - DNA, 21 bp, Artificial Sequence
  Synthetic
cgggcggaggttgtgcggcat

SEQ ID NO: 8904 - DNA, 21 bp, Artificial Sequence
  Synthetic
aagaatcatccgctgcgggag

SEQ ID NO: 8905 - DNA, 21 bp, Artificial Sequence
  Synthetic
cctaatcgtgaggtgatgcgt

SEQ ID NO: 8906 - DNA, 21 bp, Artificial Sequence
  Synthetic
aggaatgatacgtctactcgt

SEQ ID NO: 8907 - DNA, 21 bp, Artificial Sequence
  Synthetic
atggtggctcgtgaggggcgt

SEQ ID NO: 8908 - DNA, 21 bp, Artificial Sequence
  Synthetic
ctggctaagtggcatgatgct

SEQ ID NO: 8909 - DNA, 21 bp, Artificial Sequence
  Synthetic
tggattgagaagccttttatt

SEQ ID NO: 8910 - DNA, 21 bp, Artificial Sequence
  Synthetic
tcgcatgctgggagtggtgtt

SEQ ID NO: 8911 - DNA, 21 bp, Artificial Sequence
  Synthetic
tttggtgggcgtcatgcgacg

SEQ ID NO: 8912 - DNA, 21 bp, Artificial Sequence
  Synthetic
cctcatcatgctagtactcat

SEQ ID NO: 8913 - DNA, 21 bp, Artificial Sequence
  Synthetic
tggagggtgaatgagtttgag

SEQ ID NO: 8914 - DNA, 21 bp, Artificial Sequence
  Synthetic
aggtgggagcatgggggtcag

SEQ ID NO: 8915 - DNA, 21 bp, Artificial Sequence
  Synthetic
gtgcgtgcggcttttggtgtg

SEQ ID NO: 8916 - DNA, 21 bp, Artificial Sequence
  Synthetic
gggatgcggcgggagtcgcag

SEQ ID NO: 8917 - DNA, 21 bp, Artificial Sequence
  Synthetic
gcgtgggggaatgcgcagcat

SEQ ID NO: 8918 - DNA, 21 bp, Artificial Sequence
  Synthetic
atgcgtcatagtattgcttcg

SEQ ID NO: 8919 - DNA, 21 bp, Artificial Sequence
  Synthetic
atgcgtgggcatctgggtcct

SEQ ID NO: 8920 - DNA, 21 bp, Artificial Sequence
  Synthetic
gctagggatgttaggccgcat

SEQ ID NO: 8921 - DNA, 21 bp, Artificial Sequence
  Synthetic
tcggatttgggttggcatcct

SEQ ID NO: 8922 - DNA, 21 bp, Artificial Sequence
  Synthetic
cgggaggtgcatgtgggtgcg

SEQ ID NO: 8923 - DNA, 21 bp, Artificial Sequence
  Synthetic
tggactgcgcatgatccgaag

SEQ ID NO: 8924 - DNA, 21 bp, Artificial Sequence
  Synthetic
catagtcgtacgcatgatttg

SEQ ID NO: 8925 - DNA, 21 bp, Artificial Sequence
  Synthetic
tggatgaaggtgactcatgtt

SEQ ID NO: 8926 - DNA, 21 bp, Artificial Sequence
  Synthetic
agtaaggatcagccttttagg

SEQ ID NO: 8927 - DNA, 21 bp, Artificial Sequence
  Synthetic
acggcttggaggagtgatggt

SEQ ID NO: 8928 - DNA, 21 bp, Artificial Sequence
  Synthetic
catccgaatgtgctggctcgt

SEQ ID NO: 8929 - DNA, 21 bp, Artificial Sequence
  Synthetic
agtacgcatgggtgggcggcg

SEQ ID NO: 8930 - DNA, 21 bp, Artificial Sequence
  Synthetic
gtgaaggcgtttgagcagagg

SEQ ID NO: 8931 - DNA, 21 bp, Artificial Sequence
  Synthetic
gcgggtcgtgctctgggtttg

SEQ ID NO: 8932 - DNA, 21 bp, Artificial Sequence
  Synthetic
aggatgatgaattctactttt

SEQ ID NO: 8933 - DNA, 21 bp, Artificial Sequence
  Synthetic
gatagggatcggggtttgcgt

SEQ ID NO: 8934 - DNA, 21 bp, Artificial Sequence
  Synthetic
ctggggcagaaggagggtcgg

SEQ ID NO: 8935 - DNA, 21 bp, Artificial Sequence
  Synthetic
tctgatcatatgagtaagcgt

SEQ ID NO: 8936 - DNA, 21 bp, Artificial Sequence
  Synthetic
tatgatgctaatgctaggagg

SEQ ID NO: 8937 - DNA, 21 bp, Artificial Sequence
  Synthetic
actcaggctcatatgatgggg

SEQ ID NO: 8938 - DNA, 21 bp, Artificial Sequence
  Synthetic
ctgaatggttatgggtctcgg

SEQ ID NO: 8939 - DNA, 21 bp, Artificial Sequence
  Synthetic
gtgcctcgtgttaatcatacg

SEQ ID NO: 8940 - DNA, 21 bp, Artificial Sequence
  Synthetic
cataggcagggttcgcttctt

SEQ ID NO: 8941 - DNA, 21 bp, Artificial Sequence
  Synthetic
catgttcgtcaggttgctctt

SEQ ID NO: 8942 - DNA, 21 bp, Artificial Sequence
  Synthetic
catcttgggggtaggggttcg

SEQ ID NO: 8943 - DNA, 21 bp, Artificial Sequence
  Synthetic
ctgggtaagccgcattctcag

SEQ ID NO: 8944 - DNA, 21 bp, Artificial Sequence
  Synthetic
agggttgattcgcagaggatt

SEQ ID NO: 8945 - DNA, 21 bp, Artificial Sequence
  Synthetic
tcgaataagagtcatcagcat

SEQ ID NO: 8946 - DNA, 21 bp, Artificial Sequence
  Synthetic
gagcggggtgggcggcatgat

SEQ ID NO: 8947 - DNA, 21 bp, Artificial Sequence
  Synthetic
cggactgttttgttggagagg

SEQ ID NO: 8948 - DNA, 21 bp, Artificial Sequence
  Synthetic
gatcctatgtggaatcgtgcg

SEQ ID NO: 8949 - DNA, 21 bp, Artificial Sequence
  Synthetic
ccgattatgtttagtgaggtt

SEQ ID NO: 8950 - DNA, 21 bp, Artificial Sequence
  Synthetic
gcgaggttgcatgtgattgat

SEQ ID NO: 8951 - DNA, 21 bp, Artificial Sequence
  Synthetic
cgtttggctcggcctgagatg

SEQ ID NO: 8952 - DNA, 21 bp, Artificial Sequence
  Synthetic
tcgctgtcgtcgtttaagcag

SEQ ID NO: 8953 - DNA, 21 bp, Artificial Sequence
  Synthetic
tctagggatggtagtcggaat

SEQ ID NO: 8954 - DNA, 21 bp, Artificial Sequence
  Synthetic
aatagggctgatcttgctcgg

SEQ ID NO: 8955 - DNA, 21 bp, Artificial Sequence
  Synthetic
cctgaggtgcggaattgtgtg

SEQ ID NO: 8956 - DNA, 21 bp, Artificial Sequence
  Synthetic
agtatgagggctactcctttt

SEQ ID NO: 8957 - DNA, 21 bp, Artificial Sequence
  Synthetic
cttgttggggcgcttgcgatg

SEQ ID NO: 8958 - DNA, 21 bp, Artificial Sequence
  Synthetic
aggacgacggatgttgttatg

SEQ ID NO: 8959 - DNA, 21 bp, Artificial Sequence
  Synthetic
agtttggtggctccgtttaag

SEQ ID NO: 8960 - DNA, 21 bp, Artificial Sequence
  Synthetic
ttgagtgggcatatgattctt

SEQ ID NO: 8961 - DNA, 21 bp, Artificial Sequence
  Synthetic
ggggctagggagaagatggtg

SEQ ID NO: 8962 - DNA, 21 bp, Artificial Sequence
  Synthetic
ccgcggtttagtccgcaggct

SEQ ID NO: 8963 - DNA, 21 bp, Artificial Sequence
  Synthetic
gatgcggatctgggtgcttgg

SEQ ID NO: 8964 - DNA, 21 bp, Artificial Sequence
  Synthetic
agtactcggccgctggatcat

SEQ ID NO: 8965 - DNA, 21 bp, Artificial Sequence
  Synthetic
agtaggattgctcagcatgag

SEQ ID NO: 8966 - DNA, 21 bp, Artificial Sequence
  Synthetic
attctggctggtagtcggaat

SEQ ID NO: 8967 - DNA, 21 bp, Artificial Sequence
  Synthetic
gagccgaagatgcttcttgtg

SEQ ID NO: 8968 - DNA, 21 bp, Artificial Sequence
  Synthetic
ttggggctggttattcagagt

SEQ ID NO: 8969 - DNA, 21 bp, Artificial Sequence
  Synthetic
ccgaataatctgcagcatagg

SEQ ID NO: 8970 - DNA, 21 bp, Artificial Sequence
  Synthetic
gggaatgcggggactgctaag

SEQ ID NO: 8971 - DNA, 21 bp, Artificial Sequence
  Synthetic
cgtggtgcgcatcctccgctg

SEQ ID NO: 8972 - DNA, 21 bp, Artificial Sequence
  Synthetic
actgggccggaggggcggaag

SEQ ID NO: 8973 - DNA, 21 bp, Artificial Sequence
  Synthetic
cggggtgagaggcttaatagt

SEQ ID NO: 8974 - DNA, 21 bp, Artificial Sequence
  Synthetic
aagccgtggaatgagttgacg

SEQ ID NO: 8975 - DNA, 21 bp, Artificial Sequence
  Synthetic
tcgggtggtattgtgtctggg

SEQ ID NO: 8976 - DNA, 21 bp, Artificial Sequence
  Synthetic
ggtcgtgtgattggtcgtgag

SEQ ID NO: 8977 - DNA, 21 bp, Artificial Sequence
  Synthetic
gctcgtcttgagaggcatttg

SEQ ID NO: 8978 - DNA, 21 bp, Artificial Sequence
  Synthetic
cttaatgcgttgcatacgcgg

SEQ ID NO: 8979 - DNA, 21 bp, Artificial Sequence
  Synthetic
aggacgatggatgcttttagg

SEQ ID NO: 8980 - DNA, 21 bp, Artificial Sequence
  Synthetic
agtcatattgggtttagtgcg

SEQ ID NO: 8981 - DNA, 21 bp, Artificial Sequence
  Synthetic
gatgggctttcgcgtgttctg

SEQ ID NO: 8982 - DNA, 21 bp, Artificial Sequence
  Synthetic
cgtacttcggagttgcatagg

SEQ ID NO: 8983 - DNA, 21 bp, Artificial Sequence
  Synthetic
aatacgcgtgtgattgatagg

SEQ ID NO: 8984 - DNA, 21 bp, Artificial Sequence
  Synthetic
gttagtacgcgggagaggctg

SEQ ID NO: 8985 - DNA, 21 bp, Artificial Sequence
  Synthetic
ggtattgttgtgaggctgcat

SEQ ID NO: 8986 - DNA, 21 bp, Artificial Sequence
  Synthetic
aggagttctttgtttgttggt

SEQ ID NO: 8987 - DNA, 21 bp, Artificial Sequence
  Synthetic
cgtcctggtggggggacttat

SEQ ID NO: 8988 - DNA, 21 bp, Artificial Sequence
  Synthetic
tttaattctcagacggggaag

SEQ ID NO: 8989 - DNA, 21 bp, Artificial Sequence
  Synthetic
aagaggagtggttatgatgct

SEQ ID NO: 8990 - DNA, 21 bp, Artificial Sequence
  Synthetic
aggggtgagaagccgggttgg

SEQ ID NO: 8991 - DNA, 21 bp, Artificial Sequence
  Synthetic
aatggtagtaggcaggtgcat

SEQ ID NO: 8992 - DNA, 21 bp, Artificial Sequence
  Synthetic
tctgcttggtctatggagcat

SEQ ID NO: 8993 - DNA, 21 bp, Artificial Sequence
  Synthetic
agtgcggctcggagtttgttt

SEQ ID NO: 8994 - DNA, 21 bp, Artificial Sequence
  Synthetic
aagaatgttcataatctggcg

SEQ ID NO: 8995 - DNA, 21 bp, Artificial Sequence
  Synthetic
ggggctacggtgaagaattgg

SEQ ID NO: 8996 - DNA, 21 bp, Artificial Sequence
  Synthetic
ggttttccgcagcggaatact

SEQ ID NO: 8997 - DNA, 21 bp, Artificial Sequence
  Synthetic
cttttgcgttcggaggcgcgg

SEQ ID NO: 8998 - DNA, 21 bp, Artificial Sequence
  Synthetic
gtgctgcgtaatccgctgatg

SEQ ID NO: 8999 - DNA, 21 bp, Artificial Sequence
  Synthetic
atgcataataatttgcgtaat

SEQ ID NO: 9000 - DNA, 21 bp, Artificial Sequence
  Synthetic
aggttggctgagcagcggatt

SEQ ID NO: 9001 - DNA, 21 bp, Artificial Sequence
  Synthetic
ttgaagcatggtattgttaat

SEQ ID NO: 9002 - DNA, 21 bp, Artificial Sequence
  Synthetic
cttagggatagggcgcatggg

SEQ ID NO: 9003 - DNA, 21 bp, Artificial Sequence
  Synthetic
aatggtcttccgcggagtatt

SEQ ID NO: 9004 - DNA, 21 bp, Artificial Sequence
  Synthetic
cgtccgaatcgtcctcaggat

SEQ ID NO: 9005 - DNA, 21 bp, Artificial Sequence
  Synthetic
cctcttgtgcctgagcggcgg

SEQ ID NO: 9006 - DNA, 21 bp, Artificial Sequence
  Synthetic
aagttggggtctggtgtgtgg

SEQ ID NO: 9007 - DNA, 21 bp, Artificial Sequence
  Synthetic
aggtctgtgcgtttggagtcg

SEQ ID NO: 9008 - DNA, 21 bp, Artificial Sequence
  Synthetic
actaagacgattcagttgtat

SEQ ID NO: 9009 - DNA, 21 bp, Artificial Sequence
  Synthetic
atgcattttgagagtcctagg

SEQ ID NO: 9010 - DNA, 21 bp, Artificial Sequence
  Synthetic
acgcataagagtagtacgctg

SEQ ID NO: 9011 - DNA, 21 bp, Artificial Sequence
  Synthetic
cttggggctgggcttctgcgt

SEQ ID NO: 9012 - DNA, 21 bp, Artificial Sequence
  Synthetic
actactcagtctattcgtttt

SEQ ID NO: 9013 - DNA, 21 bp, Artificial Sequence
  Synthetic
gggagggcgcctattaatcat

SEQ ID NO: 9014 - DNA, 21 bp, Artificial Sequence
  Synthetic
ctggggttgggttggtctcct

SEQ ID NO: 9015 - DNA, 21 bp, Artificial Sequence
  Synthetic
agtccttttgggagtaagcat

SEQ ID NO: 9016 - DNA, 21 bp, Artificial Sequence
  Synthetic
tttaatactccgagggcggtg

SEQ ID NO: 9017 - DNA, 21 bp, Artificial Sequence
  Synthetic
cggcattcggctatggggatg

SEQ ID NO: 9018 - DNA, 21 bp, Artificial Sequence
  Synthetic
cgtgagaggatggagaagtct

SEQ ID NO: 9019 - DNA, 21 bp, Artificial Sequence
  Synthetic
atgggtggggctgtgggtcgt

SEQ ID NO: 9020 - DNA, 21 bp, Artificial Sequence
  Synthetic
tcgcttcatgtgagtggtcgg

SEQ ID NO: 9021 - DNA, 21 bp, Artificial Sequence
  Synthetic
actatggagtcgccgtggctg

SEQ ID NO: 9022 - DNA, 21 bp, Artificial Sequence
  Synthetic
tggggtactgcgattgggaag

SEQ ID NO: 9023 - DNA, 21 bp, Artificial Sequence
  Synthetic
gggaggacttcttttcagtcg

SEQ ID NO: 9024 - DNA, 21 bp, Artificial Sequence
  Synthetic
cgtctggagtcttctaaggct

SEQ ID NO: 9025 - DNA, 21 bp, Artificial Sequence
  Synthetic
gctggtggtagggtggcgatg

SEQ ID NO: 9026 - DNA, 21 bp, Artificial Sequence
  Synthetic
atgggtgagtatcgggctcgg

SEQ ID NO: 9027 - DNA, 21 bp, Artificial Sequence
  Synthetic
agtgcgttgagggttgagagg

SEQ ID NO: 9028 - DNA, 21 bp, Artificial Sequence
  Synthetic
gatggggggcgggtgggtgtg

SEQ ID NO: 9029 - DNA, 21 bp, Artificial Sequence
  Synthetic
gataggtttaatcatatgcat

SEQ ID NO: 9030 - DNA, 21 bp, Artificial Sequence
  Synthetic
agtttggaggcggcgcggcgg

SEQ ID NO: 9031 - DNA, 21 bp, Artificial Sequence
  Synthetic
gcgcgtcatcaggagaagagt

SEQ ID NO: 9032 - DNA, 21 bp, Artificial Sequence
  Synthetic
gcgcttgttaagcctatgcat

SEQ ID NO: 9033 - DNA, 21 bp, Artificial Sequence
  Synthetic
agtagggcgaagccggagcat

SEQ ID NO: 9034 - DNA, 21 bp, Artificial Sequence
  Synthetic
gcggtttggggtggggggcct

SEQ ID NO: 9035 - DNA, 21 bp, Artificial Sequence
  Synthetic
gggacttatccgtatgtgaat

SEQ ID NO: 9036 - DNA, 21 bp, Artificial Sequence
  Synthetic
gatgctaagcggcctggtctt

SEQ ID NO: 9037 - DNA, 21 bp, Artificial Sequence
  Synthetic
tttgatgtgaggaggccgttt

SEQ ID NO: 9038 - DNA, 21 bp, Artificial Sequence
  Synthetic
aatcgtgggctgccgcatggt

SEQ ID NO: 9039 - DNA, 21 bp, Artificial Sequence
  Synthetic
aggcgggagaatggtccgttg

SEQ ID NO: 9040 - DNA, 21 bp, Artificial Sequence
  Synthetic
atggtggcgaatccgtttcgg

SEQ ID NO: 9041 - DNA, 21 bp, Artificial Sequence
  Synthetic
ggggctagggctgagttgcgg

SEQ ID NO: 9042 - DNA, 21 bp, Artificial Sequence
  Synthetic
catgctcctaggcatgtgcag

SEQ ID NO: 9043 - DNA, 21 bp, Artificial Sequence
  Synthetic
aggcatcaggctcagatgacg

SEQ ID NO: 9044 - DNA, 21 bp, Artificial Sequence
  Synthetic
ctgtcgcaggtgattgggaag

SEQ ID NO: 9045 - DNA, 21 bp, Artificial Sequence
  Synthetic
ttgctggggcctgagcgtagg

SEQ ID NO: 9046 - DNA, 21 bp, Artificial Sequence
  Synthetic
catggtatgagggtgaatgcg

SEQ ID NO: 9047 - DNA, 21 bp, Artificial Sequence
  Synthetic
aagggtatgtctcatcagaat

SEQ ID NO: 9048 - DNA, 21 bp, Artificial Sequence
  Synthetic
cggtttcatggtcgtgatgat

SEQ ID NO: 9049 - DNA, 21 bp, Artificial Sequence
  Synthetic
ctgcgtggtgctccgcatatg

SEQ ID NO: 9050 - DNA, 21 bp, Artificial Sequence
  Synthetic
gagcattggggtgctgcgcgt

SEQ ID NO: 9051 - DNA, 21 bp, Artificial Sequence
  Synthetic
cagaagttgcatttgggtggg

SEQ ID NO: 9052 - DNA, 21 bp, Artificial Sequence
  Synthetic
attttgggggtgtatgctgtg

SEQ ID NO: 9053 - DNA, 21 bp, Artificial Sequence
  Synthetic
gagggtaatgctcataatagg

SEQ ID NO: 9054 - DNA, 21 bp, Artificial Sequence
  Synthetic
gtgcatctgaggagtacgtct

SEQ ID NO: 9055 - DNA, 21 bp, Artificial Sequence
  Synthetic
aataggtttgttgatgctggg

SEQ ID NO: 9056 - DNA, 21 bp, Artificial Sequence
  Synthetic
gcggtgttgaggaatggtact

SEQ ID NO: 9057 - DNA, 21 bp, Artificial Sequence
  Synthetic
cgtttgagtagtcatcagttg

SEQ ID NO: 9058 - DNA, 21 bp, Artificial Sequence
  Synthetic
gcgggtggtagtgcgcggtgt

SEQ ID NO: 9059 - DNA, 21 bp, Artificial Sequence
  Synthetic
ggggagcaggcgaggcatacg

SEQ ID NO: 9060 - DNA, 21 bp, Artificial Sequence
  Synthetic
aggacggctaatgagatgcgt

SEQ ID NO: 9061 - DNA, 21 bp, Artificial Sequence
  Synthetic
cggggtccttcgaatgggtat

SEQ ID NO: 9062 - DNA, 21 bp, Artificial Sequence
  Synthetic
cctggtcggtggaatggtgag

SEQ ID NO: 9063 - DNA, 21 bp, Artificial Sequence
  Synthetic
catcttgggatgaagagtcat

SEQ ID NO: 9064 - DNA, 21 bp, Artificial Sequence
  Synthetic
attgttgggccttttaagggg

SEQ ID NO: 9065 - DNA, 21 bp, Artificial Sequence
  Synthetic
gcgaatcatgttcgtgagaag

SEQ ID NO: 9066 - DNA, 21 bp, Artificial Sequence
  Synthetic
gagctggtgcgtagggagagg

SEQ ID NO: 9067 - DNA, 21 bp, Artificial Sequence
  Synthetic
aataaggagcatagtattagg

SEQ ID NO: 9068 - DNA, 21 bp, Artificial Sequence
  Synthetic
ggtactgcgcgtggtagtttt

SEQ ID NO: 9069 - DNA, 21 bp, Artificial Sequence
  Synthetic
cgtattgctctggatgggcgt

SEQ ID NO: 9070 - DNA, 21 bp, Artificial Sequence
  Synthetic
cgtaatggtaagaattgggag

SEQ ID NO: 9071 - DNA, 21 bp, Artificial Sequence
  Synthetic
acggggaagcttggtgggtgt

SEQ ID NO: 9072 - DNA, 21 bp, Artificial Sequence
  Synthetic
gctgtgaatacgagtaggaat

SEQ ID NO: 9073 - DNA, 21 bp, Artificial Sequence
  Synthetic
catcatggtactcatgagagg

SEQ ID NO: 9074 - DNA, 21 bp, Artificial Sequence
  Synthetic
gttgggcggtttacgattgcg

SEQ ID NO: 9075 - DNA, 21 bp, Artificial Sequence
  Synthetic
agggggatggagtttaatagg

SEQ ID NO: 9076 - DNA, 21 bp, Artificial Sequence
  Synthetic
catgtggcggattggcttaag

SEQ ID NO: 9077 - DNA, 21 bp, Artificial Sequence
  Synthetic
cgtcatgggcctgtggggatg

SEQ ID NO: 9078 - DNA, 21 bp, Artificial Sequence
  Synthetic
attggtaggaggcaggatgat

SEQ ID NO: 9079 - DNA, 21 bp, Artificial Sequence
  Synthetic
ggggattggatgattgcgagt

SEQ ID NO: 9080 - DNA, 21 bp, Artificial Sequence
  Synthetic
agtgcgtggggggcggagagg

SEQ ID NO: 9081 - DNA, 21 bp, Artificial Sequence
  Synthetic
tcgttgaaggctccttttcat

SEQ ID NO: 9082 - DNA, 21 bp, Artificial Sequence
  Synthetic
gatgctcgttggcctgggagt

SEQ ID NO: 9083 - DNA, 21 bp, Artificial Sequence
  Synthetic
gaggggcgttcgcatctgagt

SEQ ID NO: 9084 - DNA, 21 bp, Artificial Sequence
  Synthetic
gaggttgttgctgcgcggttg

SEQ ID NO: 9085 - DNA, 21 bp, Artificial Sequence
  Synthetic
ggtgatcggtcgaaggtgtgg

SEQ ID NO: 9086 - DNA, 21 bp, Artificial Sequence
  Synthetic
aatcgtgtgcgggagcctcct

SEQ ID NO: 9087 - DNA, 21 bp, Artificial Sequence
  Synthetic
atgggtaaggctactccgtgg

SEQ ID NO: 9088 - DNA, 21 bp, Artificial Sequence
  Synthetic
agggctgggcatctgagtcat

SEQ ID NO: 9089 - DNA, 21 bp, Artificial Sequence
  Synthetic
aggtctactgtgactcctacg

SEQ ID NO: 9090 - DNA, 21 bp, Artificial Sequence
  Synthetic
gttttgctggatggttgtaag

SEQ ID NO: 9091 - DNA, 21 bp, Artificial Sequence
  Synthetic
gagggtcgttggagggagtcg

SEQ ID NO: 9092 - DNA, 21 bp, Artificial Sequence
  Synthetic
gtgtttgcgcagggggcgagg

SEQ ID NO: 9093 - DNA, 21 bp, Artificial Sequence
  Synthetic
aatttgcagaagccgtttatt

SEQ ID NO: 9094 - DNA, 21 bp, Artificial Sequence
  Synthetic
acgccttggcagactaatggg

SEQ ID NO: 9095 - DNA, 21 bp, Artificial Sequence
  Synthetic
attgcgagggttccggggcat

SEQ ID NO: 9096 - DNA, 21 bp, Artificial Sequence
  Synthetic
acggctctgattggtgggttt

SEQ ID NO: 9097 - DNA, 21 bp, Artificial Sequence
  Synthetic
tctccgggtggttggccgccg

SEQ ID NO: 9098 - DNA, 21 bp, Artificial Sequence
  Synthetic
tctaagacgcctgattggtgt

SEQ ID NO: 9099 - DNA, 21 bp, Artificial Sequence
  Synthetic
cataatgggtcgtttcctagg

SEQ ID NO: 9100 - DNA, 21 bp, Artificial Sequence
  Synthetic
actccttggagtgagcggggg

SEQ ID NO: 9101 - DNA, 21 bp, Artificial Sequence
  Synthetic
aggcctaattatggggtgctg

SEQ ID NO: 9102 - DNA, 21 bp, Artificial Sequence
  Synthetic
cgggcgatgagtgataatagg

SEQ ID NO: 9103 - DNA, 21 bp, Artificial Sequence
  Synthetic
atttgggtggctggggcggcg

SEQ ID NO: 9104 - DNA, 21 bp, Artificial Sequence
  Synthetic
atgggtcgtattattactcat

SEQ ID NO: 9105 - DNA, 21 bp, Artificial Sequence
  Synthetic
tctggtccgagtcatattagg

SEQ ID NO: 9106 - DNA, 21 bp, Artificial Sequence
  Synthetic
gttgctactgttcatgggcgg

SEQ ID NO: 9107 - DNA, 21 bp, Artificial Sequence
  Synthetic
actcgggagaatcgggttctt

SEQ ID NO: 9108 - DNA, 21 bp, Artificial Sequence
  Synthetic
agtttgaatacgcatggtaag

SEQ ID NO: 9109 - DNA, 21 bp, Artificial Sequence
  Synthetic
gagcggactattccttctcgg

SEQ ID NO: 9110 - DNA, 21 bp, Artificial Sequence
  Synthetic
attttggtgcttggtgcgagt

SEQ ID NO: 9111 - DNA, 21 bp, Artificial Sequence
  Synthetic
ggtagtgctaggactcgtgag

SEQ ID NO: 9112 - DNA, 21 bp, Artificial Sequence
  Synthetic
ggtggtcgtactctgcatgct

SEQ ID NO: 9113 - DNA, 21 bp, Artificial Sequence
  Synthetic
agggctcatacgccgaatagt

SEQ ID NO: 9114 - DNA, 21 bp, Artificial Sequence
  Synthetic
cgtgggagtccgcatattgcg

SEQ ID NO: 9115 - DNA, 21 bp, Artificial Sequence
  Synthetic
gatatgcatcgtggtgtgaat

SEQ ID NO: 9116 - DNA, 21 bp, Artificial Sequence
  Synthetic
attccgaggggggtgaatcat

SEQ ID NO: 9117 - DNA, 21 bp, Artificial Sequence
  Synthetic
gagattacgaattctgttcgg

SEQ ID NO: 9118 - DNA, 21 bp, Artificial Sequence
  Synthetic
gatcggatgggggctgggcgg

SEQ ID NO: 9119 - DNA, 21 bp, Artificial Sequence
  Synthetic
aggattaatattcagcgtgat

SEQ ID NO: 9120 - DNA, 21 bp, Artificial Sequence
  Synthetic
gtgccgaatatggctcatcgg

SEQ ID NO: 9121 - DNA, 21 bp, Artificial Sequence
  Synthetic
aagccgcatgggtcgggtacg

SEQ ID NO: 9122 - DNA, 21 bp, Artificial Sequence
  Synthetic
cggattgcggtgggttatcct

SEQ ID NO: 9123 - DNA, 21 bp, Artificial Sequence
  Synthetic
ttgcgtcctttgacttctaat

SEQ ID NO: 9124 - DNA, 21 bp, Artificial Sequence
  Synthetic
gggaaggcgatggatacgagg

SEQ ID NO: 9125 - DNA, 21 bp, Artificial Sequence
  Synthetic
gtgcataggcatgagtatgct

SEQ ID NO: 9126 - DNA, 21 bp, Artificial Sequence
  Synthetic
cgtgggcctaataaggttgat

SEQ ID NO: 9127 - DNA, 21 bp, Artificial Sequence
  Synthetic
aatgattggacggttaatgct

SEQ ID NO: 9128 - DNA, 21 bp, Artificial Sequence
  Synthetic
aagtcgattaatccttatgct

SEQ ID NO: 9129 - DNA, 21 bp, Artificial Sequence
  Synthetic
ggtgataggcctgttctgagg

SEQ ID NO: 9130 - DNA, 21 bp, Artificial Sequence
  Synthetic
ggtgggcctcttaatcctcgg

SEQ ID NO: 9131 - DNA, 21 bp, Artificial Sequence
  Synthetic
gttcatcggattgttaatcag

SEQ ID NO: 9132 - DNA, 21 bp, Artificial Sequence
  Synthetic
tatcatgggtgggctagtgct

SEQ ID NO: 9133 - DNA, 21 bp, Artificial Sequence
  Synthetic
ctgtgggctcctacgaatgcg

SEQ ID NO: 9134 - DNA, 21 bp, Artificial Sequence
  Synthetic
aagcatggggctgaggttaag

SEQ ID NO: 9135 - DNA, 21 bp, Artificial Sequence
  Synthetic
cgtagggttgagaatgattgg

SEQ ID NO: 9136 - DNA, 21 bp, Artificial Sequence
  Synthetic
atgggggggcagggtgcgcgg

SEQ ID NO: 9137 - DNA, 21 bp, Artificial Sequence
  Synthetic
aggtcgagtgagagggagaag

SEQ ID NO: 9138 - DNA, 21 bp, Artificial Sequence
  Synthetic
cgtcgtgaggctgcgtatctg

SEQ ID NO: 9139 - DNA, 21 bp, Artificial Sequence
  Synthetic
ctgtcttctggtctgggtgtg

SEQ ID NO: 9140 - DNA, 21 bp, Artificial Sequence
  Synthetic
ggtggggagcttaggcctaag

SEQ ID NO: 9141 - DNA, 21 bp, Artificial Sequence
  Synthetic
acgaagggtgtggagggtcgg

SEQ ID NO: 9142 - DNA, 21 bp, Artificial Sequence
  Synthetic
tggggtcatacttttgagcgt

SEQ ID NO: 9143 - DNA, 21 bp, Artificial Sequence
  Synthetic
ggggggttttcgttggtttct

SEQ ID NO: 9144 - DNA, 21 bp, Artificial Sequence
  Synthetic
ttgcgggggaatccgaattat

SEQ ID NO: 9145 - DNA, 21 bp, Artificial Sequence
  Synthetic
tgggggaattcgcttgcgagg

SEQ ID NO: 9146 - DNA, 21 bp, Artificial Sequence
  Synthetic
gttatgactggtcctcctagg

SEQ ID NO: 9147 - DNA, 21 bp, Artificial Sequence
  Synthetic
atgttgtcgtttcgggaggtg

SEQ ID NO: 9148 - DNA, 21 bp, Artificial Sequence
  Synthetic
ggtcctcttaatctgtttcag

SEQ ID NO: 9149 - DNA, 21 bp, Artificial Sequence
  Synthetic
gggcagactaataagaattgg

SEQ ID NO: 9150 - DNA, 21 bp, Artificial Sequence
  Synthetic
catgggcaggagcggacttgg

SEQ ID NO: 9151 - DNA, 21 bp, Artificial Sequence
  Synthetic
catcataatcggaatggtgct

SEQ ID NO: 9152 - DNA, 21 bp, Artificial Sequence
  Synthetic
gtgcgttttacgaatctggtg

SEQ ID NO: 9153 - DNA, 21 bp, Artificial Sequence
  Synthetic
ctgcgtgatgctgctttgcgg

SEQ ID NO: 9154 - DNA, 21 bp, Artificial Sequence
  Synthetic
cgtactgcgggtcctactcat

SEQ ID NO: 9155 - DNA, 21 bp, Artificial Sequence
  Synthetic
ggtccggggcctgattcggag

SEQ ID NO: 9156 - DNA, 21 bp, Artificial Sequence
  Synthetic
aagcatactctttcgacgcat

SEQ ID NO: 9157 - DNA, 21 bp, Artificial Sequence
  Synthetic
gggtcggggtattggcctgcg

SEQ ID NO: 9158 - DNA, 21 bp, Artificial Sequence
  Synthetic
caggggactgggccgcatcgg

SEQ ID NO: 9159 - DNA, 21 bp, Artificial Sequence
  Synthetic
gggcgttctgtgactttgact

SEQ ID NO: 9160 - DNA, 21 bp, Artificial Sequence
  Synthetic
actgagctgggttgggttcct

SEQ ID NO: 9161 - DNA, 21 bp, Artificial Sequence
  Synthetic
tatgatcatatgatttttaat

SEQ ID NO: 9162 - DNA, 21 bp, Artificial Sequence
  Synthetic
gaggagtttcggccgggtagg

SEQ ID NO: 9163 - DNA, 21 bp, Artificial Sequence
  Synthetic
cgtcatgctgctatgccgtat

SEQ ID NO: 9164 - DNA, 21 bp, Artificial Sequence
  Synthetic
aatcataataggtattctgat

SEQ ID NO: 9165 - DNA, 21 bp, Artificial Sequence
  Synthetic
cggcttgggagtggtgcgcat

SEQ ID NO: 9166 - DNA, 21 bp, Artificial Sequence
  Synthetic
gtgaggcgtgatggttctttt

SEQ ID NO: 9167 - DNA, 21 bp, Artificial Sequence
  Synthetic
gcggatcggggttcggtgcgt

SEQ ID NO: 9168 - DNA, 21 bp, Artificial Sequence
  Synthetic
catcagcgttcgttgtcttcg

SEQ ID NO: 9169 - DNA, 21 bp, Artificial Sequence
  Synthetic
gggcgggatcggctgttggcg

SEQ ID NO: 9170 - DNA, 21 bp, Artificial Sequence
  Synthetic
atgaagggttttgagagggtt

SEQ ID NO: 9171 - DNA, 21 bp, Artificial Sequence
  Synthetic
gttatgactaagcatattttg

SEQ ID NO: 9172 - DNA, 21 bp, Artificial Sequence
  Synthetic
gcgaagggttatggtccgatg

SEQ ID NO: 9173 - DNA, 21 bp, Artificial Sequence
  Synthetic
gttcatcagcggacgcctact

SEQ ID NO: 9174 - DNA, 21 bp, Artificial Sequence
  Synthetic
tttcataatggtgttcggagt

SEQ ID NO: 9175 - DNA, 21 bp, Artificial Sequence
  Synthetic
aaggctgatgggattccgcgt

SEQ ID NO: 9176 - DNA, 21 bp, Artificial Sequence
  Synthetic
aggaaggagattaggattgct

SEQ ID NO: 9177 - DNA, 21 bp, Artificial Sequence
  Synthetic
gatgctagggggccggggtgt

SEQ ID NO: 9178 - DNA, 21 bp, Artificial Sequence
  Synthetic
aggccgacgacgaatgagaag

SEQ ID NO: 9179 - DNA, 21 bp, Artificial Sequence
  Synthetic
tttaagccggctaatgagagg

SEQ ID NO: 9180 - DNA, 21 bp, Artificial Sequence
  Synthetic
cgtgctatggatgctcataag

SEQ ID NO: 9181 - DNA, 21 bp, Artificial Sequence
  Synthetic
cataatagggatactaggacg

SEQ ID NO: 9182 - DNA, 21 bp, Artificial Sequence
  Synthetic
cggcgtacggatgttactggg

SEQ ID NO: 9183 - DNA, 21 bp, Artificial Sequence
  Synthetic
gggaataggcataatgttacg

SEQ ID NO: 9184 - DNA, 21 bp, Artificial Sequence
  Synthetic
aagggggagtggaagtcgacg

SEQ ID NO: 9185 - DNA, 21 bp, Artificial Sequence
  Synthetic
aatggttcgacttatgtgggg

SEQ ID NO: 9186 - DNA, 21 bp, Artificial Sequence
  Synthetic
cttcgtcatcgtgaggatgtg

SEQ ID NO: 9187 - DNA, 21 bp, Artificial Sequence
  Synthetic
cgtagggctatggatgttctg

SEQ ID NO: 9188 - DNA, 21 bp, Artificial Sequence
  Synthetic
aatcggtcgcatgcggagtgg

SEQ ID NO: 9189 - DNA, 21 bp, Artificial Sequence
  Synthetic
agggcgatgaaggaggcttct

SEQ ID NO: 9190 - DNA, 21 bp, Artificial Sequence
  Synthetic
gtgcatcagcgttcggggctt

SEQ ID NO: 9191 - DNA, 21 bp, Artificial Sequence
  Synthetic
cgtgagaagctgcttgagtat

SEQ ID NO: 9192 - DNA, 21 bp, Artificial Sequence
  Synthetic
cgtatggggttgggtcatacg

SEQ ID NO: 9193 - DNA, 21 bp, Artificial Sequence
  Synthetic
tatggtggtaagaatgtgcat

SEQ ID NO: 9194 - DNA, 21 bp, Artificial Sequence
  Synthetic
tgtttgacgtctcatagggct

SEQ ID NO: 9195 - DNA, 21 bp, Artificial Sequence
  Synthetic
tggcttactaaggtggataag

SEQ ID NO: 9196 - DNA, 21 bp, Artificial Sequence
  Synthetic
agtggtgggactatgaatagg

SEQ ID NO: 9197 - DNA, 21 bp, Artificial Sequence
  Synthetic
agtcgtcaggatcctaatcgg

SEQ ID NO: 9198 - DNA, 21 bp, Artificial Sequence
  Synthetic
cgtaatgcgcatacggtgcat

SEQ ID NO: 9199 - DNA, 21 bp, Artificial Sequence
  Synthetic
gcgcagagtattgtggatact

SEQ ID NO: 9200 - DNA, 21 bp, Artificial Sequence
  Synthetic
cggaaggatagtggtgagagg

SEQ ID NO: 9201 - DNA, 21 bp, Artificial Sequence
  Synthetic
cgtgataggatgttggataag

SEQ ID NO: 9202 - DNA, 21 bp, Artificial Sequence
  Synthetic
cgtcattatcatgaggcggtt

SEQ ID NO: 9203 - DNA, 21 bp, Artificial Sequence
  Synthetic
aatcatcgggcgccgcttaat

SEQ ID NO: 9204 - DNA, 21 bp, Artificial Sequence
  Synthetic
atgatgagtcatcgtcctaat

SEQ ID NO: 9205 - DNA, 21 bp, Artificial Sequence
  Synthetic
aagagtggtctgcctgcgatt

SEQ ID NO: 9206 - DNA, 21 bp, Artificial Sequence
  Synthetic
caggtgcctatgcgtgttgtt

SEQ ID NO: 9207 - DNA, 21 bp, Artificial Sequence
  Synthetic
gggattaatgttcttacttat

SEQ ID NO: 9208 - DNA, 21 bp, Artificial Sequence
  Synthetic
cttgttcatggtccgcgtaat

SEQ ID NO: 9209 - DNA, 21 bp, Artificial Sequence
  Synthetic
gggttggttcgtgatggtagg

SEQ ID NO: 9210 - DNA, 21 bp, Artificial Sequence
  Synthetic
catatgcttaaggagtttgtt

SEQ ID NO: 9211 - DNA, 21 bp, Artificial Sequence
  Synthetic
tttaatcatcgggcggtgctg

SEQ ID NO: 9212 - DNA, 21 bp, Artificial Sequence
  Synthetic
aggttggatggtactatgttt

SEQ ID NO: 9213 - DNA, 21 bp, Artificial Sequence
  Synthetic
aagtttaaggatgtgaatttg

SEQ ID NO: 9214 - DNA, 21 bp, Artificial Sequence
  Synthetic
tggagtcatttgcgtgagcat

SEQ ID NO: 9215 - DNA, 21 bp, Artificial Sequence
  Synthetic
ggtcatccgggtcgtgtgatt

SEQ ID NO: 9216 - DNA, 21 bp, Artificial Sequence
  Synthetic
gggcatcggacgaattcgact

SEQ ID NO: 9217 - DNA, 21 bp, Artificial Sequence
  Synthetic
cgttttgcgaatggtagtgtt

SEQ ID NO: 9218 - DNA, 21 bp, Artificial Sequence
  Synthetic
gcgcagtttagtgaggctcgg

SEQ ID NO: 9219 - DNA, 21 bp, Artificial Sequence
  Synthetic
tatgagcgtgtggggcggatg

SEQ ID NO: 9220 - DNA, 21 bp, Artificial Sequence
  Synthetic
actctgcatatgcggcatcct

SEQ ID NO: 9221 - DNA, 21 bp, Artificial Sequence
  Synthetic
agtgtgccgagttatcgtgcg

SEQ ID NO: 9222 - DNA, 21 bp, Artificial Sequence
  Synthetic
agtcgtagttcgctgcattcg

SEQ ID NO: 9223 - DNA, 21 bp, Artificial Sequence
  Synthetic
aaggttgtgcatgggggtagt

SEQ ID NO: 9224 - DNA, 21 bp, Artificial Sequence
  Synthetic
ccgatgcataatcgtagtgat

SEQ ID NO: 9225 - DNA, 21 bp, Artificial Sequence
  Synthetic
gcttggagtacgactgtgggg

SEQ ID NO: 9226 - DNA, 21 bp, Artificial Sequence
  Synthetic
tatcatactaagttggtgact

SEQ ID NO: 9227 - DNA, 21 bp, Artificial Sequence
  Synthetic
tatcatcttaataagatggcg

SEQ ID NO: 9228 - DNA, 21 bp, Artificial Sequence
  Synthetic
ttgaaggatcggttttctggg

SEQ ID NO: 9229 - DNA, 21 bp, Artificial Sequence
  Synthetic
aatgtgggtcggactgatagg

SEQ ID NO: 9230 - DNA, 21 bp, Artificial Sequence
  Synthetic
gagcttaggagtggtcagcgt

SEQ ID NO: 9231 - DNA, 21 bp, Artificial Sequence
  Synthetic
gagagtgggcatcggacgttt

SEQ ID NO: 9232 - DNA, 21 bp, Artificial Sequence
  Synthetic
gttcgggggtttggggagtat

SEQ ID NO: 9233 - DNA, 21 bp, Artificial Sequence
  Synthetic
catgctgcgctggggaggaat

SEQ ID NO: 9234 - DNA, 21 bp, Artificial Sequence
  Synthetic
cgggggcgggagccgccgatg

SEQ ID NO: 9235 - DNA, 21 bp, Artificial Sequence
  Synthetic
aaggctcatgaggggaggagt

SEQ ID NO: 9236 - DNA, 21 bp, Artificial Sequence
  Synthetic
ttgaagattcctgattttagg

SEQ ID NO: 9237 - DNA, 21 bp, Artificial Sequence
  Synthetic
aagcatggtacgccggctcat

SEQ ID NO: 9238 - DNA, 21 bp, Artificial Sequence
  Synthetic
cggacgggtgagaagcagtgg

SEQ ID NO: 9239 - DNA, 21 bp, Artificial Sequence
  Synthetic
gttcctcagggtaggaaggat

SEQ ID NO: 9240 - DNA, 21 bp, Artificial Sequence
  Synthetic
gtgtttcatcgtgcgaatttg

SEQ ID NO: 9241 - DNA, 21 bp, Artificial Sequence
  Synthetic
tctgcggttaggccttttacg

SEQ ID NO: 9242 - DNA, 21 bp, Artificial Sequence
  Synthetic
gggcgggggttgcatgtgggg

SEQ ID NO: 9243 - DNA, 21 bp, Artificial Sequence
  Synthetic
cgtcattcgccgtcttctatg

SEQ ID NO: 9244 - DNA, 21 bp, Artificial Sequence
  Synthetic
catcgtagtgagggtcgtcag

SEQ ID NO: 9245 - DNA, 21 bp, Artificial Sequence
  Synthetic
ggtgggcattctcttccgcgt

SEQ ID NO: 9246 - DNA, 21 bp, Artificial Sequence
  Synthetic
tctgatgttggttggtctccg

SEQ ID NO: 9247 - DNA, 21 bp, Artificial Sequence
  Synthetic
atgcgtggtgatcatcatttg

SEQ ID NO: 9248 - DNA, 21 bp, Artificial Sequence
  Synthetic
agtacttgggggcagaatcat

SEQ ID NO: 9249 - DNA, 21 bp, Artificial Sequence
  Synthetic
caggctaagtttaatactttt

SEQ ID NO: 9250 - DNA, 21 bp, Artificial Sequence
  Synthetic
gttgcgacgcgtacgttttgt

SEQ ID NO: 9251 - DNA, 21 bp, Artificial Sequence
  Synthetic
gttgagtatcgtattagtact

SEQ ID NO: 9252 - DNA, 21 bp, Artificial Sequence
  Synthetic
attgcttctgtgaagaatctg

SEQ ID NO: 9253 - DNA, 21 bp, Artificial Sequence
  Synthetic
acgccttctgttttgcagctg

SEQ ID NO: 9254 - DNA, 21 bp, Artificial Sequence
  Synthetic
gggcatagtgggatgtattat

SEQ ID NO: 9255 - DNA, 21 bp, Artificial Sequence
  Synthetic
agtcatatggtgccggatttt

SEQ ID NO: 9256 - DNA, 21 bp, Artificial Sequence
  Synthetic
gtgagtacttcgtttagtaag

SEQ ID NO: 9257 - DNA, 21 bp, Artificial Sequence
  Synthetic
catgtgagtgatggtctgact

SEQ ID NO: 9258 - DNA, 21 bp, Artificial Sequence
  Synthetic
gagcgtagtgctcctaagcag

SEQ ID NO: 9259 - DNA, 21 bp, Artificial Sequence
  Synthetic
cgttctgttgttgggatgcat

SEQ ID NO: 9260 - DNA, 21 bp, Artificial Sequence
  Synthetic
tggcgggggatggagcgtgcg

SEQ ID NO: 9261 - DNA, 21 bp, Artificial Sequence
  Synthetic
ggttgtgcgcgtggtggttgt

SEQ ID NO: 9262 - DNA, 21 bp, Artificial Sequence
  Synthetic
aagaatacggctaatgatcgg

SEQ ID NO: 9263 - DNA, 21 bp, Artificial Sequence
  Synthetic
gataggcctaagctggctgct

SEQ ID NO: 9264 - DNA, 21 bp, Artificial Sequence
  Synthetic
tgggcttctcatactcctaag

SEQ ID NO: 9265 - DNA, 21 bp, Artificial Sequence
  Synthetic
gtgattgcttctaaggagttg

SEQ ID NO: 9266 - DNA, 21 bp, Artificial Sequence
  Synthetic
ggtgtggctattgctcatacg

SEQ ID NO: 9267 - DNA, 21 bp, Artificial Sequence
  Synthetic
aatacggagttgttggggagg

SEQ ID NO: 9268 - DNA, 21 bp, Artificial Sequence
  Synthetic
atgcttgtgggggcgcatttt

SEQ ID NO: 9269 - DNA, 21 bp, Artificial Sequence
  Synthetic
tcgcatgcggggtgggcggcg

SEQ ID NO: 9270 - DNA, 21 bp, Artificial Sequence
  Synthetic
ggtcagggggtgcgtacttcg

SEQ ID NO: 9271 - DNA, 21 bp, Artificial Sequence
  Synthetic
tttacgcttagttcgtcggtt

SEQ ID NO: 9272 - DNA, 21 bp, Artificial Sequence
  Synthetic
aataatcaggtttggcatact

SEQ ID NO: 9273 - DNA, 21 bp, Artificial Sequence
  Synthetic
actgctcattttcatctggtt

SEQ ID NO: 9274 - DNA, 21 bp, Artificial Sequence
  Synthetic
tatacggggcggccttttgag

SEQ ID NO: 9275 - DNA, 21 bp, Artificial Sequence
  Synthetic
tcggggcgggcgcttgggact

SEQ ID NO: 9276 - DNA, 21 bp, Artificial Sequence
  Synthetic
ttttcgctgactgatccgcgt

SEQ ID NO: 9277 - DNA, 21 bp, Artificial Sequence
  Synthetic
tatggtattcattataggagt

SEQ ID NO: 9278 - DNA, 21 bp, Artificial Sequence
  Synthetic
ttggtgcaggtgcataagcat

SEQ ID NO: 9279 - DNA, 21 bp, Artificial Sequence
  Synthetic
gcgggtgtgcgtgtggagcgg

SEQ ID NO: 9280 - DNA, 21 bp, Artificial Sequence
  Synthetic
tgtgctaatcataagaatact

SEQ ID NO: 9281 - DNA, 21 bp, Artificial Sequence
  Synthetic
gggcctcagaagagtgtgtat

SEQ ID NO: 9282 - DNA, 21 bp, Artificial Sequence
  Synthetic
gggggttcgacgcggggttct

SEQ ID NO: 9283 - DNA, 21 bp, Artificial Sequence
  Synthetic
gctgcgcatgttgttgcggtg

SEQ ID NO: 9284 - DNA, 21 bp, Artificial Sequence
  Synthetic
acggtgcgtacgtcggtttat

SEQ ID NO: 9285 - DNA, 21 bp, Artificial Sequence
  Synthetic
aaggagttgcatagggggaat

SEQ ID NO: 9286 - DNA, 21 bp, Artificial Sequence
  Synthetic
gcgccgtggactcagaatggt

SEQ ID NO: 9287 - DNA, 21 bp, Artificial Sequence
  Synthetic
attcatcagcctactgttagg

SEQ ID NO: 9288 - DNA, 21 bp, Artificial Sequence
  Synthetic
aattctggtggtgcgttgcgg

SEQ ID NO: 9289 - DNA, 21 bp, Artificial Sequence
  Synthetic
agggatttgccgcaggttcgt

SEQ ID NO: 9290 - DNA, 21 bp, Artificial Sequence
  Synthetic
gggccttcggggttggggcgt

SEQ ID NO: 9291 - DNA, 21 bp, Artificial Sequence
  Synthetic
aagaattttcatgctcctctg

SEQ ID NO: 9292 - DNA, 21 bp, Artificial Sequence
  Synthetic
acgaaggttggttatatgaat

SEQ ID NO: 9293 - DNA, 21 bp, Artificial Sequence
  Synthetic
atggagtttaagcttcctctg

SEQ ID NO: 9294 - DNA, 21 bp, Artificial Sequence
  Synthetic
ggtctgtggaagggtgctaat

SEQ ID NO: 9295 - DNA, 21 bp, Artificial Sequence
  Synthetic
gcgcgttggtctggttctgat

SEQ ID NO: 9296 - DNA, 21 bp, Artificial Sequence
  Synthetic
ggtgggggtgcggggaggctt

SEQ ID NO: 9297 - DNA, 21 bp, Artificial Sequence
  Synthetic
cgtcctcattcggctatgctt

SEQ ID NO: 9298 - DNA, 21 bp, Artificial Sequence
  Synthetic
cgtcaggggacttttgagaag

SEQ ID NO: 9299 - DNA, 21 bp, Artificial Sequence
  Synthetic
catcgtgatcttcgtggtaat

SEQ ID NO: 9300 - DNA, 21 bp, Artificial Sequence
  Synthetic
cctcggatggggccgcatgct

SEQ ID NO: 9301 - DNA, 21 bp, Artificial Sequence
  Synthetic
cttaggaatttggatgcgaag

SEQ ID NO: 9302 - DNA, 21 bp, Artificial Sequence
  Synthetic
cgtgatgatcgtctgggtcgg

SEQ ID NO: 9303 - DNA, 21 bp, Artificial Sequence
  Synthetic
cgtgctagtggtcaggataag

SEQ ID NO: 9304 - DNA, 21 bp, Artificial Sequence
  Synthetic
aatcagatgccgactttgcgt

SEQ ID NO: 9305 - DNA, 21 bp, Artificial Sequence
  Synthetic
aggcttactattgaggggagg

SEQ ID NO: 9306 - DNA, 21 bp, Artificial Sequence
  Synthetic
ttgaagcatacggatgggcgt

SEQ ID NO: 9307 - DNA, 21 bp, Artificial Sequence
  Synthetic
atggttaagcatggtggtagt

SEQ ID NO: 9308 - DNA, 21 bp, Artificial Sequence
  Synthetic
tggattagggctaattctgag

SEQ ID NO: 9309 - DNA, 21 bp, Artificial Sequence
  Synthetic
gttggtcctggtcgttctgtt

SEQ ID NO: 9310 - DNA, 21 bp, Artificial Sequence
  Synthetic
catcttaggttttctattgag

SEQ ID NO: 9311 - DNA, 21 bp, Artificial Sequence
  Synthetic
tggtcgagggcgtttgaggcg

SEQ ID NO: 9312 - DNA, 21 bp, Artificial Sequence
  Synthetic
tcggagctgcctgtgtttagt

SEQ ID NO: 9313 - DNA, 21 bp, Artificial Sequence
  Synthetic
cgtttgaagcttgagatgggg

SEQ ID NO: 9314 - DNA, 21 bp, Artificial Sequence
  Synthetic
aatgcgttgactattgttggt

SEQ ID NO: 9315 - DNA, 21 bp, Artificial Sequence
  Synthetic
gagggggtttctggttctatt

SEQ ID NO: 9316 - DNA, 21 bp, Artificial Sequence
  Synthetic
ctgattgctcagcatgtggag

SEQ ID NO: 9317 - DNA, 21 bp, Artificial Sequence
  Synthetic
gtgcatcttgcgctgaatgct

SEQ ID NO: 9318 - DNA, 21 bp, Artificial Sequence
  Synthetic
ttgggtgggcgtgtgattgtt

SEQ ID NO: 9319 - DNA, 21 bp, Artificial Sequence
  Synthetic
gttacgaaggggattattttt

SEQ ID NO: 9320 - DNA, 21 bp, Artificial Sequence
  Synthetic
cttgttgctaatgataagttt

SEQ ID NO: 9321 - DNA, 21 bp, Artificial Sequence
  Synthetic
gcggatgctcggtctggttgg

SEQ ID NO: 9322 - DNA, 21 bp, Artificial Sequence
  Synthetic
tcgtcggggcatctgactgtg

SEQ ID NO: 9323 - DNA, 21 bp, Artificial Sequence
  Synthetic
tgttctacgtctgttgttgtt

SEQ ID NO: 9324 - DNA, 21 bp, Artificial Sequence
  Synthetic
gataagggttatgggagtttg

SEQ ID NO: 9325 - DNA, 21 bp, Artificial Sequence
  Synthetic
atggttcttggtcgttcggcg

SEQ ID NO: 9326 - DNA, 21 bp, Artificial Sequence
  Synthetic
ttgcatgctaggggtatggtg

SEQ ID NO: 9327 - DNA, 21 bp, Artificial Sequence
  Synthetic
ttgggtcggactgcgtgtact

SEQ ID NO: 9328 - DNA, 21 bp, Artificial Sequence
  Synthetic
tcggctggggcgaagcatcag

SEQ ID NO: 9329 - DNA, 21 bp, Artificial Sequence
  Synthetic
cgtcatgttacgcatgatcat

SEQ ID NO: 9330 - DNA, 21 bp, Artificial Sequence
  Synthetic
gttcatggggcggcgcttaag

SEQ ID NO: 9331 - DNA, 21 bp, Artificial Sequence
  Synthetic
tcgagggggagtagtagttgt

SEQ ID NO: 9332 - DNA, 21 bp, Artificial Sequence
  Synthetic
aggtggaatgttgttaatgag

SEQ ID NO: 9333 - DNA, 21 bp, Artificial Sequence
  Synthetic
cgtagtggggtggatggtcgg

SEQ ID NO: 9334 - DNA, 21 bp, Artificial Sequence
  Synthetic
cagcatgcgatggttcgtaat

SEQ ID NO: 9335 - DNA, 21 bp, Artificial Sequence
  Synthetic
cgtgagactattgctcggcat

SEQ ID NO: 9336 - DNA, 21 bp, Artificial Sequence
  Synthetic
cttcgggcgcatggggtttcg

SEQ ID NO: 9337 - DNA, 21 bp, Artificial Sequence
  Synthetic
actgcgtgggcggctaagggg

SEQ ID NO: 9338 - DNA, 21 bp, Artificial Sequence
  Synthetic
catcgtactgttgttgggact

SEQ ID NO: 9339 - DNA, 21 bp, Artificial Sequence
  Synthetic
catgagattgctgctggttgg

SEQ ID NO: 9340 - DNA, 21 bp, Artificial Sequence
  Synthetic
attagtcgtcagttgtctggt

SEQ ID NO: 9341 - DNA, 21 bp, Artificial Sequence
  Synthetic
cggggtatgtcgcagaaggag

SEQ ID NO: 9342 - DNA, 21 bp, Artificial Sequence
  Synthetic
gagcgggcggtttcttcgaag

SEQ ID NO: 9343 - DNA, 21 bp, Artificial Sequence
  Synthetic
tatagtggtagtcagtatctg

SEQ ID NO: 9344 - DNA, 21 bp, Artificial Sequence
  Synthetic
agtgcgcagacttctggttgg

SEQ ID NO: 9345 - DNA, 21 bp, Artificial Sequence
  Synthetic
ttgcgggatccgtttccgggt

SEQ ID NO: 9346 - DNA, 21 bp, Artificial Sequence
  Synthetic
aaggaggttcatcaggttagg

SEQ ID NO: 9347 - DNA, 21 bp, Artificial Sequence
  Synthetic
gtgaatggtaaggtgggtccg

SEQ ID NO: 9348 - DNA, 21 bp, Artificial Sequence
  Synthetic
ctgcataatggggggcggctt

SEQ ID NO: 9349 - DNA, 21 bp, Artificial Sequence
  Synthetic
aggatgcagagggctggggag

SEQ ID NO: 9350 - DNA, 21 bp, Artificial Sequence
  Synthetic
ggtgagtggtctcggggttgt

SEQ ID NO: 9351 - DNA, 21 bp, Artificial Sequence
  Synthetic
aatgcgtatgtgtcgaaggtg

SEQ ID NO: 9352 - DNA, 21 bp, Artificial Sequence
  Synthetic
cagagtagtaatcctatgagg

SEQ ID NO: 9353 - DNA, 21 bp, Artificial Sequence
  Synthetic
cgtaggatggataatctgttg

SEQ ID NO: 9354 - DNA, 21 bp, Artificial Sequence
  Synthetic
gggggtcatgctggtcgtgtt

SEQ ID NO: 9355 - DNA, 21 bp, Artificial Sequence
  Synthetic
ttggggcctgtgttgccgagg

SEQ ID NO: 9356 - DNA, 21 bp, Artificial Sequence
  Synthetic
aatacggggcagcaggggcgg

SEQ ID NO: 9357 - DNA, 21 bp, Artificial Sequence
  Synthetic
cggttgaataagaatgatttt

SEQ ID NO: 9358 - DNA, 21 bp, Artificial Sequence
  Synthetic
tgtgagaagcggcagcgggag

SEQ ID NO: 9359 - DNA, 21 bp, Artificial Sequence
  Synthetic
cgtttggcgcgggagttgatt

SEQ ID NO: 9360 - DNA, 21 bp, Artificial Sequence
  Synthetic
cgtagggagcctgagtttaag

SEQ ID NO: 9361 - DNA, 21 bp, Artificial Sequence
  Synthetic
tgggctggggctgtggtgcgt

SEQ ID NO: 9362 - DNA, 21 bp, Artificial Sequence
  Synthetic
gcggatcaggttcgtaagctt

SEQ ID NO: 9363 - DNA, 21 bp, Artificial Sequence
  Synthetic
gtttggcgtccgaaggatgtg

SEQ ID NO: 9364 - DNA, 21 bp, Artificial Sequence
  Synthetic
tggggggatgcgaagggtcgt

SEQ ID NO: 9365 - DNA, 21 bp, Artificial Sequence
  Synthetic
attaaggggaatcatgttttt

SEQ ID NO: 9366 - DNA, 21 bp, Artificial Sequence
  Synthetic
agggttttggatggggctagg

SEQ ID NO: 9367 - DNA, 21 bp, Artificial Sequence
  Synthetic
gagcgtgcgatttcgtctagg

SEQ ID NO: 9368 - DNA, 21 bp, Artificial Sequence
  Synthetic
ggtcgtatgagggaggagtgg

SEQ ID NO: 9369 - DNA, 21 bp, Artificial Sequence
  Synthetic
tatagtcgtaatacgtctcag

SEQ ID NO: 9370 - DNA, 21 bp, Artificial Sequence
  Synthetic
aatgatcctcgtcgtagtatg

SEQ ID NO: 9371 - DNA, 21 bp, Artificial Sequence
  Synthetic
catattcatctgaatattggg

SEQ ID NO: 9372 - DNA, 21 bp, Artificial Sequence
  Synthetic
aggagggagccttctcataat

SEQ ID NO: 9373 - DNA, 21 bp, Artificial Sequence
  Synthetic
tctgggactcgtcttgctagt

SEQ ID NO: 9374 - DNA, 21 bp, Artificial Sequence
  Synthetic
aataagaagtgggaggatacg

SEQ ID NO: 9375 - DNA, 21 bp, Artificial Sequence
  Synthetic
atttcgctgcgtggtgatcgg

SEQ ID NO: 9376 - DNA, 21 bp, Artificial Sequence
  Synthetic
agtgagcagtatgttcgtggt

SEQ ID NO: 9377 - DNA, 21 bp, Artificial Sequence
  Synthetic
cagcatgtgggtgctgcgagg

SEQ ID NO: 9378 - DNA, 21 bp, Artificial Sequence
  Synthetic
agtctggcggctcatagggct

SEQ ID NO: 9379 - DNA, 21 bp, Artificial Sequence
  Synthetic
cctctgaggcatgatagtacg

SEQ ID NO: 9380 - DNA, 21 bp, Artificial Sequence
  Synthetic
cgggggaatctgaatcatacg

SEQ ID NO: 9381 - DNA, 21 bp, Artificial Sequence
  Synthetic
ggttatccgcataagacgtgt

SEQ ID NO: 9382 - DNA, 21 bp, Artificial Sequence
  Synthetic
ggtgcgcatgtgcaggggcgt

SEQ ID NO: 9383 - DNA, 21 bp, Artificial Sequence
  Synthetic
catcgggtggatattttgagg

SEQ ID NO: 9384 - DNA, 21 bp, Artificial Sequence
  Synthetic
cttttgaaggggtctgtgatt

SEQ ID NO: 9385 - DNA, 21 bp, Artificial Sequence
  Synthetic
catgtggcggttaatttgcgg

SEQ ID NO: 9386 - DNA, 21 bp, Artificial Sequence
  Synthetic
ggggagaagaatcatggtgct

SEQ ID NO: 9387 - DNA, 21 bp, Artificial Sequence
  Synthetic
aatcatgtttctagttatgag

SEQ ID NO: 9388 - DNA, 21 bp, Artificial Sequence
  Synthetic
gggcatgcggggttgattcgt

SEQ ID NO: 9389 - DNA, 21 bp, Artificial Sequence
  Synthetic
gagaaggctgttgttgtgaag

SEQ ID NO: 9390 - DNA, 21 bp, Artificial Sequence
  Synthetic
ctttgggctgtgaggtcggag

SEQ ID NO: 9391 - DNA, 21 bp, Artificial Sequence
  Synthetic
aaggtgattaatgaggtgagg

SEQ ID NO: 9392 - DNA, 21 bp, Artificial Sequence
  Synthetic
cgtatgggtgatcggactctg

SEQ ID NO: 9393 - DNA, 21 bp, Artificial Sequence
  Synthetic
gctcctattcgtttgagtcat

SEQ ID NO: 9394 - DNA, 21 bp, Artificial Sequence
  Synthetic
catatgaaggtggatatgagg

SEQ ID NO: 9395 - DNA, 21 bp, Artificial Sequence
  Synthetic
gttcctcataatccttttaag

SEQ ID NO: 9396 - DNA, 21 bp, Artificial Sequence
  Synthetic
agggggggtcctcatgttttg

SEQ ID NO: 9397 - DNA, 21 bp, Artificial Sequence
  Synthetic
cataggggtattcctggggtg

SEQ ID NO: 9398 - DNA, 21 bp, Artificial Sequence
  Synthetic
agtaataatcgtacggagcgg

SEQ ID NO: 9399 - DNA, 21 bp, Artificial Sequence
  Synthetic
catgctcagccggttcagcgg

SEQ ID NO: 9400 - DNA, 21 bp, Artificial Sequence
  Synthetic
cgttatagtcctggtcctaat

SEQ ID NO: 9401 - DNA, 21 bp, Artificial Sequence
  Synthetic
ggggggcttgcgcagggtcgt

SEQ ID NO: 9402 - DNA, 21 bp, Artificial Sequence
  Synthetic
cgggtggggaagagtgattgg

SEQ ID NO: 9403 - DNA, 21 bp, Artificial Sequence
  Synthetic
gtgcagaatcgtcctgctttt

SEQ ID NO: 9404 - DNA, 21 bp, Artificial Sequence
  Synthetic
gctgttgagcatcgggctggt

SEQ ID NO: 9405 - DNA, 21 bp, Artificial Sequence
  Synthetic
acgaatgtggttgggcagcat

SEQ ID NO: 9406 - DNA, 21 bp, Artificial Sequence
  Synthetic
tctgggattcagagtgtgcgt

SEQ ID NO: 9407 - DNA, 21 bp, Artificial Sequence
  Synthetic
gtgcagctgagggagacgagg

SEQ ID NO: 9408 - DNA, 21 bp, Artificial Sequence
  Synthetic
cgtgctgcgattggggttacg

SEQ ID NO: 9409 - DNA, 21 bp, Artificial Sequence
  Synthetic
catctttctgctcgtattgcg

SEQ ID NO: 9410 - DNA, 21 bp, Artificial Sequence
  Synthetic
aataaggtggatgttggtcgg

SEQ ID NO: 9411 - DNA, 21 bp, Artificial Sequence
  Synthetic
tgggggcgggaggctaagggt

SEQ ID NO: 9412 - DNA, 21 bp, Artificial Sequence
  Synthetic
gtgtttccgagggggcttgtg

SEQ ID NO: 9413 - DNA, 21 bp, Artificial Sequence
  Synthetic
tatgctccgttttggacggct

SEQ ID NO: 9414 - DNA, 21 bp, Artificial Sequence
  Synthetic
tctattgtgaatggtcgtggt

SEQ ID NO: 9415 - DNA, 21 bp, Artificial Sequence
  Synthetic
agggagccgggtaatgttaag

SEQ ID NO: 9416 - DNA, 21 bp, Artificial Sequence
  Synthetic
ggttctattggtacgaagagt

SEQ ID NO: 9417 - DNA, 21 bp, Artificial Sequence
  Synthetic
ttgcggagtgatgctagtaat

SEQ ID NO: 9418 - DNA, 21 bp, Artificial Sequence
  Synthetic
aggggggattctattatgcgg

SEQ ID NO: 9419 - DNA, 21 bp, Artificial Sequence
  Synthetic
aaggttcgtctggagcatggt

SEQ ID NO: 9420 - DNA, 21 bp, Artificial Sequence
  Synthetic
gatgggggtaggactatgtgg

SEQ ID NO: 9421 - DNA, 21 bp, Artificial Sequence
  Synthetic
ggtaaggatcttcatcctgtg

SEQ ID NO: 9422 - DNA, 21 bp, Artificial Sequence
  Synthetic
atggttcggcagttgtcggct

SEQ ID NO: 9423 - DNA, 21 bp, Artificial Sequence
  Synthetic
aagtcttcgttttgtgagagt

SEQ ID NO: 9424 - DNA, 21 bp, Artificial Sequence
  Synthetic
gggaatctgttgtctccttcg

SEQ ID NO: 9425 - DNA, 21 bp, Artificial Sequence
  Synthetic
aggcatgttgggcatgctggg

SEQ ID NO: 9426 - DNA, 21 bp, Artificial Sequence
  Synthetic
gttgcgcgtgatcgttcgatg

SEQ ID NO: 9427 - DNA, 21 bp, Artificial Sequence
  Synthetic
aggcataatcctttgacgttt

SEQ ID NO: 9428 - DNA, 21 bp, Artificial Sequence
  Synthetic
gcgcggctggttgagggtagg

SEQ ID NO: 9429 - DNA, 21 bp, Artificial Sequence
  Synthetic
gttctgcatacgcttgatgat

SEQ ID NO: 9430 - DNA, 21 bp, Artificial Sequence
  Synthetic
tcgattgttactgcgaatatg

SEQ ID NO: 9431 - DNA, 21 bp, Artificial Sequence
  Synthetic
actaggactaaggatgtgggt

SEQ ID NO: 9432 - DNA, 21 bp, Artificial Sequence
  Synthetic
aaggctatgtcttatgggcat

SEQ ID NO: 9433 - DNA, 21 bp, Artificial Sequence
  Synthetic
gggtggagggggaatgagcat

SEQ ID NO: 9434 - DNA, 21 bp, Artificial Sequence
  Synthetic
acgaagggtcttctgactgag

SEQ ID NO: 9435 - DNA, 21 bp, Artificial Sequence
  Synthetic
ctgcggattccgctggatcgg

SEQ ID NO: 9436 - DNA, 21 bp, Artificial Sequence
  Synthetic
tggaagggtcagcgtgatggt

SEQ ID NO: 9437 - DNA, 21 bp, Artificial Sequence
  Synthetic
cattcgaagagtcttttgcat

SEQ ID NO: 9438 - DNA, 21 bp, Artificial Sequence
  Synthetic
aatcgtgagaatatgcatagg

SEQ ID NO: 9439 - DNA, 21 bp, Artificial Sequence
  Synthetic
gatagggatctggttcgtact

SEQ ID NO: 9440 - DNA, 21 bp, Artificial Sequence
  Synthetic
cttccggggtcggttcagagg

SEQ ID NO: 9441 - DNA, 21 bp, Artificial Sequence
  Synthetic
gtggttcgtgggcctaataat

SEQ ID NO: 9442 - DNA, 21 bp, Artificial Sequence
  Synthetic
ggttcggtgaatgtgcttcgt

SEQ ID NO: 9443 - DNA, 21 bp, Artificial Sequence
  Synthetic
gggtctggtagtaaggattgg

SEQ ID NO: 9444 - DNA, 21 bp, Artificial Sequence
  Synthetic
tggagtgattttaagcatgtt

SEQ ID NO: 9445 - DNA, 21 bp, Artificial Sequence
  Synthetic
ggtggtgctaatcattatcat

SEQ ID NO: 9446 - DNA, 21 bp, Artificial Sequence
  Synthetic
ggtcgtaatgatgctcatctg

SEQ ID NO: 9447 - DNA, 21 bp, Artificial Sequence
  Synthetic
cataaggcgtctggtaggcct

SEQ ID NO: 9448 - DNA, 21 bp, Artificial Sequence
  Synthetic
ttggcgcagcatttgggtcgt

SEQ ID NO: 9449 - DNA, 21 bp, Artificial Sequence
  Synthetic
ggtctgaagaattggacgagt

SEQ ID NO: 9450 - DNA, 21 bp, Artificial Sequence
  Synthetic
cagccgcagaggccttttgtt

SEQ ID NO: 9451 - DNA, 21 bp, Artificial Sequence
  Synthetic
tttctggtgcggtcggttgcg

SEQ ID NO: 9452 - DNA, 21 bp, Artificial Sequence
  Synthetic
cgttatacggagtcgctgaag

SEQ ID NO: 9453 - DNA, 21 bp, Artificial Sequence
  Synthetic
tttgcgcagcggattgtgcat

SEQ ID NO: 9454 - DNA, 21 bp, Artificial Sequence
  Synthetic
ggggggaggttggttgctgtt

SEQ ID NO: 9455 - DNA, 21 bp, Artificial Sequence
  Synthetic
ttgggttctaggcttggttat

SEQ ID NO: 9456 - DNA, 21 bp, Artificial Sequence
  Synthetic
agggttgatatgccttttcag

SEQ ID NO: 9457 - DNA, 21 bp, Artificial Sequence
  Synthetic
aggcaggagaggccgtttctt

SEQ ID NO: 9458 - DNA, 21 bp, Artificial Sequence
  Synthetic
tttaatcagatttgggctgcg

SEQ ID NO: 9459 - DNA, 21 bp, Artificial Sequence
  Synthetic
atgcataagattcttgcggtg

SEQ ID NO: 9460 - DNA, 21 bp, Artificial Sequence
  Synthetic
tatagggatcgtggtcagggt

SEQ ID NO: 9461 - DNA, 21 bp, Artificial Sequence
  Synthetic
cagaatgctctgagtagtggt

SEQ ID NO: 9462 - DNA, 21 bp, Artificial Sequence
  Synthetic
catcgggcggagcctaagctg

SEQ ID NO: 9463 - DNA, 21 bp, Artificial Sequence
  Synthetic
ccgaagttggtgaatattttt

SEQ ID NO: 9464 - DNA, 21 bp, Artificial Sequence
  Synthetic
gagctgcggggtcggatgtcg

SEQ ID NO: 9465 - DNA, 21 bp, Artificial Sequence
  Synthetic
aggaagcctgatccgcatgtg

SEQ ID NO: 9466 - DNA, 21 bp, Artificial Sequence
  Synthetic
ttgctgttgcatcaggttaag

SEQ ID NO: 9467 - DNA, 21 bp, Artificial Sequence
  Synthetic
aattctgggattcatttgagg

SEQ ID NO: 9468 - DNA, 21 bp, Artificial Sequence
  Synthetic
catgagaagatgagtgctcgt

SEQ ID NO: 9469 - DNA, 21 bp, Artificial Sequence
  Synthetic
aagagtggtgttgagtatagg

SEQ ID NO: 9470 - DNA, 21 bp, Artificial Sequence
  Synthetic
tatcatgctgggcggccgggt

SEQ ID NO: 9471 - DNA, 21 bp, Artificial Sequence
  Synthetic
attcgtatggctgattcgcgg

SEQ ID NO: 9472 - DNA, 21 bp, Artificial Sequence
  Synthetic
aagtgggggggtagttctgct

SEQ ID NO: 9473 - DNA, 21 bp, Artificial Sequence
  Synthetic
ggtcgggggatgaattcttgt

SEQ ID NO: 9474 - DNA, 21 bp, Artificial Sequence
  Synthetic
ttgcataatgtgggtgctcgg

SEQ ID NO: 9475 - DNA, 21 bp, Artificial Sequence
  Synthetic
tggtttcctggtggggctagt

SEQ ID NO: 9476 - DNA, 21 bp, Artificial Sequence
  Synthetic
ggtggggatcgttgggcttat

SEQ ID NO: 9477 - DNA, 21 bp, Artificial Sequence
  Synthetic
acgcatcgggctatggtggct

SEQ ID NO: 9478 - DNA, 21 bp, Artificial Sequence
  Synthetic
gaggattttgttcgtgatctt

SEQ ID NO: 9479 - DNA, 21 bp, Artificial Sequence
  Synthetic
gcgagtttgcggcttgatatt

SEQ ID NO: 9480 - DNA, 21 bp, Artificial Sequence
  Synthetic
cttattcagactacgtcgtgg

SEQ ID NO: 9481 - DNA, 21 bp, Artificial Sequence
  Synthetic
gattctccgagggagcatcgt

SEQ ID NO: 9482 - DNA, 21 bp, Artificial Sequence
  Synthetic
ctgtggagggatgctgatttt

SEQ ID NO: 9483 - DNA, 21 bp, Artificial Sequence
  Synthetic
attgggcgtgatgctcagcgg

SEQ ID NO: 9484 - DNA, 21 bp, Artificial Sequence
  Synthetic
cggtttgcggctctgccgatt

SEQ ID NO: 9485 - DNA, 21 bp, Artificial Sequence
  Synthetic
attcctactgttgctatgagg

SEQ ID NO: 9486 - DNA, 21 bp, Artificial Sequence
  Synthetic
aatcctaagtgggatgcttat

SEQ ID NO: 9487 - DNA, 21 bp, Artificial Sequence
  Synthetic
cgggctcagcctggggggtgg

SEQ ID NO: 9488 - DNA, 21 bp, Artificial Sequence
  Synthetic
aggcagtcgcgggcggatggt

SEQ ID NO: 9489 - DNA, 21 bp, Artificial Sequence
  Synthetic
agtccgagggtgactggtcat

SEQ ID NO: 9490 - DNA, 21 bp, Artificial Sequence
  Synthetic
tctaggcagatgtatagtggt

SEQ ID NO: 9491 - DNA, 21 bp, Artificial Sequence
  Synthetic
gctgggcatgttggtcgggct

SEQ ID NO: 9492 - DNA, 21 bp, Artificial Sequence
  Synthetic
gctagggagccggcgagtagg

SEQ ID NO: 9493 - DNA, 21 bp, Artificial Sequence
  Synthetic
cgtgcgccgttttttacggat

SEQ ID NO: 9494 - DNA, 21 bp, Artificial Sequence
  Synthetic
gattggggtagtacgctggat

SEQ ID NO: 9495 - DNA, 21 bp, Artificial Sequence
  Synthetic
gtgagggggtctatggcgatg

SEQ ID NO: 9496 - DNA, 21 bp, Artificial Sequence
  Synthetic
caggaggatcggcgggggcat

SEQ ID NO: 9497 - DNA, 21 bp, Artificial Sequence
  Synthetic
actcatagggctcctagtggg

SEQ ID NO: 9498 - DNA, 21 bp, Artificial Sequence
  Synthetic
aggcaggggaggatggagact

SEQ ID NO: 9499 - DNA, 21 bp, Artificial Sequence
  Synthetic
cctcgttcttctggtgggggt

SEQ ID NO: 9500 - DNA, 21 bp, Artificial Sequence
  Synthetic
gatcttaagcagaatggtcgg

SEQ ID NO: 9501 - DNA, 21 bp, Artificial Sequence
  Synthetic
aatgctcgtgaggctgggaag

SEQ ID NO: 9502 - DNA, 21 bp, Artificial Sequence
  Synthetic
tgtaagagttgtgagccttct

SEQ ID NO: 9503 - DNA, 21 bp, Artificial Sequence
  Synthetic
gggttggggcgtgaggggagg

SEQ ID NO: 9504 - DNA, 21 bp, Artificial Sequence
  Synthetic
ggtgctcgtaaggtggagggg

SEQ ID NO: 9505 - DNA, 21 bp, Artificial Sequence
  Synthetic
cgtgggcatggtaatgcgggg

SEQ ID NO: 9506 - DNA, 21 bp, Artificial Sequence
  Synthetic
cgttctgaggttagtggtaag

SEQ ID NO: 9507 - DNA, 21 bp, Artificial Sequence
  Synthetic
tgggtggttaaggggtctgct

SEQ ID NO: 9508 - DNA, 21 bp, Artificial Sequence
  Synthetic
aattcttttaagaatttgctt

SEQ ID NO: 9509 - DNA, 21 bp, Artificial Sequence
  Synthetic
atgacttctttggggaatcgg

SEQ ID NO: 9510 - DNA, 21 bp, Artificial Sequence
  Synthetic
cggccgacggggcatgcgttg

SEQ ID NO: 9511 - DNA, 21 bp, Artificial Sequence
  Synthetic
aggcattcgattgctgagttt

SEQ ID NO: 9512 - DNA, 21 bp, Artificial Sequence
  Synthetic
cggcggctggcggatgagctg

SEQ ID NO: 9513 - DNA, 21 bp, Artificial Sequence
  Synthetic
gctaagtcttttgtttcgatt

SEQ ID NO: 9514 - DNA, 21 bp, Artificial Sequence
  Synthetic
cgggtgctgagtgaggagaag

SEQ ID NO: 9515 - DNA, 21 bp, Artificial Sequence
  Synthetic
catgggaagggggttaatggt

SEQ ID NO: 9516 - DNA, 21 bp, Artificial Sequence
  Synthetic
tttaagaatggtagtcatgtg

SEQ ID NO: 9517 - DNA, 21 bp, Artificial Sequence
  Synthetic
ttggagaggtctggtttgcgt

SEQ ID NO: 9518 - DNA, 21 bp, Artificial Sequence
  Synthetic
catgagaggaggccggggcct

SEQ ID NO: 9519 - DNA, 21 bp, Artificial Sequence
  Synthetic
ggtgggccggggctggttcgt

SEQ ID NO: 9520 - DNA, 21 bp, Artificial Sequence
  Synthetic
cttgctgttattccggtgccg

SEQ ID NO: 9521 - DNA, 21 bp, Artificial Sequence
  Synthetic
tgtcaggctgctcgtcttggg

SEQ ID NO: 9522 - DNA, 21 bp, Artificial Sequence
  Synthetic
tctatggatcgggtttttttg

SEQ ID NO: 9523 - DNA, 21 bp, Artificial Sequence
  Synthetic
ggtgctcttccgatgactcct

SEQ ID NO: 9524 - DNA, 21 bp, Artificial Sequence
  Synthetic
agtcctcggacgccttttgtt

SEQ ID NO: 9525 - DNA, 21 bp, Artificial Sequence
  Synthetic
gtgggtaatattcttgtgagg

SEQ ID NO: 9526 - DNA, 21 bp, Artificial Sequence
  Synthetic
actgctattgagcggaagcat

SEQ ID NO: 9527 - DNA, 21 bp, Artificial Sequence
  Synthetic
gcggcggggaatgttaagcat

SEQ ID NO: 9528 - DNA, 21 bp, Artificial Sequence
  Synthetic
cgtgcggggacttcgcatcct

SEQ ID NO: 9529 - DNA, 21 bp, Artificial Sequence
  Synthetic
gtgcaggggaatccggggagg

SEQ ID NO: 9530 - DNA, 21 bp, Artificial Sequence
  Synthetic
gggagggttcttgggcctcat

SEQ ID NO: 9531 - DNA, 21 bp, Artificial Sequence
  Synthetic
ctgatgcgtccgactttgcat

SEQ ID NO: 9532 - DNA, 21 bp, Artificial Sequence
  Synthetic
ggttcgcggctgcatgttggg

SEQ ID NO: 9533 - DNA, 21 bp, Artificial Sequence
  Synthetic
tggagtcctgctaatgctagg

SEQ ID NO: 9534 - DNA, 21 bp, Artificial Sequence
  Synthetic
aagactcagactaatacgtgg

SEQ ID NO: 9535 - DNA, 21 bp, Artificial Sequence
  Synthetic
ctgaggttgatgcatactggg

SEQ ID NO: 9536 - DNA, 21 bp, Artificial Sequence
  Synthetic
gaggctatgagggctacgatg

SEQ ID NO: 9537 - DNA, 21 bp, Artificial Sequence
  Synthetic
agtctgaggacggttcagtat

SEQ ID NO: 9538 - DNA, 21 bp, Artificial Sequence
  Synthetic
aagaggtttgatggtttgggt

SEQ ID NO: 9539 - DNA, 21 bp, Artificial Sequence
  Synthetic
gcttttcttcgggggggtgtg

SEQ ID NO: 9540 - DNA, 21 bp, Artificial Sequence
  Synthetic
atttatttggcttctaatgtt

SEQ ID NO: 9541 - DNA, 21 bp, Artificial Sequence
  Synthetic
atgggggcgagtacgtatttg

SEQ ID NO: 9542 - DNA, 21 bp, Artificial Sequence
  Synthetic
cataaggcgtcttatctggct

SEQ ID NO: 9543 - DNA, 21 bp, Artificial Sequence
  Synthetic
gtggttcatactgggtttaag

SEQ ID NO: 9544 - DNA, 21 bp, Artificial Sequence
  Synthetic
agttttggtcaggtggcggcg

SEQ ID NO: 9545 - DNA, 21 bp, Artificial Sequence
  Synthetic
ttgcatcatagttctgagctt

SEQ ID NO: 9546 - DNA, 21 bp, Artificial Sequence
  Synthetic
caggctgggcagttgactggg

SEQ ID NO: 9547 - DNA, 21 bp, Artificial Sequence
  Synthetic
gagactggtcgttggcatgcg

SEQ ID NO: 9548 - protein, 7 aa, Artificial Sequence
  Synthetic
FTLKEPK

SEQ ID NO: 9549 - protein, 7 aa, Artificial Sequence
  Synthetic
FTAVGPK

SEQ ID NO: 9550 - protein, 7 aa, Artificial Sequence
  Synthetic
FTTLYPK

SEQ ID NO: 9551 - protein, 7 aa, Artificial Sequence
  Synthetic
FTLAAPK

SEQ ID NO: 9552 - protein, 7 aa, Artificial Sequence
  Synthetic
FTVAYPK

SEQ ID NO: 9553 - protein, 7 aa, Artificial Sequence
  Synthetic
FTMSGPK

SEQ ID NO: 9554 - protein, 7 aa, Artificial Sequence
  Synthetic
SPSLPFR

SEQ ID NO: 9555 - protein, 7 aa, Artificial Sequence
  Synthetic
SDVMPFR

SEQ ID NO: 9556 - protein, 7 aa, Artificial Sequence
  Synthetic
SVDNPFR

SEQ ID NO: 9557 - protein, 7 aa, Artificial Sequence
  Synthetic
GPQMPFR

SEQ ID NO: 9558 - protein, 7 aa, Artificial Sequence
  Synthetic
SAETPFR

SEQ ID NO: 9559 - protein, 7 aa, Artificial Sequence
  Synthetic
STTTPFR

SEQ ID NO: 9560 - protein, 7 aa, Artificial Sequence
  Synthetic
LDPIPFK

SEQ ID NO: 9561 - protein, 7 aa, Artificial Sequence
  Synthetic
TMTSPFR

SEQ ID NO: 9562 - protein, 7 aa, Artificial Sequence
  Synthetic
TSSTPFR

SEQ ID NO: 9563 - protein, 7 aa, Artificial Sequence
  Synthetic
VSNMPFR

SEQ ID NO: 9564 - protein, 7 aa, Artificial Sequence
  Synthetic
LLSAPFR

SEQ ID NO: 9565 - protein, 7 aa, Artificial Sequence
  Synthetic
SLNVPFR

SEQ ID NO: 9566 - protein, 7 aa, Artificial Sequence
  Synthetic
TAASPFR

SEQ ID NO: 9567 - protein, 7 aa, Artificial Sequence
  Synthetic
SLQTPFK

SEQ ID NO: 9568 - protein, 7 aa, Artificial Sequence
  Synthetic
VEPLPFR

SEQ ID NO: 9569 - protein, 7 aa, Artificial Sequence
  Synthetic
SVLQPFR

SEQ ID NO: 9570 - protein, 7 aa, Artificial Sequence
  Synthetic
LPEAPFR

SEQ ID NO: 9571 - protein, 7 aa, Artificial Sequence
  Synthetic
TPSSPFR

SEQ ID NO: 9572 - protein, 7 aa, Artificial Sequence
  Synthetic
SVSLPFR

SEQ ID NO: 9573 - protein, 7 aa, Artificial Sequence
  Synthetic
SAGTPFR

SEQ ID NO: 9574 - protein, 7 aa, Artificial Sequence
  Synthetic
TTALPFR

SEQ ID NO: 9575 - protein, 7 aa, Artificial Sequence
  Synthetic
IGSLPFR

SEQ ID NO: 9576 - protein, 7 aa, Artificial Sequence
  Synthetic
FGDSPFR

SEQ ID NO: 9577 - protein, 7 aa, Artificial Sequence
  Synthetic
TPQVPFK

SEQ ID NO: 9578 - protein, 7 aa, Artificial Sequence
  Synthetic
TTVAPFR

SEQ ID NO: 9579 - protein, 7 aa, Artificial Sequence
  Synthetic
SVNNPFK

SEQ ID NO: 9580 - protein, 7 aa, Artificial Sequence
  Synthetic
IGTTPFR

SEQ ID NO: 9581 - protein, 7 aa, Artificial Sequence
  Synthetic
STDRPFK

SEQ ID NO: 9582 - protein, 7 aa, Artificial Sequence
  Synthetic
SLTLPFK

SEQ ID NO: 9583 - protein, 7 aa, Artificial Sequence
  Synthetic
TTDNPFR

SEQ ID NO: 9584 - protein, 7 aa, Artificial Sequence
  Synthetic
SIGAPFR

SEQ ID NO: 9585 - protein, 7 aa, Artificial Sequence
  Synthetic
SLAVPFK

SEQ ID NO: 9586 - protein, 7 aa, Artificial Sequence
  Synthetic
VAALPFR

SEQ ID NO: 9587 - protein, 7 aa, Artificial Sequence
  Synthetic
TDERPFR

SEQ ID NO: 9588 - protein, 7 aa, Artificial Sequence
  Synthetic
STTSPFR

SEQ ID NO: 9589 - protein, 7 aa, Artificial Sequence
  Synthetic
SLDVPFR

SEQ ID NO: 9590 - protein, 7 aa, Artificial Sequence
  Synthetic
TQNAPFR

SEQ ID NO: 9591 - protein, 7 aa, Artificial Sequence
  Synthetic
SPENPFR

SEQ ID NO: 9592 - protein, 7 aa, Artificial Sequence
  Synthetic
SVDNPFR

SEQ ID NO: 9593 - protein, 7 aa, Artificial Sequence
  Synthetic
SLEQPFK

SEQ ID NO: 9594 - protein, 7 aa, Artificial Sequence
  Synthetic
MDPMPFR

SEQ ID NO: 9595 - protein, 7 aa, Artificial Sequence
  Synthetic
SSNLPFR

SEQ ID NO: 9596 - protein, 7 aa, Artificial Sequence
  Synthetic
YETLPFR

SEQ ID NO: 9597 - protein, 7 aa, Artificial Sequence
  Synthetic
LDPLPFK

SEQ ID NO: 9598 - protein, 7 aa, Artificial Sequence
  Synthetic
GVNNPFR

SEQ ID NO: 9599 - protein, 7 aa, Artificial Sequence
  Synthetic
TPVTPFR

SEQ ID NO: 9600 - protein, 7 aa, Artificial Sequence
  Synthetic
STDHPFR

SEQ ID NO: 9601 - protein, 7 aa, Artificial Sequence
  Synthetic
SHDIPFR

SEQ ID NO: 9602 - protein, 7 aa, Artificial Sequence
  Synthetic
SVAVPFR

SEQ ID NO: 9603 - protein, 7 aa, Artificial Sequence
  Synthetic
DIVHPFR

SEQ ID NO: 9604 - protein, 7 aa, Artificial Sequence
  Synthetic
WAENPFR

SEQ ID NO: 9605 - protein, 7 aa, Artificial Sequence
  Synthetic
TAQAPFR

SEQ ID NO: 9606 - protein, 7 aa, Artificial Sequence
  Synthetic
SVIVPFR

SEQ ID NO: 9607 - protein, 7 aa, Artificial Sequence
  Synthetic
TKELPFR

SEQ ID NO: 9608 - protein, 7 aa, Artificial Sequence
  Synthetic
DLNRPFR

SEQ ID NO: 9609 - protein, 7 aa, Artificial Sequence
  Synthetic
IVPSPFR

SEQ ID NO: 9610 - protein, 7 aa, Artificial Sequence
  Synthetic
SEMQPFR

SEQ ID NO: 9611 - protein, 7 aa, Artificial Sequence
  Synthetic
TEYFPFK

SEQ ID NO: 9612 - protein, 7 aa, Artificial Sequence
  Synthetic
GITVPFR

SEQ ID NO: 9613 - protein, 7 aa, Artificial Sequence
  Synthetic
GPQMPFK

SEQ ID NO: 9614 - protein, 7 aa, Artificial Sequence
  Synthetic
GLDMPFR

SEQ ID NO: 9615 - protein, 7 aa, Artificial Sequence
  Synthetic
AQATPFR

SEQ ID NO: 9616 - protein, 7 aa, Artificial Sequence
  Synthetic
TLEFPFR

SEQ ID NO: 9617 - protein, 7 aa, Artificial Sequence
  Synthetic
YGSSPFK

SEQ ID NO: 9618 - protein, 7 aa, Artificial Sequence
  Synthetic
NGQLPFR

SEQ ID NO: 9619 - protein, 7 aa, Artificial Sequence
  Synthetic
TPLTPFK

SEQ ID NO: 9620 - protein, 7 aa, Artificial Sequence
  Synthetic
YDNLPFR

SEQ ID NO: 9621 - protein, 7 aa, Artificial Sequence
  Synthetic
LGAMPFR

SEQ ID NO: 9622 - protein, 7 aa, Artificial Sequence
  Synthetic
SASSPFR

SEQ ID NO: 9623 - protein, 7 aa, Artificial Sequence
  Synthetic
SVSHPFK

SEQ ID NO: 9624 - protein, 7 aa, Artificial Sequence
  Synthetic
SNTSPFR

SEQ ID NO: 9625 - protein, 7 aa, Artificial Sequence
  Synthetic
SNLAPFR

SEQ ID NO: 9626 - protein, 7 aa, Artificial Sequence
  Synthetic
TAELPFR

SEQ ID NO: 9627 - protein, 7 aa, Artificial Sequence
  Synthetic
FAEMPFR

SEQ ID NO: 9628 - protein, 7 aa, Artificial Sequence
  Synthetic
TTAMPFR

SEQ ID NO: 9629 - protein, 7 aa, Artificial Sequence
  Synthetic
GPNLPFR

SEQ ID NO: 9630 - protein, 7 aa, Artificial Sequence
  Synthetic
SVNNPFK

SEQ ID NO: 9631 - protein, 7 aa, Artificial Sequence
  Synthetic
QIDRPFR

SEQ ID NO: 9632 - protein, 7 aa, Artificial Sequence
  Synthetic
SLHLPFK

SEQ ID NO: 9633 - protein, 7 aa, Artificial Sequence
  Synthetic
WGESPFR

SEQ ID NO: 9634 - protein, 7 aa, Artificial Sequence
  Synthetic
SPVAPFR

SEQ ID NO: 9635 - protein, 7 aa, Artificial Sequence
  Synthetic
DPTHPFR

SEQ ID NO: 9636 - protein, 7 aa, Artificial Sequence
  Synthetic
LPESPFR

SEQ ID NO: 9637 - protein, 7 aa, Artificial Sequence
  Synthetic
STENPFR

SEQ ID NO: 9638 - protein, 7 aa, Artificial Sequence
  Synthetic
VGGVPFR

SEQ ID NO: 9639 - protein, 7 aa, Artificial Sequence
  Synthetic
VLANPFR

SEQ ID NO: 9640 - protein, 7 aa, Artificial Sequence
  Synthetic
LPELPFR

SEQ ID NO: 9641 - protein, 7 aa, Artificial Sequence
  Synthetic
SSANPFK

SEQ ID NO: 9642 - protein, 7 aa, Artificial Sequence
  Synthetic
SESMPFR

SEQ ID NO: 9643 - protein, 7 aa, Artificial Sequence
  Synthetic
SEAVPFR

SEQ ID NO: 9644 - protein, 7 aa, Artificial Sequence
  Synthetic
LPERPFR

SEQ ID NO: 9645 - protein, 7 aa, Artificial Sequence
  Synthetic
YNAVPFR

SEQ ID NO: 9646 - protein, 7 aa, Artificial Sequence
  Synthetic
TPAVPFR

SEQ ID NO: 9647 - protein, 7 aa, Artificial Sequence
  Synthetic
SAHSPFR

SEQ ID NO: 9648 - protein, 7 aa, Artificial Sequence
  Synthetic
VGDLPFR

SEQ ID NO: 9649 - protein, 7 aa, Artificial Sequence
  Synthetic
LDNLPFR

SEQ ID NO: 9650 - protein, 7 aa, Artificial Sequence
  Synthetic
SKDQPFR

SEQ ID NO: 9651 - protein, 7 aa, Artificial Sequence
  Synthetic
SLVAPFK

SEQ ID NO: 9652 - protein, 7 aa, Artificial Sequence
  Synthetic
MVANPFR

SEQ ID NO: 9653 - protein, 7 aa, Artificial Sequence
  Synthetic
VPHNPFK

SEQ ID NO: 9654 - protein, 7 aa, Artificial Sequence
  Synthetic
FPGNPFK

SEQ ID NO: 9655 - protein, 7 aa, Artificial Sequence
  Synthetic
DVVHPFR

SEQ ID NO: 9656 - protein, 7 aa, Artificial Sequence
  Synthetic
SDQIPFR

SEQ ID NO: 9657 - protein, 7 aa, Artificial Sequence
  Synthetic
NLLTPFK

SEQ ID NO: 9658 - protein, 7 aa, Artificial Sequence
  Synthetic
GTFLPPS

SEQ ID NO: 9659 - protein, 7 aa, Artificial Sequence
  Synthetic
GQWQPPS

SEQ ID NO: 9660 - protein, 7 aa, Artificial Sequence
  Synthetic
GMWSPPE

SEQ ID NO: 9661 - protein, 7 aa, Artificial Sequence
  Synthetic
GVFSPPP

SEQ ID NO: 9662 - protein, 7 aa, Artificial Sequence
  Synthetic
GSFLPPS

SEQ ID NO: 9663 - protein, 7 aa, Artificial Sequence
  Synthetic
GSFSPPA

SEQ ID NO: 9664 - protein, 7 aa, Artificial Sequence
  Synthetic
GAFAPPQ

SEQ ID NO: 9665 - protein, 7 aa, Artificial Sequence
  Synthetic
GRFYPPE

SEQ ID NO: 9666 - protein, 7 aa, Artificial Sequence
  Synthetic
GQFSPPS

SEQ ID NO: 9667 - protein, 7 aa, Artificial Sequence
  Synthetic
GSFMPPP

SEQ ID NO: 9668 - protein, 7 aa, Artificial Sequence
  Synthetic
GAFSPPM

SEQ ID NO: 9669 - protein, 7 aa, Artificial Sequence
  Synthetic
GVFNPPT

SEQ ID NO: 9670 - protein, 7 aa, Artificial Sequence
  Synthetic
GEWSPPK

SEQ ID NO: 9671 - protein, 7 aa, Artificial Sequence
  Synthetic
GSFSPPT

SEQ ID NO: 9672 - protein, 7 aa, Artificial Sequence
  Synthetic
GVWLPPE

SEQ ID NO: 9673 - protein, 7 aa, Artificial Sequence
  Synthetic
GHFTPPA

SEQ ID NO: 9674 - protein, 7 aa, Artificial Sequence
  Synthetic
GAWNPPN

SEQ ID NO: 9675 - protein, 7 aa, Artificial Sequence
  Synthetic
GSWTPPS

SEQ ID NO: 9676 - protein, 7 aa, Artificial Sequence
  Synthetic
GSFTPPA

SEQ ID NO: 9677 - protein, 7 aa, Artificial Sequence
  Synthetic
GTWVPPP

SEQ ID NO: 9678 - protein, 7 aa, Artificial Sequence
  Synthetic
GGFVPPM

SEQ ID NO: 9679 - protein, 7 aa, Artificial Sequence
  Synthetic
GVFVPPQ

SEQ ID NO: 9680 - protein, 7 aa, Artificial Sequence
  Synthetic
GTWDPPA

SEQ ID NO: 9681 - protein, 7 aa, Artificial Sequence
  Synthetic
GKFSPPQ

SEQ ID NO: 9682 - protein, 7 aa, Artificial Sequence
  Synthetic
GAFLPPT

SEQ ID NO: 9683 - protein, 7 aa, Artificial Sequence
  Synthetic
GHWVPPE

SEQ ID NO: 9684 - protein, 7 aa, Artificial Sequence
  Synthetic
GDFSPPM

SEQ ID NO: 9685 - protein, 7 aa, Artificial Sequence
  Synthetic
GTFLPPT

SEQ ID NO: 9686 - protein, 7 aa, Artificial Sequence
  Synthetic
GVWVPPS

SEQ ID NO: 9687 - protein, 7 aa, Artificial Sequence
  Synthetic
GGFIPPE

SEQ ID NO: 9688 - protein, 7 aa, Artificial Sequence
  Synthetic
GRFVPPQ

SEQ ID NO: 9689 - protein, 7 aa, Artificial Sequence
  Synthetic
GKWSPPA

SEQ ID NO: 9690 - protein, 7 aa, Artificial Sequence
  Synthetic
GVFLPPM

SEQ ID NO: 9691 - protein, 7 aa, Artificial Sequence
  Synthetic
GRFDPPA

SEQ ID NO: 9692 - protein, 7 aa, Artificial Sequence
  Synthetic
GHFAPPH

SEQ ID NO: 9693 - protein, 7 aa, Artificial Sequence
  Synthetic
GLFTPPS

SEQ ID NO: 9694 - protein, 7 aa, Artificial Sequence
  Synthetic
GSWTPPE

SEQ ID NO: 9695 - protein, 7 aa, Artificial Sequence
  Synthetic
GMFMPPM

SEQ ID NO: 9696 - protein, 7 aa, Artificial Sequence
  Synthetic
GVWLPPN

SEQ ID NO: 9697 - protein, 7 aa, Artificial Sequence
  Synthetic
GHFTPPS

SEQ ID NO: 9698 - protein, 7 aa, Artificial Sequence
  Synthetic
GSFAPPS

SEQ ID NO: 9699 - protein, 7 aa, Artificial Sequence
  Synthetic
GTWVPPN

SEQ ID NO: 9700 - protein, 7 aa, Artificial Sequence
  Synthetic
GTWVPPM

SEQ ID NO: 9701 - protein, 7 aa, Artificial Sequence
  Synthetic
GNFVPPS

SEQ ID NO: 9702 - protein, 7 aa, Artificial Sequence
  Synthetic
GRFIPPT

SEQ ID NO: 9703 - protein, 7 aa, Artificial Sequence
  Synthetic
GSWSPPH

SEQ ID NO: 9704 - protein, 7 aa, Artificial Sequence
  Synthetic
GNWVPPN

SEQ ID NO: 9705 - protein, 7 aa, Artificial Sequence
  Synthetic
GVWTPPA

SEQ ID NO: 9706 - protein, 7 aa, Artificial Sequence
  Synthetic
GNWRPPA

SEQ ID NO: 9707 - protein, 7 aa, Artificial Sequence
  Synthetic
GTFHPPR

SEQ ID NO: 9708 - protein, 7 aa, Artificial Sequence
  Synthetic
GVFNPPE

SEQ ID NO: 9709 - protein, 7 aa, Artificial Sequence
  Synthetic
GHFTPPV

SEQ ID NO: 9710 - protein, 7 aa, Artificial Sequence
  Synthetic
GVWVPPN

SEQ ID NO: 9711 - protein, 7 aa, Artificial Sequence
  Synthetic
GRFVPPQ

SEQ ID NO: 9712 - protein, 7 aa, Artificial Sequence
  Synthetic
ALDRPFI

SEQ ID NO: 9713 - protein, 7 aa, Artificial Sequence
  Synthetic
TPQRPFI

SEQ ID NO: 9714 - protein, 7 aa, Artificial Sequence
  Synthetic
SVDKPFL

SEQ ID NO: 9715 - protein, 7 aa, Artificial Sequence
  Synthetic
SIGKPFI

SEQ ID NO: 9716 - protein, 7 aa, Artificial Sequence
  Synthetic
SAARPFT

SEQ ID NO: 9717 - protein, 7 aa, Artificial Sequence
  Synthetic
TSGRPFV

SEQ ID NO: 9718 - protein, 7 aa, Artificial Sequence
  Synthetic
SQSRPFQ

SEQ ID NO: 9719 - protein, 7 aa, Artificial Sequence
  Synthetic
GIGRPFT

SEQ ID NO: 9720 - protein, 7 aa, Artificial Sequence
  Synthetic
TLAKPFH

SEQ ID NO: 9721 - protein, 7 aa, Artificial Sequence
  Synthetic
IVTKPFL

SEQ ID NO: 9722 - protein, 7 aa, Artificial Sequence
  Synthetic
GVDRPFL

SEQ ID NO: 9723 - protein, 7 aa, Artificial Sequence
  Synthetic
SIDKPFY

SEQ ID NO: 9724 - protein, 7 aa, Artificial Sequence
  Synthetic
TGSKPFL

SEQ ID NO: 9725 - protein, 7 aa, Artificial Sequence
  Synthetic
TRDRPFI

SEQ ID NO: 9726 - protein, 7 aa, Artificial Sequence
  Synthetic
NLTRPFI

SEQ ID NO: 9727 - protein, 7 aa, Artificial Sequence
  Synthetic
DFARPFL

SEQ ID NO: 9728 - protein, 7 aa, Artificial Sequence
  Synthetic
IASRPFL

SEQ ID NO: 9729 - protein, 7 aa, Artificial Sequence
  Synthetic
LLNRPFA

SEQ ID NO: 9730 - protein, 7 aa, Artificial Sequence
  Synthetic
TTGRPFV

SEQ ID NO: 9731 - protein, 7 aa, Artificial Sequence
  Synthetic
SPLKPFL

SEQ ID NO: 9732 - protein, 7 aa, Artificial Sequence
  Synthetic
SGARPFI

SEQ ID NO: 9733 - protein, 7 aa, Artificial Sequence
  Synthetic
TLARPFA

SEQ ID NO: 9734 - protein, 7 aa, Artificial Sequence
  Synthetic
FRDRPFI

SEQ ID NO: 9735 - protein, 7 aa, Artificial Sequence
  Synthetic
TREKPFQ

SEQ ID NO: 9736 - protein, 7 aa, Artificial Sequence
  Synthetic
SIARPFS

SEQ ID NO: 9737 - protein, 7 aa, Artificial Sequence
  Synthetic
GLTRPFT

SEQ ID NO: 9738 - protein, 7 aa, Artificial Sequence
  Synthetic
GIAKPFL

SEQ ID NO: 9739 - protein, 7 aa, Artificial Sequence
  Synthetic
SSSRPFM

SEQ ID NO: 9740 - protein, 7 aa, Artificial Sequence
  Synthetic
TVARPFI

SEQ ID NO: 9741 - protein, 7 aa, Artificial Sequence
  Synthetic
DTSRPFL

SEQ ID NO: 9742 - protein, 7 aa, Artificial Sequence
  Synthetic
SLTKPFN

SEQ ID NO: 9743 - protein, 7 aa, Artificial Sequence
  Synthetic
SATKPFH

SEQ ID NO: 9744 - protein, 7 aa, Artificial Sequence
  Synthetic
TMTKPFV

SEQ ID NO: 9745 - protein, 7 aa, Artificial Sequence
  Synthetic
STTRPFN

SEQ ID NO: 9746 - protein, 7 aa, Artificial Sequence
  Synthetic
YTGKPFQ

SEQ ID NO: 9747 - protein, 7 aa, Artificial Sequence
  Synthetic
SAIKPFL

SEQ ID NO: 9748 - protein, 7 aa, Artificial Sequence
  Synthetic
DLHRPFH

SEQ ID NO: 9749 - protein, 7 aa, Artificial Sequence
  Synthetic
EQSRPFL

SEQ ID NO: 9750 - protein, 7 aa, Artificial Sequence
  Synthetic
GEMRPFL

SEQ ID NO: 9751 - protein, 7 aa, Artificial Sequence
  Synthetic
YDARPFL

SEQ ID NO: 9752 - protein, 7 aa, Artificial Sequence
  Synthetic
TGGRPFI

SEQ ID NO: 9753 - protein, 7 aa, Artificial Sequence
  Synthetic
TEQRPFL

SEQ ID NO: 9754 - protein, 7 aa, Artificial Sequence
  Synthetic
TDTRPFL

SEQ ID NO: 9755 - protein, 7 aa, Artificial Sequence
  Synthetic
TAVRPFV

SEQ ID NO: 9756 - protein, 7 aa, Artificial Sequence
  Synthetic
SIPRPFP

SEQ ID NO: 9757 - protein, 7 aa, Artificial Sequence
  Synthetic
TSDRPFQ

SEQ ID NO: 9758 - protein, 7 aa, Artificial Sequence
  Synthetic
TVAKPFH

SEQ ID NO: 9759 - protein, 7 aa, Artificial Sequence
  Synthetic
DVTRPFL

SEQ ID NO: 9760 - protein, 7 aa, Artificial Sequence
  Synthetic
DLSRPFV

SEQ ID NO: 9761 - protein, 7 aa, Artificial Sequence
  Synthetic
GVTRPFI

SEQ ID NO: 9762 - protein, 7 aa, Artificial Sequence
  Synthetic
LPDRPFM

SEQ ID NO: 9763 - protein, 7 aa, Artificial Sequence
  Synthetic
STDRPFK

SEQ ID NO: 9764 - protein, 7 aa, Artificial Sequence
  Synthetic
MLSKPFL

SEQ ID NO: 9765 - protein, 7 aa, Artificial Sequence
  Synthetic
TVDRPFV

SEQ ID NO: 9766 - protein, 7 aa, Artificial Sequence
  Synthetic
SVSRPFI

SEQ ID NO: 9767 - protein, 7 aa, Artificial Sequence
  Synthetic
SATRPFV

SEQ ID NO: 9768 - protein, 7 aa, Artificial Sequence
  Synthetic
LSTRPFI

SEQ ID NO: 9769 - protein, 7 aa, Artificial Sequence
  Synthetic
GLDKPFL

SEQ ID NO: 9770 - protein, 7 aa, Artificial Sequence
  Synthetic
YEGRPFV

SEQ ID NO: 9771 - protein, 7 aa, Artificial Sequence
  Synthetic
AIARPFA

SEQ ID NO: 9772 - protein, 7 aa, Artificial Sequence
  Synthetic
SVSRPFM

SEQ ID NO: 9773 - protein, 7 aa, Artificial Sequence
  Synthetic
TDERPFR

SEQ ID NO: 9774 - protein, 7 aa, Artificial Sequence
  Synthetic
SMLRPFE

SEQ ID NO: 9775 - protein, 7 aa, Artificial Sequence
  Synthetic
EMARPFM

SEQ ID NO: 9776 - protein, 7 aa, Artificial Sequence
  Synthetic
GVARPFV

SEQ ID NO: 9777 - protein, 7 aa, Artificial Sequence
  Synthetic
YVERPFA

SEQ ID NO: 9778 - protein, 7 aa, Artificial Sequence
  Synthetic
DMSRPFH

SEQ ID NO: 9779 - protein, 7 aa, Artificial Sequence
  Synthetic
NIARPFY

SEQ ID NO: 9780 - protein, 7 aa, Artificial Sequence
  Synthetic
SSSRPFV

SEQ ID NO: 9781 - protein, 7 aa, Artificial Sequence
  Synthetic
GRDRPFV

SEQ ID NO: 9782 - protein, 7 aa, Artificial Sequence
  Synthetic
SANKPFL

SEQ ID NO: 9783 - protein, 7 aa, Artificial Sequence
  Synthetic
SADRPFQ

SEQ ID NO: 9784 - protein, 7 aa, Artificial Sequence
  Synthetic
GSERPFL

SEQ ID NO: 9785 - protein, 7 aa, Artificial Sequence
  Synthetic
SLTKPFN

SEQ ID NO: 9786 - protein, 7 aa, Artificial Sequence
  Synthetic
YPTRPFN

SEQ ID NO: 9787 - protein, 7 aa, Artificial Sequence
  Synthetic
LLTRPFA

SEQ ID NO: 9788 - protein, 7 aa, Artificial Sequence
  Synthetic
TVERPFS

SEQ ID NO: 9789 - protein, 7 aa, Artificial Sequence
  Synthetic
GPSRPFQ

SEQ ID NO: 9790 - protein, 7 aa, Artificial Sequence
  Synthetic
GISRPFQ

SEQ ID NO: 9791 - protein, 7 aa, Artificial Sequence
  Synthetic
GVDRPFV

SEQ ID NO: 9792 - protein, 7 aa, Artificial Sequence
  Synthetic
YDTRPFT

SEQ ID NO: 9793 - protein, 7 aa, Artificial Sequence
  Synthetic
NVSRPFL

SEQ ID NO: 9794 - protein, 7 aa, Artificial Sequence
  Synthetic
SPERPFT

SEQ ID NO: 9795 - protein, 7 aa, Artificial Sequence
  Synthetic
GVGKPFL

SEQ ID NO: 9796 - protein, 7 aa, Artificial Sequence
  Synthetic
LASKPFL

SEQ ID NO: 9797 - protein, 7 aa, Artificial Sequence
  Synthetic
TLGRPFS

SEQ ID NO: 9798 - protein, 7 aa, Artificial Sequence
  Synthetic
SLNRPFV

SEQ ID NO: 9799 - protein, 7 aa, Artificial Sequence
  Synthetic
YLGKPFV

SEQ ID NO: 9800 - protein, 7 aa, Artificial Sequence
  Synthetic
SRERPFY

SEQ ID NO: 9801 - protein, 7 aa, Artificial Sequence
  Synthetic
DVARPFL

SEQ ID NO: 9802 - protein, 7 aa, Artificial Sequence
  Synthetic
SQSRPFN

SEQ ID NO: 9803 - protein, 7 aa, Artificial Sequence
  Synthetic
TSIRPFL

SEQ ID NO: 9804 - protein, 7 aa, Artificial Sequence
  Synthetic
LSSRPFL

SEQ ID NO: 9805 - protein, 7 aa, Artificial Sequence
  Synthetic
STQRPFM

SEQ ID NO: 9806 - protein, 7 aa, Artificial Sequence
  Synthetic
SELKPFY

SEQ ID NO: 9807 - protein, 7 aa, Artificial Sequence
  Synthetic
SVDRPFV

SEQ ID NO: 9808 - protein, 7 aa, Artificial Sequence
  Synthetic
GPDRPFV

SEQ ID NO: 9809 - protein, 7 aa, Artificial Sequence
  Synthetic
ATARPFL

SEQ ID NO: 9810 - protein, 7 aa, Artificial Sequence
  Synthetic
ELVRPFL

SEQ ID NO: 9811 - protein, 7 aa, Artificial Sequence
  Synthetic
SPLRPFT

SEQ ID NO: 9812 - protein, 7 aa, Artificial Sequence
  Synthetic
SSERPFQ

SEQ ID NO: 9813 - protein, 7 aa, Artificial Sequence
  Synthetic
ESLRPFL

SEQ ID NO: 9814 - protein, 7 aa, Artificial Sequence
  Synthetic
EALRPFM

SEQ ID NO: 9815 - protein, 7 aa, Artificial Sequence
  Synthetic
STQRPFT

SEQ ID NO: 9816 - protein, 7 aa, Artificial Sequence
  Synthetic
AASRPFM

SEQ ID NO: 9817 - protein, 7 aa, Artificial Sequence
  Synthetic
GETRPFL

SEQ ID NO: 9818 - protein, 7 aa, Artificial Sequence
  Synthetic
VPARPFL

SEQ ID NO: 9819 - protein, 7 aa, Artificial Sequence
  Synthetic
SRERPFT

SEQ ID NO: 9820 - protein, 7 aa, Artificial Sequence
  Synthetic
YANRPFT

SEQ ID NO: 9821 - protein, 7 aa, Artificial Sequence
  Synthetic
TGTRPFV

SEQ ID NO: 9822 - protein, 7 aa, Artificial Sequence
  Synthetic
NAIRPFI

SEQ ID NO: 9823 - protein, 7 aa, Artificial Sequence
  Synthetic
TCAKPFL

SEQ ID NO: 9824 - protein, 7 aa, Artificial Sequence
  Synthetic
YLSKPFV

SEQ ID NO: 9825 - protein, 7 aa, Artificial Sequence
  Synthetic
DLNRPFR

SEQ ID NO: 9826 - protein, 7 aa, Artificial Sequence
  Synthetic
SEHRPFI

SEQ ID NO: 9827 - protein, 7 aa, Artificial Sequence
  Synthetic
SGDRPFL

SEQ ID NO: 9828 - protein, 7 aa, Artificial Sequence
  Synthetic
YPSRPFV

SEQ ID NO: 9829 - protein, 7 aa, Artificial Sequence
  Synthetic
SVEKPFW

SEQ ID NO: 9830 - protein, 7 aa, Artificial Sequence
  Synthetic
SLSKPFA

SEQ ID NO: 9831 - protein, 7 aa, Artificial Sequence
  Synthetic
STSKPFY

SEQ ID NO: 9832 - protein, 7 aa, Artificial Sequence
  Synthetic
WLERPFA

SEQ ID NO: 9833 - protein, 7 aa, Artificial Sequence
  Synthetic
SQDRPFI

SEQ ID NO: 9834 - protein, 7 aa, Artificial Sequence
  Synthetic
SLERPFI

SEQ ID NO: 9835 - protein, 7 aa, Artificial Sequence
  Synthetic
VAGRPFL

SEQ ID NO: 9836 - protein, 7 aa, Artificial Sequence
  Synthetic
YADKPFL

SEQ ID NO: 9837 - protein, 7 aa, Artificial Sequence
  Synthetic
SIVRPFV

SEQ ID NO: 9838 - protein, 7 aa, Artificial Sequence
  Synthetic
SIARPFT

SEQ ID NO: 9839 - protein, 7 aa, Artificial Sequence
  Synthetic
EYTRPFM

SEQ ID NO: 9840 - protein, 7 aa, Artificial Sequence
  Synthetic
TLDKPFT

SEQ ID NO: 9841 - protein, 7 aa, Artificial Sequence
  Synthetic
EILRPFM

SEQ ID NO: 9842 - protein, 7 aa, Artificial Sequence
  Synthetic
SRERPFV

SEQ ID NO: 9843 - protein, 7 aa, Artificial Sequence
  Synthetic
MPGRPFM

SEQ ID NO: 9844 - protein, 7 aa, Artificial Sequence
  Synthetic
SIEKPFV

SEQ ID NO: 9845 - protein, 7 aa, Artificial Sequence
  Synthetic
DLNRPFQ

SEQ ID NO: 9846 - protein, 7 aa, Artificial Sequence
  Synthetic
SDGRPFL

SEQ ID NO: 9847 - protein, 7 aa, Artificial Sequence
  Synthetic
AADRPFL

SEQ ID NO: 9848 - protein, 7 aa, Artificial Sequence
  Synthetic
DGYRPFI

SEQ ID NO: 9849 - protein, 7 aa, Artificial Sequence
  Synthetic
ALMRPFP

SEQ ID NO: 9850 - protein, 7 aa, Artificial Sequence
  Synthetic
LLQRPFL

SEQ ID NO: 9851 - protein, 7 aa, Artificial Sequence
  Synthetic
LPERPFV

SEQ ID NO: 9852 - protein, 7 aa, Artificial Sequence
  Synthetic
SALRPFT

SEQ ID NO: 9853 - protein, 7 aa, Artificial Sequence
  Synthetic
YALKPFV

SEQ ID NO: 9854 - protein, 7 aa, Artificial Sequence
  Synthetic
GVTRPFQ

SEQ ID NO: 9855 - protein, 7 aa, Artificial Sequence
  Synthetic
TPARPFT

SEQ ID NO: 9856 - protein, 7 aa, Artificial Sequence
  Synthetic
SAPRPFA

SEQ ID NO: 9857 - protein, 7 aa, Artificial Sequence
  Synthetic
WESRPFI

SEQ ID NO: 9858 - protein, 7 aa, Artificial Sequence
  Synthetic
TVGRPFT

SEQ ID NO: 9859 - protein, 7 aa, Artificial Sequence
  Synthetic
QIDRPFR

SEQ ID NO: 9860 - protein, 7 aa, Artificial Sequence
  Synthetic
LLSRPFS

SEQ ID NO: 9861 - protein, 7 aa, Artificial Sequence
  Synthetic
SSSRPFQ

SEQ ID NO: 9862 - protein, 7 aa, Artificial Sequence
  Synthetic
SVVRPFP

SEQ ID NO: 9863 - protein, 7 aa, Artificial Sequence
  Synthetic
LLSRPFA

SEQ ID NO: 9864 - protein, 7 aa, Artificial Sequence
  Synthetic
SAARPFM

SEQ ID NO: 9865 - protein, 7 aa, Artificial Sequence
  Synthetic
GELRPFL

SEQ ID NO: 9866 - protein, 7 aa, Artificial Sequence
  Synthetic
YADRPFI

SEQ ID NO: 9867 - protein, 7 aa, Artificial Sequence
  Synthetic
SLERPFF

SEQ ID NO: 9868 - protein, 7 aa, Artificial Sequence
  Synthetic
TLHRPFA

SEQ ID NO: 9869 - protein, 7 aa, Artificial Sequence
  Synthetic
TFDKPFL

SEQ ID NO: 9870 - protein, 7 aa, Artificial Sequence
  Synthetic
GQTRPFL

SEQ ID NO: 9871 - protein, 7 aa, Artificial Sequence
  Synthetic
SVNRPFV

SEQ ID NO: 9872 - protein, 7 aa, Artificial Sequence
  Synthetic
TPAKPFW

SEQ ID NO: 9873 - protein, 7 aa, Artificial Sequence
  Synthetic
EYNRPFM

SEQ ID NO: 9874 - protein, 7 aa, Artificial Sequence
  Synthetic
DMTRPFQ

SEQ ID NO: 9875 - protein, 7 aa, Artificial Sequence
  Synthetic
SVERPFH

SEQ ID NO: 9876 - protein, 7 aa, Artificial Sequence
  Synthetic
GLDKPFL

SEQ ID NO: 9877 - protein, 7 aa, Artificial Sequence
  Synthetic
VISRPFA

SEQ ID NO: 9878 - protein, 7 aa, Artificial Sequence
  Synthetic
LIERPFQ

SEQ ID NO: 9879 - protein, 7 aa, Artificial Sequence
  Synthetic
MLTRPFS

SEQ ID NO: 9880 - protein, 7 aa, Artificial Sequence
  Synthetic
EITKPFW

SEQ ID NO: 9881 - protein, 7 aa, Artificial Sequence
  Synthetic
YSGRPFL

SEQ ID NO: 9882 - protein, 7 aa, Artificial Sequence
  Synthetic
TTQKPFV

SEQ ID NO: 9883 - protein, 7 aa, Artificial Sequence
  Synthetic
GFERPFL

SEQ ID NO: 9884 - protein, 7 aa, Artificial Sequence
  Synthetic
DISRPFM

SEQ ID NO: 9885 - protein, 7 aa, Artificial Sequence
  Synthetic
TTLRPFV

SEQ ID NO: 9886 - protein, 7 aa, Artificial Sequence
  Synthetic
FLDRPFP

SEQ ID NO: 9887 - protein, 7 aa, Artificial Sequence
  Synthetic
ALARPFP

SEQ ID NO: 9888 - protein, 7 aa, Artificial Sequence
  Synthetic
VPAKPFL

SEQ ID NO: 9889 - protein, 7 aa, Artificial Sequence
  Synthetic
YDHRPFQ

SEQ ID NO: 9890 - protein, 7 aa, Artificial Sequence
  Synthetic
SVARPFM

SEQ ID NO: 9891 - protein, 7 aa, Artificial Sequence
  Synthetic
SAMRPFV

SEQ ID NO: 9892 - protein, 7 aa, Artificial Sequence
  Synthetic
SSSKPFV

SEQ ID NO: 9893 - protein, 7 aa, Artificial Sequence
  Synthetic
VQTKPFL

SEQ ID NO: 9894 - protein, 7 aa, Artificial Sequence
  Synthetic
SVLRPFM

SEQ ID NO: 9895 - protein, 7 aa, Artificial Sequence
  Synthetic
SMSKPFT

SEQ ID NO: 9896 - protein, 7 aa, Artificial Sequence
  Synthetic
DLTRPFL

SEQ ID NO: 9897 - protein, 7 aa, Artificial Sequence
  Synthetic
QVSRPFM

SEQ ID NO: 9898 - protein, 7 aa, Artificial Sequence
  Synthetic
YESRPFT

SEQ ID NO: 9899 - protein, 7 aa, Artificial Sequence
  Synthetic
LPERPFR

SEQ ID NO: 9900 - protein, 7 aa, Artificial Sequence
  Synthetic
DKHRPFL

SEQ ID NO: 9901 - protein, 7 aa, Artificial Sequence
  Synthetic
YLTRPFA

SEQ ID NO: 9902 - protein, 7 aa, Artificial Sequence
  Synthetic
GASRPFQ

SEQ ID NO: 9903 - protein, 7 aa, Artificial Sequence
  Synthetic
DMERPFH

SEQ ID NO: 9904 - protein, 7 aa, Artificial Sequence
  Synthetic
DVLRPFH

SEQ ID NO: 9905 - protein, 7 aa, Artificial Sequence
  Synthetic
WIEKPFI

SEQ ID NO: 9906 - protein, 7 aa, Artificial Sequence
  Synthetic
NLQKPFI

SEQ ID NO: 9907 - protein, 7 aa, Artificial Sequence
  Synthetic
SAVRPFT

SEQ ID NO: 9908 - protein, 7 aa, Artificial Sequence
  Synthetic
YTGRPFE

SEQ ID NO: 9909 - protein, 7 aa, Artificial Sequence
  Synthetic
QPQRPFV

SEQ ID NO: 9910 - protein, 7 aa, Artificial Sequence
  Synthetic
RQERPFL

SEQ ID NO: 9911 - protein, 7 aa, Artificial Sequence
  Synthetic
PSSSTSW

SEQ ID NO: 9912 - protein, 7 aa, Artificial Sequence
  Synthetic
PVSSSTW

SEQ ID NO: 9913 - protein, 7 aa, Artificial Sequence
  Synthetic
PVSSSSW

SEQ ID NO: 9914 - protein, 7 aa, Artificial Sequence
  Synthetic
PQNHVSW

SEQ ID NO: 9915 - protein, 7 aa, Artificial Sequence
  Synthetic
PVMTSSW

SEQ ID NO: 9916 - protein, 7 aa, Artificial Sequence
  Synthetic
PSSSHTW

SEQ ID NO: 9917 - protein, 7 aa, Artificial Sequence
  Synthetic
PEMRHSW

SEQ ID NO: 9918 - protein, 7 aa, Artificial Sequence
  Synthetic
PTSINSW

SEQ ID NO: 9919 - protein, 7 aa, Artificial Sequence
  Synthetic
PENALSW

SEQ ID NO: 9920 - protein, 7 aa, Artificial Sequence
  Synthetic
PLNNTSW

SEQ ID NO: 9921 - protein, 7 aa, Artificial Sequence
  Synthetic
PVDRATW

SEQ ID NO: 9922 - protein, 7 aa, Artificial Sequence
  Synthetic
PNHAISW

SEQ ID NO: 9923 - protein, 7 aa, Artificial Sequence
  Synthetic
PTHTVSW

SEQ ID NO: 9924 - protein, 7 aa, Artificial Sequence
  Synthetic
PFDRSTW

SEQ ID NO: 9925 - protein, 7 aa, Artificial Sequence
  Synthetic
PSSASSW

SEQ ID NO: 9926 - protein, 7 aa, Artificial Sequence
  Synthetic
PESRVSW

SEQ ID NO: 9927 - protein, 7 aa, Artificial Sequence
  Synthetic
PVTRTSW

SEQ ID NO: 9928 - protein, 7 aa, Artificial Sequence
  Synthetic
PISSSSW

SEQ ID NO: 9929 - protein, 7 aa, Artificial Sequence
  Synthetic
PISTLSW

SEQ ID NO: 9930 - protein, 7 aa, Artificial Sequence
  Synthetic
PTSSYSW

SEQ ID NO: 9931 - protein, 7 aa, Artificial Sequence
  Synthetic
PMHSTSW

SEQ ID NO: 9932 - protein, 7 aa, Artificial Sequence
  Synthetic
PLSTTSW

SEQ ID NO: 9933 - protein, 7 aa, Artificial Sequence
  Synthetic
PVDRVSW

SEQ ID NO: 9934 - protein, 7 aa, Artificial Sequence
  Synthetic
PINSLSW

SEQ ID NO: 9935 - protein, 7 aa, Artificial Sequence
  Synthetic
PAHATSW

SEQ ID NO: 9936 - protein, 7 aa, Artificial Sequence
  Synthetic
PMMTTAW

SEQ ID NO: 9937 - protein, 7 aa, Artificial Sequence
  Synthetic
PDIARLW

SEQ ID NO: 9938 - protein, 7 aa, Artificial Sequence
  Synthetic
PQSNSSW

SEQ ID NO: 9939 - protein, 7 aa, Artificial Sequence
  Synthetic
PSSSSTW

SEQ ID NO: 9940 - protein, 7 aa, Artificial Sequence
  Synthetic
PSTNTSW

SEQ ID NO: 9941 - protein, 7 aa, Artificial Sequence
  Synthetic
PRAGSQW

SEQ ID NO: 9942 - protein, 7 aa, Artificial Sequence
  Synthetic
PGQKNTW

SEQ ID NO: 9943 - protein, 7 aa, Artificial Sequence
  Synthetic
PPAHGSW

SEQ ID NO: 9944 - protein, 7 aa, Artificial Sequence
  Synthetic
PNRTPEW

SEQ ID NO: 9945 - protein, 7 aa, Artificial Sequence
  Synthetic
PVIASHW

SEQ ID NO: 9946 - protein, 7 aa, Artificial Sequence
  Synthetic
PHGVTSW

SEQ ID NO: 9947 - protein, 7 aa, Artificial Sequence
  Synthetic
GALGWAP

SEQ ID NO: 9948 - protein, 7 aa, Artificial Sequence
  Synthetic
SKTGWAP

SEQ ID NO: 9949 - protein, 7 aa, Artificial Sequence
  Synthetic
SRQGWAP

SEQ ID NO: 9950 - protein, 7 aa, Artificial Sequence
  Synthetic
GTMGWAP

SEQ ID NO: 9951 - protein, 7 aa, Artificial Sequence
  Synthetic
SPKGWAP

SEQ ID NO: 9952 - protein, 7 aa, Artificial Sequence
  Synthetic
SVLGWAP

SEQ ID NO: 9953 - protein, 7 aa, Artificial Sequence
  Synthetic
SAMGWAP

SEQ ID NO: 9954 - protein, 7 aa, Artificial Sequence
  Synthetic
GSLGWAP

SEQ ID NO: 9955 - protein, 7 aa, Artificial Sequence
  Synthetic
SALGWAP

SEQ ID NO: 9956 - protein, 7 aa, Artificial Sequence
  Synthetic
SVIGWAP

SEQ ID NO: 9957 - protein, 7 aa, Artificial Sequence
  Synthetic
NTIGWAP

SEQ ID NO: 9958 - protein, 7 aa, Artificial Sequence
  Synthetic
SKVGWAP

SEQ ID NO: 9959 - protein, 7 aa, Artificial Sequence
  Synthetic
SIHGWAP

SEQ ID NO: 9960 - protein, 7 aa, Artificial Sequence
  Synthetic
SNTGWAP

SEQ ID NO: 9961 - protein, 7 aa, Artificial Sequence
  Synthetic
SKAGWAP

SEQ ID NO: 9962 - protein, 7 aa, Artificial Sequence
  Synthetic
SLVGWAP

SEQ ID NO: 9963 - protein, 7 aa, Artificial Sequence
  Synthetic
ANTGWAP

SEQ ID NO: 9964 - protein, 7 aa, Artificial Sequence
  Synthetic
HQTGWAP

SEQ ID NO: 9965 - protein, 7 aa, Artificial Sequence
  Synthetic
SISGWAP

SEQ ID NO: 9966 - protein, 7 aa, Artificial Sequence
  Synthetic
GRNGWAP

SEQ ID NO: 9967 - protein, 7 aa, Artificial Sequence
  Synthetic
LTLTTSV

SEQ ID NO: 9968 - protein, 7 aa, Artificial Sequence
  Synthetic
LTMTTSV

SEQ ID NO: 9969 - protein, 7 aa, Artificial Sequence
  Synthetic
LTIRTSI

SEQ ID NO: 9970 - protein, 7 aa, Artificial Sequence
  Synthetic
LTLQTSI

SEQ ID NO: 9971 - protein, 7 aa, Artificial Sequence
  Synthetic
LTMSTSR

SEQ ID NO: 9972 - protein, 7 aa, Artificial Sequence
  Synthetic
LTLMTSI

SEQ ID NO: 9973 - protein, 7 aa, Artificial Sequence
  Synthetic
LTLHTSV

SEQ ID NO: 9974 - protein, 7 aa, Artificial Sequence
  Synthetic
LTLTTSV

SEQ ID NO: 9975 - protein, 7 aa, Artificial Sequence
  Synthetic
LTISTSR

SEQ ID NO: 9976 - protein, 7 aa, Artificial Sequence
  Synthetic
LTLQTSV

SEQ ID NO: 9977 - protein, 7 aa, Artificial Sequence
  Synthetic
LTLTTSK

SEQ ID NO: 9978 - protein, 7 aa, Artificial Sequence
  Synthetic
LTMNTSI

SEQ ID NO: 9979 - protein, 7 aa, Artificial Sequence
  Synthetic
HVKFEAI

SEQ ID NO: 9980 - protein, 7 aa, Artificial Sequence
  Synthetic
SARFEFV

SEQ ID NO: 9981 - protein, 7 aa, Artificial Sequence
  Synthetic
TLRFESI

SEQ ID NO: 9982 - protein, 7 aa, Artificial Sequence
  Synthetic
TQRFENI

SEQ ID NO: 9983 - protein, 7 aa, Artificial Sequence
  Synthetic
RVKFESV

SEQ ID NO: 9984 - protein, 7 aa, Artificial Sequence
  Synthetic
SSRFESV

SEQ ID NO: 9985 - protein, 7 aa, Artificial Sequence
  Synthetic
SLRFEAV

SEQ ID NO: 9986 - protein, 7 aa, Artificial Sequence
  Synthetic
ALRFEAV

SEQ ID NO: 9987 - protein, 7 aa, Artificial Sequence
  Synthetic
MVKFEQV

SEQ ID NO: 9988 - protein, 7 aa, Artificial Sequence
  Synthetic
SNRFEVV

SEQ ID NO: 9989 - protein, 7 aa, Artificial Sequence
  Synthetic
AFKFEQV

SEQ ID NO: 9990 - protein, 7 aa, Artificial Sequence
  Synthetic
TLKFERI

SEQ ID NO: 9991 - protein, 7 aa, Artificial Sequence
  Synthetic
SSRFEAV

SEQ ID NO: 9992 - protein, 7 aa, Artificial Sequence
  Synthetic
SVRFEKV

SEQ ID NO: 9993 - protein, 7 aa, Artificial Sequence
  Synthetic
SRKFELV

SEQ ID NO: 9994 - protein, 7 aa, Artificial Sequence
  Synthetic
SHKFEVV

SEQ ID NO: 9995 - protein, 7 aa, Artificial Sequence
  Synthetic
QRRFEEV

SEQ ID NO: 9996 - protein, 7 aa, Artificial Sequence
  Synthetic
TIRFENV

SEQ ID NO: 9997 - protein, 7 aa, Artificial Sequence
  Synthetic
SMRFEHI

SEQ ID NO: 9998 - protein, 7 aa, Artificial Sequence
  Synthetic
KVRFESV

SEQ ID NO: 9999 - protein, 7 aa, Artificial Sequence
  Synthetic
VVRFEQI

SEQ ID NO: 10000 - protein, 7 aa, Artificial Sequence
  Synthetic
SMRFETV

SEQ ID NO: 10001 - protein, 7 aa, Artificial Sequence
  Synthetic
ALKFENV

SEQ ID NO: 10002 - protein, 7 aa, Artificial Sequence
  Synthetic
SSRFEHI

SEQ ID NO: 10003 - protein, 7 aa, Artificial Sequence
  Synthetic
TYRFESV

SEQ ID NO: 10004 - protein, 7 aa, Artificial Sequence
  Synthetic
VVRFEAV

SEQ ID NO: 10005 - protein, 7 aa, Artificial Sequence
  Synthetic
QSKFESI

SEQ ID NO: 10006 - protein, 7 aa, Artificial Sequence
  Synthetic
LMRFEQV

SEQ ID NO: 10007 - protein, 7 aa, Artificial Sequence
  Synthetic
RNRFEDI

SEQ ID NO: 10008 - protein, 7 aa, Artificial Sequence
  Synthetic
QLRFESI

SEQ ID NO: 10009 - protein, 7 aa, Artificial Sequence
  Synthetic
QYRFEDV

SEQ ID NO: 10010 - protein, 7 aa, Artificial Sequence
  Synthetic
QIRFEQV

SEQ ID NO: 10011 - protein, 7 aa, Artificial Sequence
  Synthetic
QLRFEVM

SEQ ID NO: 10012 - protein, 7 aa, Artificial Sequence
  Synthetic
VMRFEQI

SEQ ID NO: 10013 - protein, 7 aa, Artificial Sequence
  Synthetic
GTFLPPS

SEQ ID NO: 10014 - protein, 7 aa, Artificial Sequence
  Synthetic
GQWQPPS

SEQ ID NO: 10015 - protein, 7 aa, Artificial Sequence
  Synthetic
RTFSPPS

SEQ ID NO: 10016 - protein, 7 aa, Artificial Sequence
  Synthetic
GSFLPPS

SEQ ID NO: 10017 - protein, 7 aa, Artificial Sequence
  Synthetic
GQFSPPS

SEQ ID NO: 10018 - protein, 7 aa, Artificial Sequence
  Synthetic
VSFSPPS

SEQ ID NO: 10019 - protein, 7 aa, Artificial Sequence
  Synthetic
NTFSPPS

SEQ ID NO: 10020 - protein, 7 aa, Artificial Sequence
  Synthetic
GSWTPPS

SEQ ID NO: 10021 - protein, 7 aa, Artificial Sequence
  Synthetic
YTFAPPS

SEQ ID NO: 10022 - protein, 7 aa, Artificial Sequence
  Synthetic
HNWDPPS

SEQ ID NO: 10023 - protein, 7 aa, Artificial Sequence
  Synthetic
GVWVPPS

SEQ ID NO: 10024 - protein, 7 aa, Artificial Sequence
  Synthetic
GLFTPPS

SEQ ID NO: 10025 - protein, 7 aa, Artificial Sequence
  Synthetic
GHFTPPS

SEQ ID NO: 10026 - protein, 7 aa, Artificial Sequence
  Synthetic
GSFAPPS

SEQ ID NO: 10027 - protein, 7 aa, Artificial Sequence
  Synthetic
GNFVPPS

SEQ ID NO: 10028 - protein, 7 aa, Artificial Sequence
  Synthetic
TVWNPPS

SEQ ID NO: 10029 - protein, 7 aa, Artificial Sequence
  Synthetic
KTWEPPS

SEQ ID NO: 10030 - protein, 7 aa, Artificial Sequence
  Synthetic
SSAGWVA

SEQ ID NO: 10031 - protein, 7 aa, Artificial Sequence
  Synthetic
SKTGWAP

SEQ ID NO: 10032 - protein, 7 aa, Artificial Sequence
  Synthetic
SRVGWVA

SEQ ID NO: 10033 - protein, 7 aa, Artificial Sequence
  Synthetic
SSIGWSA

SEQ ID NO: 10034 - protein, 7 aa, Artificial Sequence
  Synthetic
SSIGWTP

SEQ ID NO: 10035 - protein, 7 aa, Artificial Sequence
  Synthetic
SRQGWAP

SEQ ID NO: 10036 - protein, 7 aa, Artificial Sequence
  Synthetic
SPKGWAP

SEQ ID NO: 10037 - protein, 7 aa, Artificial Sequence
  Synthetic
SPIGWSP

SEQ ID NO: 10038 - protein, 7 aa, Artificial Sequence
  Synthetic
SVVGWSA

SEQ ID NO: 10039 - protein, 7 aa, Artificial Sequence
  Synthetic
SVLGWAP

SEQ ID NO: 10040 - protein, 7 aa, Artificial Sequence
  Synthetic
SIAGWVA

SEQ ID NO: 10041 - protein, 7 aa, Artificial Sequence
  Synthetic
SAMGWAP

SEQ ID NO: 10042 - protein, 7 aa, Artificial Sequence
  Synthetic
SAVGWAA

SEQ ID NO: 10043 - protein, 7 aa, Artificial Sequence
  Synthetic
SALGWAP

SEQ ID NO: 10044 - protein, 7 aa, Artificial Sequence
  Synthetic
SLGGWVA

SEQ ID NO: 10045 - protein, 7 aa, Artificial Sequence
  Synthetic
SVIGWAP

SEQ ID NO: 10046 - protein, 7 aa, Artificial Sequence
  Synthetic
SSLGWAA

SEQ ID NO: 10047 - protein, 7 aa, Artificial Sequence
  Synthetic
SSVGWLA

SEQ ID NO: 10048 - protein, 7 aa, Artificial Sequence
  Synthetic
SALGWSA

SEQ ID NO: 10049 - protein, 7 aa, Artificial Sequence
  Synthetic
SPVGWSP

SEQ ID NO: 10050 - protein, 7 aa, Artificial Sequence
  Synthetic
SELGWSP

SEQ ID NO: 10051 - protein, 7 aa, Artificial Sequence
  Synthetic
SKVGWTA

SEQ ID NO: 10052 - protein, 7 aa, Artificial Sequence
  Synthetic
SLVGWAA

SEQ ID NO: 10053 - protein, 7 aa, Artificial Sequence
  Synthetic
SESGWVA

SEQ ID NO: 10054 - protein, 7 aa, Artificial Sequence
  Synthetic
STIGWIA

SEQ ID NO: 10055 - protein, 7 aa, Artificial Sequence
  Synthetic
SAMGWVA

SEQ ID NO: 10056 - protein, 7 aa, Artificial Sequence
  Synthetic
SVVGWAA

SEQ ID NO: 10057 - protein, 7 aa, Artificial Sequence
  Synthetic
SPIGWSA

SEQ ID NO: 10058 - protein, 7 aa, Artificial Sequence
  Synthetic
SDRGWTA

SEQ ID NO: 10059 - protein, 7 aa, Artificial Sequence
  Synthetic
SKVGWAP

SEQ ID NO: 10060 - protein, 7 aa, Artificial Sequence
  Synthetic
SRTGWTA

SEQ ID NO: 10061 - protein, 7 aa, Artificial Sequence
  Synthetic
SIVGWAA

SEQ ID NO: 10062 - protein, 7 aa, Artificial Sequence
  Synthetic
SIHGWAP

SEQ ID NO: 10063 - protein, 7 aa, Artificial Sequence
  Synthetic
SGIGWTA

SEQ ID NO: 10064 - protein, 7 aa, Artificial Sequence
  Synthetic
SLQGWVA

SEQ ID NO: 10065 - protein, 7 aa, Artificial Sequence
  Synthetic
SNTGWAP

SEQ ID NO: 10066 - protein, 7 aa, Artificial Sequence
  Synthetic
SKAGWAP

SEQ ID NO: 10067 - protein, 7 aa, Artificial Sequence
  Synthetic
SELGWIP

SEQ ID NO: 10068 - protein, 7 aa, Artificial Sequence
  Synthetic
SGNGWVA

SEQ ID NO: 10069 - protein, 7 aa, Artificial Sequence
  Synthetic
SLHGWAA

SEQ ID NO: 10070 - protein, 7 aa, Artificial Sequence
  Synthetic
SVLGWTA

SEQ ID NO: 10071 - protein, 7 aa, Artificial Sequence
  Synthetic
SLVGWAA

SEQ ID NO: 10072 - protein, 7 aa, Artificial Sequence
  Synthetic
SLVGWAP

SEQ ID NO: 10073 - protein, 7 aa, Artificial Sequence
  Synthetic
SATGWVA

SEQ ID NO: 10074 - protein, 7 aa, Artificial Sequence
  Synthetic
SSLGWAA

SEQ ID NO: 10075 - protein, 7 aa, Artificial Sequence
  Synthetic
SEVGWAA

SEQ ID NO: 10076 - protein, 7 aa, Artificial Sequence
  Synthetic
SSPGWVA

SEQ ID NO: 10077 - protein, 7 aa, Artificial Sequence
  Synthetic
SSHGWIA

SEQ ID NO: 10078 - protein, 7 aa, Artificial Sequence
  Synthetic
SGPGWVA

SEQ ID NO: 10079 - protein, 7 aa, Artificial Sequence
  Synthetic
SDSGWVA

SEQ ID NO: 10080 - protein, 7 aa, Artificial Sequence
  Synthetic
SFPGWSA

SEQ ID NO: 10081 - protein, 7 aa, Artificial Sequence
  Synthetic
SISGWAP

SEQ ID NO: 10082 - protein, 7 aa, Artificial Sequence
  Synthetic
SDLGWHP

SEQ ID NO: 10083 - protein, 7 aa, Artificial Sequence
  Synthetic
STHGWAA

SEQ ID NO: 10084 - protein, 7 aa, Artificial Sequence
  Synthetic
SPGGWPP

SEQ ID NO: 10085 - protein, 7 aa, Artificial Sequence
  Synthetic
SDVGWSP

SEQ ID NO: 10086 - protein, 7 aa, Artificial Sequence
  Synthetic
SHAGWAA

SEQ ID NO: 10087 - DNA, 21 bp, Artificial Sequence
  Synthetic
tttactctgaaggagcctaag

SEQ ID NO: 10088 - DNA, 21 bp, Artificial Sequence
  Synthetic
tttactgctgttggtccgaag

SEQ ID NO: 10089 - DNA, 21 bp, Artificial Sequence
  Synthetic
tttactactctttatccgaag

SEQ ID NO: 10090 - DNA, 21 bp, Artificial Sequence
  Synthetic
tttactttggctgctcctaag

SEQ ID NO: 10091 - DNA, 21 bp, Artificial Sequence
  Synthetic
tttactgtggcttatccgaag

SEQ ID NO: 10092 - DNA, 21 bp, Artificial Sequence
  Synthetic
tttactatgagtgggccgaag

SEQ ID NO: 10093 - DNA, 21 bp, Artificial Sequence
  Synthetic
tctccgtcgcttccttttcgt

SEQ ID NO: 10094 - DNA, 21 bp, Artificial Sequence
  Synthetic
tctgatgttatgccgtttcgg

SEQ ID NO: 10095 - DNA, 21 bp, Artificial Sequence
  Synthetic
tcggttgataatccttttagg

SEQ ID NO: 10096 - DNA, 21 bp, Artificial Sequence
  Synthetic
ggtccgcagatgccgtttcgt

SEQ ID NO: 10097 - DNA, 21 bp, Artificial Sequence
  Synthetic
tcggcggagactccttttagg

SEQ ID NO: 10098 - DNA, 21 bp, Artificial Sequence
  Synthetic
agtactacgactccgtttagg

SEQ ID NO: 10099 - DNA, 21 bp, Artificial Sequence
  Synthetic
ttggatccgattccgtttaag

SEQ ID NO: 10100 - DNA, 21 bp, Artificial Sequence
  Synthetic
actatgacgtcgccttttcgt

SEQ ID NO: 10101 - DNA, 21 bp, Artificial Sequence
  Synthetic
acgagtagtacgccgtttcgt

SEQ ID NO: 10102 - DNA, 21 bp, Artificial Sequence
  Synthetic
gtgagtaatatgccttttagg

SEQ ID NO: 10103 - DNA, 21 bp, Artificial Sequence
  Synthetic
ttgctttcggctccgtttcgg

SEQ ID NO: 10104 - DNA, 21 bp, Artificial Sequence
  Synthetic
tctttgaatgttccttttcgt

SEQ ID NO: 10105 - DNA, 21 bp, Artificial Sequence
  Synthetic
actgcggcgagtccttttcgt

SEQ ID NO: 10106 - DNA, 21 bp, Artificial Sequence
  Synthetic
tctttgcagactccttttaag

SEQ ID NO: 10107 - DNA, 21 bp, Artificial Sequence
  Synthetic
gttgagcctttgccgtttcgt

SEQ ID NO: 10108 - DNA, 21 bp, Artificial Sequence
  Synthetic
tctgttttgcagccttttagg

SEQ ID NO: 10109 - DNA, 21 bp, Artificial Sequence
  Synthetic
ttgcctgaggcgccgtttcgg

SEQ ID NO: 10110 - DNA, 21 bp, Artificial Sequence
  Synthetic
acgccgagtagtccgtttcgg

SEQ ID NO: 10111 - DNA, 21 bp, Artificial Sequence
  Synthetic
tctgtttcgctgccttttcgg

SEQ ID NO: 10112 - DNA, 21 bp, Artificial Sequence
  Synthetic
tcggctgggactccgtttcgg

SEQ ID NO: 10113 - DNA, 21 bp, Artificial Sequence
  Synthetic
acgactgctttgccgtttcgg

SEQ ID NO: 10114 - DNA, 21 bp, Artificial Sequence
  Synthetic
attgggtcgcttccgtttcgt

SEQ ID NO: 10115 - DNA, 21 bp, Artificial Sequence
  Synthetic
tttggtgattcgccgtttcgg

SEQ ID NO: 10116 - DNA, 21 bp, Artificial Sequence
  Synthetic
acgccgcaggttccgtttaag

SEQ ID NO: 10117 - DNA, 21 bp, Artificial Sequence
  Synthetic
actactgttgctccttttcgg

SEQ ID NO: 10118 - DNA, 21 bp, Artificial Sequence
  Synthetic
tctgttaataatccttttaag

SEQ ID NO: 10119 - DNA, 21 bp, Artificial Sequence
  Synthetic
attgggactacgccgtttagg

SEQ ID NO: 10120 - DNA, 21 bp, Artificial Sequence
  Synthetic
agtacggatcgtccttttaag

SEQ ID NO: 10121 - DNA, 21 bp, Artificial Sequence
  Synthetic
tctctgacgcttccgtttaag

SEQ ID NO: 10122 - DNA, 21 bp, Artificial Sequence
  Synthetic
actactgataatccttttcgg

SEQ ID NO: 10123 - DNA, 21 bp, Artificial Sequence
  Synthetic
tcgattggggctccgtttcgg

SEQ ID NO: 10124 - DNA, 21 bp, Artificial Sequence
  Synthetic
tctttggctgtgccttttaag

SEQ ID NO: 10125 - DNA, 21 bp, Artificial Sequence
  Synthetic
gtggcggcgctgccttttcgg

SEQ ID NO: 10126 - DNA, 21 bp, Artificial Sequence
  Synthetic
actgatgagcgtccttttagg

SEQ ID NO: 10127 - DNA, 21 bp, Artificial Sequence
  Synthetic
agtacgactagtccttttcgg

SEQ ID NO: 10128 - DNA, 21 bp, Artificial Sequence
  Synthetic
tcgttggatgttccttttcgg

SEQ ID NO: 10129 - DNA, 21 bp, Artificial Sequence
  Synthetic
actcagaatgcgccttttcgt

SEQ ID NO: 10130 - DNA, 21 bp, Artificial Sequence
  Synthetic
tcgcctgagaatccgtttagg

SEQ ID NO: 10131 - DNA, 21 bp, Artificial Sequence
  Synthetic
tctgttgataatccgtttcgt

SEQ ID NO: 10132 - DNA, 21 bp, Artificial Sequence
  Synthetic
tctttggagcagccttttaag

SEQ ID NO: 10133 - DNA, 21 bp, Artificial Sequence
  Synthetic
atggatccgatgccttttcgg

SEQ ID NO: 10134 - DNA, 21 bp, Artificial Sequence
  Synthetic
agttcgaatctgccgtttcgt

SEQ ID NO: 10135 - DNA, 21 bp, Artificial Sequence
  Synthetic
tatgagacgcttccttttagg

SEQ ID NO: 10136 - DNA, 21 bp, Artificial Sequence
  Synthetic
ttggatcctctgccgtttaag

SEQ ID NO: 10137 - DNA, 21 bp, Artificial Sequence
  Synthetic
ggtgtgaataatccgtttcgt

SEQ ID NO: 10138 - DNA, 21 bp, Artificial Sequence
  Synthetic
acgccggttacgccttttcgt

SEQ ID NO: 10139 - DNA, 21 bp, Artificial Sequence
  Synthetic
agtacggatcatccttttagg

SEQ ID NO: 10140 - DNA, 21 bp, Artificial Sequence
  Synthetic
tcgcatgatattccttttcgg

SEQ ID NO: 10141 - DNA, 21 bp, Artificial Sequence
  Synthetic
tcggtggctgtgccttttcgt

SEQ ID NO: 10142 - DNA, 21 bp, Artificial Sequence
  Synthetic
gatattgttcatccgtttcgt

SEQ ID NO: 10143 - DNA, 21 bp, Artificial Sequence
  Synthetic
tgggctgagaatccgtttcgg

SEQ ID NO: 10144 - DNA, 21 bp, Artificial Sequence
  Synthetic
acggctcaggcgccttttcgg

SEQ ID NO: 10145 - DNA, 21 bp, Artificial Sequence
  Synthetic
tcggtgattgtgccgtttagg

SEQ ID NO: 10146 - DNA, 21 bp, Artificial Sequence
  Synthetic
acgaaggagctgccttttcgg

SEQ ID NO: 10147 - DNA, 21 bp, Artificial Sequence
  Synthetic
gatcttaatcgtccgtttcgg

SEQ ID NO: 10148 - DNA, 21 bp, Artificial Sequence
  Synthetic
attgtgccgagtccttttcgg

SEQ ID NO: 10149 - DNA, 21 bp, Artificial Sequence
  Synthetic
agtgagatgcagccttttcgt

SEQ ID NO: 10150 - DNA, 21 bp, Artificial Sequence
  Synthetic
acggagtattttccttttaag

SEQ ID NO: 10151 - DNA, 21 bp, Artificial Sequence
  Synthetic
ggtattacggtgccgtttcgg

SEQ ID NO: 10152 - DNA, 21 bp, Artificial Sequence
  Synthetic
gggccgcagatgccgtttaag

SEQ ID NO: 10153 - DNA, 21 bp, Artificial Sequence
  Synthetic
ggtttggatatgccttttcgg

SEQ ID NO: 10154 - DNA, 21 bp, Artificial Sequence
  Synthetic
gcgcaggcgacgccttttcgt

SEQ ID NO: 10155 - DNA, 21 bp, Artificial Sequence
  Synthetic
actttggagtttccttttcgt

SEQ ID NO: 10156 - DNA, 21 bp, Artificial Sequence
  Synthetic
tatggtagttcgccttttaag

SEQ ID NO: 10157 - DNA, 21 bp, Artificial Sequence
  Synthetic
aatgggcagttgccttttcgg

SEQ ID NO: 10158 - DNA, 21 bp, Artificial Sequence
  Synthetic
acgccgcttactccttttaag

SEQ ID NO: 10159 - DNA, 21 bp, Artificial Sequence
  Synthetic
tatgataatttgccgtttcgg

SEQ ID NO: 10160 - DNA, 21 bp, Artificial Sequence
  Synthetic
ttgggggcgatgccgtttcgt

SEQ ID NO: 10161 - DNA, 21 bp, Artificial Sequence
  Synthetic
tctgcgagttctccgtttcgg

SEQ ID NO: 10162 - DNA, 21 bp, Artificial Sequence
  Synthetic
tctgtgagtcatccttttaag

SEQ ID NO: 10163 - DNA, 21 bp, Artificial Sequence
  Synthetic
tctaatactagtccttttagg

SEQ ID NO: 10164 - DNA, 21 bp, Artificial Sequence
  Synthetic
tctaatctggcgccgtttcgt

SEQ ID NO: 10165 - DNA, 21 bp, Artificial Sequence
  Synthetic
actgctgagcttccgtttagg

SEQ ID NO: 10166 - DNA, 21 bp, Artificial Sequence
  Synthetic
tttgcggagatgccttttagg

SEQ ID NO: 10167 - DNA, 21 bp, Artificial Sequence
  Synthetic
acgactgcgatgccttttcgg

SEQ ID NO: 10168 - DNA, 21 bp, Artificial Sequence
  Synthetic
ggtccgaatcttccttttagg

SEQ ID NO: 10169 - DNA, 21 bp, Artificial Sequence
  Synthetic
agtgtgaataatccgtttaag

SEQ ID NO: 10170 - DNA, 21 bp, Artificial Sequence
  Synthetic
cagattgatcgtccttttcgg

SEQ ID NO: 10171 - DNA, 21 bp, Artificial Sequence
  Synthetic
agtctgcatcttccttttaag

SEQ ID NO: 10172 - DNA, 21 bp, Artificial Sequence
  Synthetic
tggggtgagtctccttttcgg

SEQ ID NO: 10173 - DNA, 21 bp, Artificial Sequence
  Synthetic
agtccggttgctccttttagg

SEQ ID NO: 10174 - DNA, 21 bp, Artificial Sequence
  Synthetic
gatccgacgcatccgtttcgt

SEQ ID NO: 10175 - DNA, 21 bp, Artificial Sequence
  Synthetic
ttgcctgagtctccgtttagg

SEQ ID NO: 10176 - DNA, 21 bp, Artificial Sequence
  Synthetic
tctactgagaatccgtttcgt

SEQ ID NO: 10177 - DNA, 21 bp, Artificial Sequence
  Synthetic
gtgggtggggtgccgtttagg

SEQ ID NO: 10178 - DNA, 21 bp, Artificial Sequence
  Synthetic
gtgttggcgaatccgtttcgg

SEQ ID NO: 10179 - DNA, 21 bp, Artificial Sequence
  Synthetic
ctgccggagcttccgtttcgt

SEQ ID NO: 10180 - DNA, 21 bp, Artificial Sequence
  Synthetic
agtagtgctaatccttttaag

SEQ ID NO: 10181 - DNA, 21 bp, Artificial Sequence
  Synthetic
agtgagtcgatgccttttagg

SEQ ID NO: 10182 - DNA, 21 bp, Artificial Sequence
  Synthetic
tctgaggctgttccgtttcgt

SEQ ID NO: 10183 - DNA, 21 bp, Artificial Sequence
  Synthetic
ttgccggagcgtccgtttagg

SEQ ID NO: 10184 - DNA, 21 bp, Artificial Sequence
  Synthetic
tataatgctgttccttttcgg

SEQ ID NO: 10185 - DNA, 21 bp, Artificial Sequence
  Synthetic
acgccggcggttccttttcgt

SEQ ID NO: 10186 - DNA, 21 bp, Artificial Sequence
  Synthetic
tcggctcatagtccttttcgg

SEQ ID NO: 10187 - DNA, 21 bp, Artificial Sequence
  Synthetic
gttggtgatctgccgtttcgg

SEQ ID NO: 10188 - DNA, 21 bp, Artificial Sequence
  Synthetic
ttggataatcttccttttcgt

SEQ ID NO: 10189 - DNA, 21 bp, Artificial Sequence
  Synthetic
agtaaggatcagccttttagg

SEQ ID NO: 10190 - DNA, 21 bp, Artificial Sequence
  Synthetic
agtttggtggctccgtttaag

SEQ ID NO: 10191 - DNA, 21 bp, Artificial Sequence
  Synthetic
atggtggcgaatccgtttcgg

SEQ ID NO: 10192 - DNA, 21 bp, Artificial Sequence
  Synthetic
gttcctcataatccttttaag

SEQ ID NO: 10193 - DNA, 21 bp, Artificial Sequence
  Synthetic
tttccgggtaatccgtttaag

SEQ ID NO: 10194 - DNA, 21 bp, Artificial Sequence
  Synthetic
gatgttgttcatccgtttcgt

SEQ ID NO: 10195 - DNA, 21 bp, Artificial Sequence
  Synthetic
agtgatcagattccttttagg

SEQ ID NO: 10196 - DNA, 21 bp, Artificial Sequence
  Synthetic
aatttgttgacgccttttaag

SEQ ID NO: 10197 - DNA, 21 bp, Artificial Sequence
  Synthetic
gggacgtttttgccgccgagt

SEQ ID NO: 10198 - DNA, 21 bp, Artificial Sequence
  Synthetic
ggtcagtggcagcctcctagt

SEQ ID NO: 10199 - DNA, 21 bp, Artificial Sequence
  Synthetic
gggatgtggagtcctccggag

SEQ ID NO: 10200 - DNA, 21 bp, Artificial Sequence
  Synthetic
ggggtgtttagtcctcctcct

SEQ ID NO: 10201 - DNA, 21 bp, Artificial Sequence
  Synthetic
gggagttttcttcctcctagt

SEQ ID NO: 10202 - DNA, 21 bp, Artificial Sequence
  Synthetic
ggtagttttagtcctccggct

SEQ ID NO: 10203 - DNA, 21 bp, Artificial Sequence
  Synthetic
ggggcttttgctcctccgcag

SEQ ID NO: 10204 - DNA, 21 bp, Artificial Sequence
  Synthetic
ggtcgtttttatccgccggag

SEQ ID NO: 10205 - DNA, 21 bp, Artificial Sequence
  Synthetic
gggcagttttctcctccgagt

SEQ ID NO: 10206 - DNA, 21 bp, Artificial Sequence
  Synthetic
gggtcgtttatgcctcctcct

SEQ ID NO: 10207 - DNA, 21 bp, Artificial Sequence
  Synthetic
ggtgcgttttctcctcctatg

SEQ ID NO: 10208 - DNA, 21 bp, Artificial Sequence
  Synthetic
ggtgtgtttaatcctcctacg

SEQ ID NO: 10209 - DNA, 21 bp, Artificial Sequence
  Synthetic
ggtgagtggagtccgcctaag

SEQ ID NO: 10210 - DNA, 21 bp, Artificial Sequence
  Synthetic
gggagttttagtccgcctacg

SEQ ID NO: 10211 - DNA, 21 bp, Artificial Sequence
  Synthetic
ggggtttggttgcctccggag

SEQ ID NO: 10212 - DNA, 21 bp, Artificial Sequence
  Synthetic
ggtcattttacgccgcctgct

SEQ ID NO: 10213 - DNA, 21 bp, Artificial Sequence
  Synthetic
ggtgcttggaatcctccgaat

SEQ ID NO: 10214 - DNA, 21 bp, Artificial Sequence
  Synthetic
ggttcgtggactcctccttct

SEQ ID NO: 10215 - DNA, 21 bp, Artificial Sequence
  Synthetic
gggtcgtttactccgccggct

SEQ ID NO: 10216 - DNA, 21 bp, Artificial Sequence
  Synthetic
ggtacttgggttccgcctccg

SEQ ID NO: 10217 - DNA, 21 bp, Artificial Sequence
  Synthetic
gggggttttgtgcctccgatg

SEQ ID NO: 10218 - DNA, 21 bp, Artificial Sequence
  Synthetic
ggtgtgtttgttcctcctcag

SEQ ID NO: 10219 - DNA, 21 bp, Artificial Sequence
  Synthetic
gggacgtgggatcctcctgct

SEQ ID NO: 10220 - DNA, 21 bp, Artificial Sequence
  Synthetic
ggtaagttttctcctccgcag

SEQ ID NO: 10221 - DNA, 21 bp, Artificial Sequence
  Synthetic
ggtgcgtttttgcctccgacg

SEQ ID NO: 10222 - DNA, 21 bp, Artificial Sequence
  Synthetic
gggcattgggttcctccggag

SEQ ID NO: 10223 - DNA, 21 bp, Artificial Sequence
  Synthetic
ggtgattttagtcctcctatg

SEQ ID NO: 10224 - DNA, 21 bp, Artificial Sequence
  Synthetic
gggacttttcttcctcctacg

SEQ ID NO: 10225 - DNA, 21 bp, Artificial Sequence
  Synthetic
ggggtgtgggttccgcctagt

SEQ ID NO: 10226 - DNA, 21 bp, Artificial Sequence
  Synthetic
ggggggtttattcctccggag

SEQ ID NO: 10227 - DNA, 21 bp, Artificial Sequence
  Synthetic
ggtaggtttgttcctcctcag

SEQ ID NO: 10228 - DNA, 21 bp, Artificial Sequence
  Synthetic
ggtaagtggtctcctcctgct

SEQ ID NO: 10229 - DNA, 21 bp, Artificial Sequence
  Synthetic
ggggtgtttctgcctccgatg

SEQ ID NO: 10230 - DNA, 21 bp, Artificial Sequence
  Synthetic
gggcgttttgatcctcctgct

SEQ ID NO: 10231 - DNA, 21 bp, Artificial Sequence
  Synthetic
ggtcattttgcgcctccgcat

SEQ ID NO: 10232 - DNA, 21 bp, Artificial Sequence
  Synthetic
gggttgtttactccgccgtcg

SEQ ID NO: 10233 - DNA, 21 bp, Artificial Sequence
  Synthetic
ggttcttggacgcctccggag

SEQ ID NO: 10234 - DNA, 21 bp, Artificial Sequence
  Synthetic
gggatgtttatgccgcctatg

SEQ ID NO: 10235 - DNA, 21 bp, Artificial Sequence
  Synthetic
ggtgtgtggcttccgcctaat

SEQ ID NO: 10236 - DNA, 21 bp, Artificial Sequence
  Synthetic
ggtcattttacgcctccgtcg

SEQ ID NO: 10237 - DNA, 21 bp, Artificial Sequence
  Synthetic
gggtcgtttgcgcctccttct

SEQ ID NO: 10238 - DNA, 21 bp, Artificial Sequence
  Synthetic
gggacgtgggttccgcctaat

SEQ ID NO: 10239 - DNA, 21 bp, Artificial Sequence
  Synthetic
ggtacgtgggttccgccgatg

SEQ ID NO: 10240 - DNA, 21 bp, Artificial Sequence
  Synthetic
ggtaattttgtgcctccgagt

SEQ ID NO: 10241 - DNA, 21 bp, Artificial Sequence
  Synthetic
ggtcggtttattcctcctacg

SEQ ID NO: 10242 - DNA, 21 bp, Artificial Sequence
  Synthetic
ggttcttggtctcctcctcat

SEQ ID NO: 10243 - DNA, 21 bp, Artificial Sequence
  Synthetic
gggaattgggtgcctcctaat

SEQ ID NO: 10244 - DNA, 21 bp, Artificial Sequence
  Synthetic
ggtgtgtggactcctccggct

SEQ ID NO: 10245 - DNA, 21 bp, Artificial Sequence
  Synthetic
ggtaattggcgtcctccggct

SEQ ID NO: 10246 - DNA, 21 bp, Artificial Sequence
  Synthetic
ggtacgtttcatcctcctcgg

SEQ ID NO: 10247 - DNA, 21 bp, Artificial Sequence
  Synthetic
ggtgtgtttaatccgcctgag

SEQ ID NO: 10248 - DNA, 21 bp, Artificial Sequence
  Synthetic
ggtcattttacgccgccggtg

SEQ ID NO: 10249 - DNA, 21 bp, Artificial Sequence
  Synthetic
ggggtttgggttcctccgaat

SEQ ID NO: 10250 - DNA, 21 bp, Artificial Sequence
  Synthetic
gggcgttttgtgcctcctcag

SEQ ID NO: 10251 - DNA, 21 bp, Artificial Sequence
  Synthetic
gctcttgatcgtccgtttatt

SEQ ID NO: 10252 - DNA, 21 bp, Artificial Sequence
  Synthetic
actccgcagaggccttttatt

SEQ ID NO: 10253 - DNA, 21 bp, Artificial Sequence
  Synthetic
tcggtggataagccgtttttg

SEQ ID NO: 10254 - DNA, 21 bp, Artificial Sequence
  Synthetic
agtattggtaagccttttatt

SEQ ID NO: 10255 - DNA, 21 bp, Artificial Sequence
  Synthetic
agtgctgctcgtccttttact

SEQ ID NO: 10256 - DNA, 21 bp, Artificial Sequence
  Synthetic
acgagtgggcggccttttgtg

SEQ ID NO: 10257 - DNA, 21 bp, Artificial Sequence
  Synthetic
tcgcagtctaggccgtttcag

SEQ ID NO: 10258 - DNA, 21 bp, Artificial Sequence
  Synthetic
ggtattgggaggccttttact

SEQ ID NO: 10259 - DNA, 21 bp, Artificial Sequence
  Synthetic
acgctggcgaagccgtttcat

SEQ ID NO: 10260 - DNA, 21 bp, Artificial Sequence
  Synthetic
attgtgactaagccgtttctg

SEQ ID NO: 10261 - DNA, 21 bp, Artificial Sequence
  Synthetic
ggtgttgataggccttttttg

SEQ ID NO: 10262 - DNA, 21 bp, Artificial Sequence
  Synthetic
tctattgataagcctttttat

SEQ ID NO: 10263 - DNA, 21 bp, Artificial Sequence
  Synthetic
actgggagtaagccttttttg

SEQ ID NO: 10264 - DNA, 21 bp, Artificial Sequence
  Synthetic
actcgtgataggccgtttatt

SEQ ID NO: 10265 - DNA, 21 bp, Artificial Sequence
  Synthetic
aatttgacgcgtccgtttatt

SEQ ID NO: 10266 - DNA, 21 bp, Artificial Sequence
  Synthetic
gattttgcgcgtccttttctt

SEQ ID NO: 10267 - DNA, 21 bp, Artificial Sequence
  Synthetic
attgcgagtcggccttttctg

SEQ ID NO: 10268 - DNA, 21 bp, Artificial Sequence
  Synthetic
ctgttgaatcgtccgtttgcg

SEQ ID NO: 10269 - DNA, 21 bp, Artificial Sequence
  Synthetic
actactggtaggccttttgtt

SEQ ID NO: 10270 - DNA, 21 bp, Artificial Sequence
  Synthetic
agtccgcttaagccttttctg

SEQ ID NO: 10271 - DNA, 21 bp, Artificial Sequence
  Synthetic
tcgggtgctaggccgtttatt

SEQ ID NO: 10272 - DNA, 21 bp, Artificial Sequence
  Synthetic
acgttggcgcggccgtttgcg

SEQ ID NO: 10273 - DNA, 21 bp, Artificial Sequence
  Synthetic
tttcgtgataggccgtttatt

SEQ ID NO: 10274 - DNA, 21 bp, Artificial Sequence
  Synthetic
acgagggagaagccttttcag

SEQ ID NO: 10275 - DNA, 21 bp, Artificial Sequence
  Synthetic
agtattgcgaggccttttagt

SEQ ID NO: 10276 - DNA, 21 bp, Artificial Sequence
  Synthetic
ggtctgacgaggccttttacg

SEQ ID NO: 10277 - DNA, 21 bp, Artificial Sequence
  Synthetic
ggtattgctaagccgtttctg

SEQ ID NO: 10278 - DNA, 21 bp, Artificial Sequence
  Synthetic
tcgagttcgcggccttttatg

SEQ ID NO: 10279 - DNA, 21 bp, Artificial Sequence
  Synthetic
acggttgcgcgtccttttatt

SEQ ID NO: 10280 - DNA, 21 bp, Artificial Sequence
  Synthetic
gatacgagtcgtccgtttctt

SEQ ID NO: 10281 - DNA, 21 bp, Artificial Sequence
  Synthetic
tcgcttacgaagccttttaat

SEQ ID NO: 10282 - DNA, 21 bp, Artificial Sequence
  Synthetic
agtgcgactaagccgtttcat

SEQ ID NO: 10283 - DNA, 21 bp, Artificial Sequence
  Synthetic
acgatgacgaagccttttgtt

SEQ ID NO: 10284 - DNA, 21 bp, Artificial Sequence
  Synthetic
agtactactcggccttttaat

SEQ ID NO: 10285 - DNA, 21 bp, Artificial Sequence
  Synthetic
tatacggggaagccttttcag

SEQ ID NO: 10286 - DNA, 21 bp, Artificial Sequence
  Synthetic
agtgcgattaagccttttctt

SEQ ID NO: 10287 - DNA, 21 bp, Artificial Sequence
  Synthetic
gatttgcataggccttttcat

SEQ ID NO: 10288 - DNA, 21 bp, Artificial Sequence
  Synthetic
gagcagtctcgtccgtttctg

SEQ ID NO: 10289 - DNA, 21 bp, Artificial Sequence
  Synthetic
ggtgagatgaggccttttctt

SEQ ID NO: 10290 - DNA, 21 bp, Artificial Sequence
  Synthetic
tatgatgctaggccgtttttg

SEQ ID NO: 10291 - DNA, 21 bp, Artificial Sequence
  Synthetic
actgggggtaggccttttatt

SEQ ID NO: 10292 - DNA, 21 bp, Artificial Sequence
  Synthetic
actgagcagcgtccgtttctt

SEQ ID NO: 10293 - DNA, 21 bp, Artificial Sequence
  Synthetic
acggatactcggccgtttttg

SEQ ID NO: 10294 - DNA, 21 bp, Artificial Sequence
  Synthetic
acggctgttcgtccgtttgtg

SEQ ID NO: 10295 - DNA, 21 bp, Artificial Sequence
  Synthetic
tctattcctaggccttttcct

SEQ ID NO: 10296 - DNA, 21 bp, Artificial Sequence
  Synthetic
acgtctgatcggccgtttcag

SEQ ID NO: 10297 - DNA, 21 bp, Artificial Sequence
  Synthetic
acggtggcgaagccgtttcat

SEQ ID NO: 10298 - DNA, 21 bp, Artificial Sequence
  Synthetic
gatgttactaggccttttctt

SEQ ID NO: 10299 - DNA, 21 bp, Artificial Sequence
  Synthetic
gatctgagtaggccgtttgtt

SEQ ID NO: 10300 - DNA, 21 bp, Artificial Sequence
  Synthetic
ggtgttacgcgtccttttatt

SEQ ID NO: 10301 - DNA, 21 bp, Artificial Sequence
  Synthetic
ttgccggatcggccttttatg

SEQ ID NO: 10302 - DNA, 21 bp, Artificial Sequence
  Synthetic
agtacggatcgtccttttaag

SEQ ID NO: 10303 - DNA, 21 bp, Artificial Sequence
  Synthetic
atgttgagtaagccgtttttg

SEQ ID NO: 10304 - DNA, 21 bp, Artificial Sequence
  Synthetic
acggtggataggccttttgtt

SEQ ID NO: 10305 - DNA, 21 bp, Artificial Sequence
  Synthetic
agtgtgtctaggccttttatt

SEQ ID NO: 10306 - DNA, 21 bp, Artificial Sequence
  Synthetic
tctgctacgcggccttttgtt

SEQ ID NO: 10307 - DNA, 21 bp, Artificial Sequence
  Synthetic
ttgtctactcgtccgtttatt

SEQ ID NO: 10308 - DNA, 21 bp, Artificial Sequence
  Synthetic
gggctggataagccgtttctt

SEQ ID NO: 10309 - DNA, 21 bp, Artificial Sequence
  Synthetic
tatgaggggaggccttttgtg

SEQ ID NO: 10310 - DNA, 21 bp, Artificial Sequence
  Synthetic
gcgattgcgcggccttttgct

SEQ ID NO: 10311 - DNA, 21 bp, Artificial Sequence
  Synthetic
agtgtgagtcggccttttatg

SEQ ID NO: 10312 - DNA, 21 bp, Artificial Sequence
  Synthetic
actgatgagcgtccttttagg

SEQ ID NO: 10313 - DNA, 21 bp, Artificial Sequence
  Synthetic
tctatgttgaggccgtttgag

SEQ ID NO: 10314 - DNA, 21 bp, Artificial Sequence
  Synthetic
gagatggcgcgtccgtttatg

SEQ ID NO: 10315 - DNA, 21 bp, Artificial Sequence
  Synthetic
ggggtggcgcggccgtttgtt

SEQ ID NO: 10316 - DNA, 21 bp, Artificial Sequence
  Synthetic
tatgtggagcggccgtttgcg

SEQ ID NO: 10317 - DNA, 21 bp, Artificial Sequence
  Synthetic
gatatgtcgcggccttttcat

SEQ ID NO: 10318 - DNA, 21 bp, Artificial Sequence
  Synthetic
aatattgctaggccgttttat

SEQ ID NO: 10319 - DNA, 21 bp, Artificial Sequence
  Synthetic
tcgtctagtcgtccgtttgtt

SEQ ID NO: 10320 - DNA, 21 bp, Artificial Sequence
  Synthetic
gggagggataggccgtttgtg

SEQ ID NO: 10321 - DNA, 21 bp, Artificial Sequence
  Synthetic
tctgcgaataagccgtttctg

SEQ ID NO: 10322 - DNA, 21 bp, Artificial Sequence
  Synthetic
agtgctgatcgtccttttcag

SEQ ID NO: 10323 - DNA, 21 bp, Artificial Sequence
  Synthetic
ggttcggagaggccttttctt

SEQ ID NO: 10324 - DNA, 21 bp, Artificial Sequence
  Synthetic
tctctgacgaagccgtttaat

SEQ ID NO: 10325 - DNA, 21 bp, Artificial Sequence
  Synthetic
tatcctacgaggccgtttaat

SEQ ID NO: 10326 - DNA, 21 bp, Artificial Sequence
  Synthetic
cttttgactcgtccgtttgct

SEQ ID NO: 10327 - DNA, 21 bp, Artificial Sequence
  Synthetic
acggtggagcggccttttagt

SEQ ID NO: 10328 - DNA, 21 bp, Artificial Sequence
  Synthetic
ggtcctagtaggccttttcag

SEQ ID NO: 10329 - DNA, 21 bp, Artificial Sequence
  Synthetic
gggattagtaggccttttcag

SEQ ID NO: 10330 - DNA, 21 bp, Artificial Sequence
  Synthetic
ggggttgatcggccttttgtg

SEQ ID NO: 10331 - DNA, 21 bp, Artificial Sequence
  Synthetic
tatgatactaggccttttact

SEQ ID NO: 10332 - DNA, 21 bp, Artificial Sequence
  Synthetic
aatgtttctcgtccgtttctg

SEQ ID NO: 10333 - DNA, 21 bp, Artificial Sequence
  Synthetic
tcgcctgagaggccttttact

SEQ ID NO: 10334 - DNA, 21 bp, Artificial Sequence
  Synthetic
ggggttggtaagccttttctg

SEQ ID NO: 10335 - DNA, 21 bp, Artificial Sequence
  Synthetic
ttggctagtaagccttttttg

SEQ ID NO: 10336 - DNA, 21 bp, Artificial Sequence
  Synthetic
acgctggggaggccgttttct

SEQ ID NO: 10337 - DNA, 21 bp, Artificial Sequence
  Synthetic
tcgctgaataggccgtttgtt

SEQ ID NO: 10338 - DNA, 21 bp, Artificial Sequence
  Synthetic
tatctgggtaagccttttgtt

SEQ ID NO: 10339 - DNA, 21 bp, Artificial Sequence
  Synthetic
agtcgtgagcggcctttttat

SEQ ID NO: 10340 - DNA, 21 bp, Artificial Sequence
  Synthetic
gatgttgctcggccttttctg

SEQ ID NO: 10341 - DNA, 21 bp, Artificial Sequence
  Synthetic
agtcagagtaggccttttaat

SEQ ID NO: 10342 - DNA, 21 bp, Artificial Sequence
  Synthetic
acgagtattcgtccgtttctg

SEQ ID NO: 10343 - DNA, 21 bp, Artificial Sequence
  Synthetic
ctgagtagtcggccttttctt

SEQ ID NO: 10344 - DNA, 21 bp, Artificial Sequence
  Synthetic
tctactcagcgtccttttatg

SEQ ID NO: 10345 - DNA, 21 bp, Artificial Sequence
  Synthetic
agtgagttgaagcctttttat

SEQ ID NO: 10346 - DNA, 21 bp, Artificial Sequence
  Synthetic
tctgttgatcgtccttttgtg

SEQ ID NO: 10347 - DNA, 21 bp, Artificial Sequence
  Synthetic
gggcctgatcgtccttttgtg

SEQ ID NO: 10348 - DNA, 21 bp, Artificial Sequence
  Synthetic
gcgacggctcggccttttttg

SEQ ID NO: 10349 - DNA, 21 bp, Artificial Sequence
  Synthetic
gagcttgtgaggccgtttctt

SEQ ID NO: 10350 - DNA, 21 bp, Artificial Sequence
  Synthetic
agtccgttgaggccttttact

SEQ ID NO: 10351 - DNA, 21 bp, Artificial Sequence
  Synthetic
tcgtctgagcggccgtttcag

SEQ ID NO: 10352 - DNA, 21 bp, Artificial Sequence
  Synthetic
gagtctttgaggccgtttctg

SEQ ID NO: 10353 - DNA, 21 bp, Artificial Sequence
  Synthetic
gaggcgcttcgtccgtttatg

SEQ ID NO: 10354 - DNA, 21 bp, Artificial Sequence
  Synthetic
agtactcagcgtccttttact

SEQ ID NO: 10355 - DNA, 21 bp, Artificial Sequence
  Synthetic
gcggcgagtcggccgtttatg

SEQ ID NO: 10356 - DNA, 21 bp, Artificial Sequence
  Synthetic
ggggagacgcggccttttctt

SEQ ID NO: 10357 - DNA, 21 bp, Artificial Sequence
  Synthetic
gtgccggcgcggccgtttctg

SEQ ID NO: 10358 - DNA, 21 bp, Artificial Sequence
  Synthetic
agtcgtgagcggccgtttacg

SEQ ID NO: 10359 - DNA, 21 bp, Artificial Sequence
  Synthetic
tatgctaatcggccttttacg

SEQ ID NO: 10360 - DNA, 21 bp, Artificial Sequence
  Synthetic
acgggtacgcgtccttttgtt

SEQ ID NO: 10361 - DNA, 21 bp, Artificial Sequence
  Synthetic
aatgctattcggccttttatt

SEQ ID NO: 10362 - DNA, 21 bp, Artificial Sequence
  Synthetic
acttgtgcgaagccgtttttg

SEQ ID NO: 10363 - DNA, 21 bp, Artificial Sequence
  Synthetic
tatcttagtaagccttttgtg

SEQ ID NO: 10364 - DNA, 21 bp, Artificial Sequence
  Synthetic
gatcttaatcgtccgtttcgg

SEQ ID NO: 10365 - DNA, 21 bp, Artificial Sequence
  Synthetic
agtgagcatcgtccgtttatt

SEQ ID NO: 10366 - DNA, 21 bp, Artificial Sequence
  Synthetic
agtggggatcggccttttctt

SEQ ID NO: 10367 - DNA, 21 bp, Artificial Sequence
  Synthetic
tatccgtctcgtccttttgtg

SEQ ID NO: 10368 - DNA, 21 bp, Artificial Sequence
  Synthetic
tctgttgagaagccgttttgg

SEQ ID NO: 10369 - DNA, 21 bp, Artificial Sequence
  Synthetic
tctctttcgaagccgtttgcg

SEQ ID NO: 10370 - DNA, 21 bp, Artificial Sequence
  Synthetic
agtacgtctaagcctttttat

SEQ ID NO: 10371 - DNA, 21 bp, Artificial Sequence
  Synthetic
tggcttgagaggccgtttgct

SEQ ID NO: 10372 - DNA, 21 bp, Artificial Sequence
  Synthetic
tcgcaggatcgtccttttatt

SEQ ID NO: 10373 - DNA, 21 bp, Artificial Sequence
  Synthetic
agtctggagcggccgtttatt

SEQ ID NO: 10374 - DNA, 21 bp, Artificial Sequence
  Synthetic
gtggctggtcggccttttttg

SEQ ID NO: 10375 - DNA, 21 bp, Artificial Sequence
  Synthetic
tatgcggataagccttttctg

SEQ ID NO: 10376 - DNA, 21 bp, Artificial Sequence
  Synthetic
agtattgtgaggccttttgtg

SEQ ID NO: 10377 - DNA, 21 bp, Artificial Sequence
  Synthetic
tcgattgctcggccttttacg

SEQ ID NO: 10378 - DNA, 21 bp, Artificial Sequence
  Synthetic
gagtatacgcgtccttttatg

SEQ ID NO: 10379 - DNA, 21 bp, Artificial Sequence
  Synthetic
acgcttgataagccttttact

SEQ ID NO: 10380 - DNA, 21 bp, Artificial Sequence
  Synthetic
gagattcttaggccttttatg

SEQ ID NO: 10381 - DNA, 21 bp, Artificial Sequence
  Synthetic
agtcgtgagcggccttttgtt

SEQ ID NO: 10382 - DNA, 21 bp, Artificial Sequence
  Synthetic
atgccgggtcggccgtttatg

SEQ ID NO: 10383 - DNA, 21 bp, Artificial Sequence
  Synthetic
agtattgagaagccgtttgtg

SEQ ID NO: 10384 - DNA, 21 bp, Artificial Sequence
  Synthetic
gatcttaatcgtccttttcag

SEQ ID NO: 10385 - DNA, 21 bp, Artificial Sequence
  Synthetic
tctgatgggcgtccttttctt

SEQ ID NO: 10386 - DNA, 21 bp, Artificial Sequence
  Synthetic
gctgcggataggccgtttctt

SEQ ID NO: 10387 - DNA, 21 bp, Artificial Sequence
  Synthetic
gatgggtatcgtccttttatt

SEQ ID NO: 10388 - DNA, 21 bp, Artificial Sequence
  Synthetic
gcgcttatgcgtccgtttccg

SEQ ID NO: 10389 - DNA, 21 bp, Artificial Sequence
  Synthetic
ctgcttcagcggccttttctt

SEQ ID NO: 10390 - DNA, 21 bp, Artificial Sequence
  Synthetic
cttccggagcggccgtttgtg

SEQ ID NO: 10391 - DNA, 21 bp, Artificial Sequence
  Synthetic
agtgctctgcggccgtttact

SEQ ID NO: 10392 - DNA, 21 bp, Artificial Sequence
  Synthetic
tatgctcttaagccgtttgtt

SEQ ID NO: 10393 - DNA, 21 bp, Artificial Sequence
  Synthetic
ggtgtgacgcggccgtttcag

SEQ ID NO: 10394 - DNA, 21 bp, Artificial Sequence
  Synthetic
actccggcgaggccgtttacg

SEQ ID NO: 10395 - DNA, 21 bp, Artificial Sequence
  Synthetic
tcggctcctcgtccttttgcg

SEQ ID NO: 10396 - DNA, 21 bp, Artificial Sequence
  Synthetic
tgggagtctaggccgtttatt

SEQ ID NO: 10397 - DNA, 21 bp, Artificial Sequence
  Synthetic
actgttgggcggccttttacg

SEQ ID NO: 10398 - DNA, 21 bp, Artificial Sequence
  Synthetic
cagattgatcgtccttttcgg

SEQ ID NO: 10399 - DNA, 21 bp, Artificial Sequence
  Synthetic
ttgttgtcgaggccgttttct

SEQ ID NO: 10400 - DNA, 21 bp, Artificial Sequence
  Synthetic
agtagttctcggccgtttcag

SEQ ID NO: 10401 - DNA, 21 bp, Artificial Sequence
  Synthetic
tcggttgttaggccgtttccg

SEQ ID NO: 10402 - DNA, 21 bp, Artificial Sequence
  Synthetic
ttgttgagtaggccgtttgcg

SEQ ID NO: 10403 - DNA, 21 bp, Artificial Sequence
  Synthetic
agtgctgcgcgtccgtttatg

SEQ ID NO: 10404 - DNA, 21 bp, Artificial Sequence
  Synthetic
ggtgagctgaggccttttctg

SEQ ID NO: 10405 - DNA, 21 bp, Artificial Sequence
  Synthetic
tatgcggatcgtccttttatt

SEQ ID NO: 10406 - DNA, 21 bp, Artificial Sequence
  Synthetic
tctttggagaggccttttttt

SEQ ID NO: 10407 - DNA, 21 bp, Artificial Sequence
  Synthetic
acgttgcataggccgtttgct

SEQ ID NO: 10408 - DNA, 21 bp, Artificial Sequence
  Synthetic
acgtttgataagccttttttg

SEQ ID NO: 10409 - DNA, 21 bp, Artificial Sequence
  Synthetic
gggcagactcggccgtttctg

SEQ ID NO: 10410 - DNA, 21 bp, Artificial Sequence
  Synthetic
tctgtgaataggccgtttgtt

SEQ ID NO: 10411 - DNA, 21 bp, Artificial Sequence
  Synthetic
acgccggctaagcctttttgg

SEQ ID NO: 10412 - DNA, 21 bp, Artificial Sequence
  Synthetic
gagtataatcgtccgtttatg

SEQ ID NO: 10413 - DNA, 21 bp, Artificial Sequence
  Synthetic
gatatgacgaggccgtttcag

SEQ ID NO: 10414 - DNA, 21 bp, Artificial Sequence
  Synthetic
tctgttgagcggccttttcat

SEQ ID NO: 10415 - DNA, 21 bp, Artificial Sequence
  Synthetic
ggtctggataagccttttctt

SEQ ID NO: 10416 - DNA, 21 bp, Artificial Sequence
  Synthetic
gttattagtcggccttttgcg

SEQ ID NO: 10417 - DNA, 21 bp, Artificial Sequence
  Synthetic
cttattgagaggccgtttcag

SEQ ID NO: 10418 - DNA, 21 bp, Artificial Sequence
  Synthetic
atgttgacgcggccgttttct

SEQ ID NO: 10419 - DNA, 21 bp, Artificial Sequence
  Synthetic
gagattacgaagcctttttgg

SEQ ID NO: 10420 - DNA, 21 bp, Artificial Sequence
  Synthetic
tattctggtcgtccgtttctt

SEQ ID NO: 10421 - DNA, 21 bp, Artificial Sequence
  Synthetic
acgacgcagaagccttttgtt

SEQ ID NO: 10422 - DNA, 21 bp, Artificial Sequence
  Synthetic
gggtttgagcgtccgtttttg

SEQ ID NO: 10423 - DNA, 21 bp, Artificial Sequence
  Synthetic
gatattagtcggccgtttatg

SEQ ID NO: 10424 - DNA, 21 bp, Artificial Sequence
  Synthetic
actacgttgcgtccgtttgtt

SEQ ID NO: 10425 - DNA, 21 bp, Artificial Sequence
  Synthetic
tttcttgataggccgtttccg

SEQ ID NO: 10426 - DNA, 21 bp, Artificial Sequence
  Synthetic
gcgcttgcgaggccgtttcct

SEQ ID NO: 10427 - DNA, 21 bp, Artificial Sequence
  Synthetic
gtgcctgctaagccgtttctg

SEQ ID NO: 10428 - DNA, 21 bp, Artificial Sequence
  Synthetic
tatgatcataggccttttcag

SEQ ID NO: 10429 - DNA, 21 bp, Artificial Sequence
  Synthetic
agtgtggcgaggccgtttatg

SEQ ID NO: 10430 - DNA, 21 bp, Artificial Sequence
  Synthetic
agtgcgatgcgtccttttgtg

SEQ ID NO: 10431 - DNA, 21 bp, Artificial Sequence
  Synthetic
agttcttctaagccttttgtt

SEQ ID NO: 10432 - DNA, 21 bp, Artificial Sequence
  Synthetic
gtgcagactaagccgtttttg

SEQ ID NO: 10433 - DNA, 21 bp, Artificial Sequence
  Synthetic
tcggttttgcggccgtttatg

SEQ ID NO: 10434 - DNA, 21 bp, Artificial Sequence
  Synthetic
tcgatgtcgaagccgtttacg

SEQ ID NO: 10435 - DNA, 21 bp, Artificial Sequence
  Synthetic
gatttgacgcggccgtttttg

SEQ ID NO: 10436 - DNA, 21 bp, Artificial Sequence
  Synthetic
caggtttctaggccttttatg

SEQ ID NO: 10437 - DNA, 21 bp, Artificial Sequence
  Synthetic
tatgagtctaggccgtttact

SEQ ID NO: 10438 - DNA, 21 bp, Artificial Sequence
  Synthetic
ttgccggagcgtccgtttagg

SEQ ID NO: 10439 - DNA, 21 bp, Artificial Sequence
  Synthetic
gataagcatcggccgtttttg

SEQ ID NO: 10440 - DNA, 21 bp, Artificial Sequence
  Synthetic
tatttgacgaggccttttgcg

SEQ ID NO: 10441 - DNA, 21 bp, Artificial Sequence
  Synthetic
ggtgcgtctaggccgtttcag

SEQ ID NO: 10442 - DNA, 21 bp, Artificial Sequence
  Synthetic
gatatggagcgtccttttcat

SEQ ID NO: 10443 - DNA, 21 bp, Artificial Sequence
  Synthetic
gatgtgttgaggccgtttcat

SEQ ID NO: 10444 - DNA, 21 bp, Artificial Sequence
  Synthetic
tggattgagaagccttttatt

SEQ ID NO: 10445 - DNA, 21 bp, Artificial Sequence
  Synthetic
aatttgcagaagccgtttatt

SEQ ID NO: 10446 - DNA, 21 bp, Artificial Sequence
  Synthetic
tctgcggttaggccttttacg

SEQ ID NO: 10447 - DNA, 21 bp, Artificial Sequence
  Synthetic
tatacggggcggccttttgag

SEQ ID NO: 10448 - DNA, 21 bp, Artificial Sequence
  Synthetic
cagccgcagaggccttttgtt

SEQ ID NO: 10449 - DNA, 21 bp, Artificial Sequence
  Synthetic
aggcaggagaggccgtttctt

SEQ ID NO: 10450 - DNA, 21 bp, Artificial Sequence
  Synthetic
ccgtcttcgagtacgtcttgg

SEQ ID NO: 10451 - DNA, 21 bp, Artificial Sequence
  Synthetic
ccggtttcttcttctacgtgg

SEQ ID NO: 10452 - DNA, 21 bp, Artificial Sequence
  Synthetic
ccggtgtcgagttcgtcgtgg

SEQ ID NO: 10453 - DNA, 21 bp, Artificial Sequence
  Synthetic
ccgcagaatcatgtgtcttgg

SEQ ID NO: 10454 - DNA, 21 bp, Artificial Sequence
  Synthetic
ccggttatgacgtcttcgtgg

SEQ ID NO: 10455 - DNA, 21 bp, Artificial Sequence
  Synthetic
ccgagttcttctcatacttgg

SEQ ID NO: 10456 - DNA, 21 bp, Artificial Sequence
  Synthetic
ccggagatgcgtcattcgtgg

SEQ ID NO: 10457 - DNA, 21 bp, Artificial Sequence
  Synthetic
cctacgagtattaattcgtgg

SEQ ID NO: 10458 - DNA, 21 bp, Artificial Sequence
  Synthetic
cctgagaatgctctgtcgtgg

SEQ ID NO: 10459 - DNA, 21 bp, Artificial Sequence
  Synthetic
cctctgaataatacgagttgg

SEQ ID NO: 10460 - DNA, 21 bp, Artificial Sequence
  Synthetic
ccggtggatagggcgacgtgg

SEQ ID NO: 10461 - DNA, 21 bp, Artificial Sequence
  Synthetic
cctaatcatgctatttcgtgg

SEQ ID NO: 10462 - DNA, 21 bp, Artificial Sequence
  Synthetic
ccgactcatactgtgagttgg

SEQ ID NO: 10463 - DNA, 21 bp, Artificial Sequence
  Synthetic
ccttttgatcggagtacttgg

SEQ ID NO: 10464 - DNA, 21 bp, Artificial Sequence
  Synthetic
cctagttctgcgtcgagttgg

SEQ ID NO: 10465 - DNA, 21 bp, Artificial Sequence
  Synthetic
ccggagtctcgtgtttcttgg

SEQ ID NO: 10466 - DNA, 21 bp, Artificial Sequence
  Synthetic
ccggtgacgcggacttcgtgg

SEQ ID NO: 10467 - DNA, 21 bp, Artificial Sequence
  Synthetic
ccgattagttcgtctagttgg

SEQ ID NO: 10468 - DNA, 21 bp, Artificial Sequence
  Synthetic
ccgattagtacgttgtcgtgg

SEQ ID NO: 10469 - DNA, 21 bp, Artificial Sequence
  Synthetic
ccgacgtcttcttattcttgg

SEQ ID NO: 10470 - DNA, 21 bp, Artificial Sequence
  Synthetic
ccgatgcatagtacgtcgtgg

SEQ ID NO: 10471 - DNA, 21 bp, Artificial Sequence
  Synthetic
cctctgtcgactactagttgg

SEQ ID NO: 10472 - DNA, 21 bp, Artificial Sequence
  Synthetic
cctgttgatcgggtgtcgtgg

SEQ ID NO: 10473 - DNA, 21 bp, Artificial Sequence
  Synthetic
cctattaatagtttgagttgg

SEQ ID NO: 10474 - DNA, 21 bp, Artificial Sequence
  Synthetic
cctgcgcatgctacgagttgg

SEQ ID NO: 10475 - DNA, 21 bp, Artificial Sequence
  Synthetic
cctatgatgactactgcgtgg

SEQ ID NO: 10476 - DNA, 21 bp, Artificial Sequence
  Synthetic
cctgatattgcgaggctttgg

SEQ ID NO: 10477 - DNA, 21 bp, Artificial Sequence
  Synthetic
ccgcagagtaattcgagttgg

SEQ ID NO: 10478 - DNA, 21 bp, Artificial Sequence
  Synthetic
ccttcttcgtctagtacttgg

SEQ ID NO: 10479 - DNA, 21 bp, Artificial Sequence
  Synthetic
ccttcgactaatacttcttgg

SEQ ID NO: 10480 - DNA, 21 bp, Artificial Sequence
  Synthetic
cctcgtgctggttctcagtgg

SEQ ID NO: 10481 - DNA, 21 bp, Artificial Sequence
  Synthetic
cctgggcagaagaatacttgg

SEQ ID NO: 10482 - DNA, 21 bp, Artificial Sequence
  Synthetic
ccgccggctcatgggtcttgg

SEQ ID NO: 10483 - DNA, 21 bp, Artificial Sequence
  Synthetic
cctaatcgtacgccggagtgg

SEQ ID NO: 10484 - DNA, 21 bp, Artificial Sequence
  Synthetic
ccggtgattgcttcgcattgg

SEQ ID NO: 10485 - DNA, 21 bp, Artificial Sequence
  Synthetic
cctcatggtgttacgagttgg

SEQ ID NO: 10486 - DNA, 21 bp, Artificial Sequence
  Synthetic
ggtgcgttgggttgggctcct

SEQ ID NO: 10487 - DNA, 21 bp, Artificial Sequence
  Synthetic
agtaagactgggtgggcgccg

SEQ ID NO: 10488 - DNA, 21 bp, Artificial Sequence
  Synthetic
tcgaggcaggggtgggcgccg

SEQ ID NO: 10489 - DNA, 21 bp, Artificial Sequence
  Synthetic
gggacgatgggttgggcgccg

SEQ ID NO: 10490 - DNA, 21 bp, Artificial Sequence
  Synthetic
tctccgaagggttgggctccg

SEQ ID NO: 10491 - DNA, 21 bp, Artificial Sequence
  Synthetic
agtgtgctggggtgggctcct

SEQ ID NO: 10492 - DNA, 21 bp, Artificial Sequence
  Synthetic
tcggctatgggttgggcgccg

SEQ ID NO: 10493 - DNA, 21 bp, Artificial Sequence
  Synthetic
ggttctcttgggtgggcgccg

SEQ ID NO: 10494 - DNA, 21 bp, Artificial Sequence
  Synthetic
tctgcgcttgggtgggctcct

SEQ ID NO: 10495 - DNA, 21 bp, Artificial Sequence
  Synthetic
tcggttattggttgggctcct

SEQ ID NO: 10496 - DNA, 21 bp, Artificial Sequence
  Synthetic
aatactattggttgggctccg

SEQ ID NO: 10497 - DNA, 21 bp, Artificial Sequence
  Synthetic
tctaaggttgggtgggcgccg

SEQ ID NO: 10498 - DNA, 21 bp, Artificial Sequence
  Synthetic
agtattcatgggtgggcgcct

SEQ ID NO: 10499 - DNA, 21 bp, Artificial Sequence
  Synthetic
agtaatactgggtgggcgccg

SEQ ID NO: 10500 - DNA, 21 bp, Artificial Sequence
  Synthetic
tcgaaggctgggtgggcgccg

SEQ ID NO: 10501 - DNA, 21 bp, Artificial Sequence
  Synthetic
tcgcttgtggggtgggcgcct

SEQ ID NO: 10502 - DNA, 21 bp, Artificial Sequence
  Synthetic
gctaatacggggtgggctccg

SEQ ID NO: 10503 - DNA, 21 bp, Artificial Sequence
  Synthetic
catcagactgggtgggctcct

SEQ ID NO: 10504 - DNA, 21 bp, Artificial Sequence
  Synthetic
tcgattagtgggtgggcgccg

SEQ ID NO: 10505 - DNA, 21 bp, Artificial Sequence
  Synthetic
gggaggaatggttgggcgcct

SEQ ID NO: 10506 - DNA, 21 bp, Artificial Sequence
  Synthetic
ctgactctgacgacgagtgtt

SEQ ID NO: 10507 - DNA, 21 bp, Artificial Sequence
  Synthetic
ttgactatgactacgtcggtg

SEQ ID NO: 10508 - DNA, 21 bp, Artificial Sequence
  Synthetic
ctgacgattcggacgagtatt

SEQ ID NO: 10509 - DNA, 21 bp, Artificial Sequence
  Synthetic
ctgacgttgcagactagtatt

SEQ ID NO: 10510 - DNA, 21 bp, Artificial Sequence
  Synthetic
ttgactatgtcgacttctcgg

SEQ ID NO: 10511 - DNA, 21 bp, Artificial Sequence
  Synthetic
ttgacgcttatgacttcgatt

SEQ ID NO: 10512 - DNA, 21 bp, Artificial Sequence
  Synthetic
cttacgcttcatacgagtgtg

SEQ ID NO: 10513 - DNA, 21 bp, Artificial Sequence
  Synthetic
ttgacgttgacgacgagtgtg

SEQ ID NO: 10514 - DNA, 21 bp, Artificial Sequence
  Synthetic
cttactatttcgacttctagg

SEQ ID NO: 10515 - DNA, 21 bp, Artificial Sequence
  Synthetic
ttgactttgcagacttctgtg

SEQ ID NO: 10516 - DNA, 21 bp, Artificial Sequence
  Synthetic
ctgacgctgactacgtcgaag

SEQ ID NO: 10517 - DNA, 21 bp, Artificial Sequence
  Synthetic
ctgactatgaatactagtatt

SEQ ID NO: 10518 - DNA, 21 bp, Artificial Sequence
  Synthetic
catgtgaagtttgaggctatt

SEQ ID NO: 10519 - DNA, 21 bp, Artificial Sequence
  Synthetic
tcggctcgttttgagtttgtg

SEQ ID NO: 10520 - DNA, 21 bp, Artificial Sequence
  Synthetic
acgttgaggtttgagtctatt

SEQ ID NO: 10521 - DNA, 21 bp, Artificial Sequence
  Synthetic
actcagcgttttgagaatatt

SEQ ID NO: 10522 - DNA, 21 bp, Artificial Sequence
  Synthetic
agggtgaagtttgagagtgtt

SEQ ID NO: 10523 - DNA, 21 bp, Artificial Sequence
  Synthetic
agtagtcggtttgagagtgtt

SEQ ID NO: 10524 - DNA, 21 bp, Artificial Sequence
  Synthetic
agtcttaggtttgaggctgtg

SEQ ID NO: 10525 - DNA, 21 bp, Artificial Sequence
  Synthetic
gctttgaggtttgaggctgtt

SEQ ID NO: 10526 - DNA, 21 bp, Artificial Sequence
  Synthetic
atggttaagtttgagcaggtt

SEQ ID NO: 10527 - DNA, 21 bp, Artificial Sequence
  Synthetic
agtaataggtttgaggttgtg

SEQ ID NO: 10528 - DNA, 21 bp, Artificial Sequence
  Synthetic
gcgtttaagtttgagcaggtg

SEQ ID NO: 10529 - DNA, 21 bp, Artificial Sequence
  Synthetic
acgcttaagtttgagaggatt

SEQ ID NO: 10530 - DNA, 21 bp, Artificial Sequence
  Synthetic
tctagtcggtttgaggcggtt

SEQ ID NO: 10531 - DNA, 21 bp, Artificial Sequence
  Synthetic
tctgtgcgttttgagaaggtg

SEQ ID NO: 10532 - DNA, 21 bp, Artificial Sequence
  Synthetic
tcgcggaagtttgagcttgtg

SEQ ID NO: 10533 - DNA, 21 bp, Artificial Sequence
  Synthetic
tctcataagtttgaggttgtt

SEQ ID NO: 10534 - DNA, 21 bp, Artificial Sequence
  Synthetic
cagcgtcgttttgaggaggtt

SEQ ID NO: 10535 - DNA, 21 bp, Artificial Sequence
  Synthetic
actattaggtttgagaatgtt

SEQ ID NO: 10536 - DNA, 21 bp, Artificial Sequence
  Synthetic
tcgatgcgttttgagcatatt

SEQ ID NO: 10537 - DNA, 21 bp, Artificial Sequence
  Synthetic
aaggtgcgttttgagtctgtg

SEQ ID NO: 10538 - DNA, 21 bp, Artificial Sequence
  Synthetic
gtggttaggtttgagcagatt

SEQ ID NO: 10539 - DNA, 21 bp, Artificial Sequence
  Synthetic
agtatgcgttttgagactgtt

SEQ ID NO: 10540 - DNA, 21 bp, Artificial Sequence
  Synthetic
gctcttaagtttgagaatgtt

SEQ ID NO: 10541 - DNA, 21 bp, Artificial Sequence
  Synthetic
tcgtcgcgttttgagcatatt

SEQ ID NO: 10542 - DNA, 21 bp, Artificial Sequence
  Synthetic
acgtataggtttgagtcggtg

SEQ ID NO: 10543 - DNA, 21 bp, Artificial Sequence
  Synthetic
gttgtgaggtttgaggcggtt

SEQ ID NO: 10544 - DNA, 21 bp, Artificial Sequence
  Synthetic
cagagtaagtttgagagtatt

SEQ ID NO: 10545 - DNA, 21 bp, Artificial Sequence
  Synthetic
ctgatgaggtttgagcaggtt

SEQ ID NO: 10546 - DNA, 21 bp, Artificial Sequence
  Synthetic
cggaataggtttgaggatatt

SEQ ID NO: 10547 - DNA, 21 bp, Artificial Sequence
  Synthetic
cagctgaggtttgagagtatt

SEQ ID NO: 10548 - DNA, 21 bp, Artificial Sequence
  Synthetic
cagtataggtttgaggatgtt

SEQ ID NO: 10549 - DNA, 21 bp, Artificial Sequence
  Synthetic
cagattaggtttgagcaggtt

SEQ ID NO: 10550 - DNA, 21 bp, Artificial Sequence
  Synthetic
cagcttcggtttgaggtgatg

SEQ ID NO: 10551 - DNA, 21 bp, Artificial Sequence
  Synthetic
gttatgcgttttgagcagatt

SEQ ID NO: 10552 - DNA, 21 bp, Artificial Sequence
  Synthetic
gggacgtttttgccgccgagt

SEQ ID NO: 10553 - DNA, 21 bp, Artificial Sequence
  Synthetic
ggtcagtggcagcctcctagt

SEQ ID NO: 10554 - DNA, 21 bp, Artificial Sequence
  Synthetic
aggacttttagtcctccttcg

SEQ ID NO: 10555 - DNA, 21 bp, Artificial Sequence
  Synthetic
gggagttttcttcctcctagt

SEQ ID NO: 10556 - DNA, 21 bp, Artificial Sequence
  Synthetic
gggcagttttctcctccgagt

SEQ ID NO: 10557 - DNA, 21 bp, Artificial Sequence
  Synthetic
gtttcgtttagtcctccgagt

SEQ ID NO: 10558 - DNA, 21 bp, Artificial Sequence
  Synthetic
aatacgttttctcctccgagt

SEQ ID NO: 10559 - DNA, 21 bp, Artificial Sequence
  Synthetic
ggttcgtggactcctccttct

SEQ ID NO: 10560 - DNA, 21 bp, Artificial Sequence
  Synthetic
tatacgtttgcgccgccgagt

SEQ ID NO: 10561 - DNA, 21 bp, Artificial Sequence
  Synthetic
cataattgggatccgccgagt

SEQ ID NO: 10562 - DNA, 21 bp, Artificial Sequence
  Synthetic
ggggtgtgggttccgcctagt

SEQ ID NO: 10563 - DNA, 21 bp, Artificial Sequence
  Synthetic
gggttgtttactccgccgtcg

SEQ ID NO: 10564 - DNA, 21 bp, Artificial Sequence
  Synthetic
ggtcattttacgcctccgtcg

SEQ ID NO: 10565 - DNA, 21 bp, Artificial Sequence
  Synthetic
gggtcgtttgcgcctccttct

SEQ ID NO: 10566 - DNA, 21 bp, Artificial Sequence
  Synthetic
ggtaattttgtgcctccgagt

SEQ ID NO: 10567 - DNA, 21 bp, Artificial Sequence
  Synthetic
actgtttggaatcctccttct

SEQ ID NO: 10568 - DNA, 21 bp, Artificial Sequence
  Synthetic
aagacgtgggagccgccgtct

SEQ ID NO: 10569 - DNA, 21 bp, Artificial Sequence
  Synthetic
agtagtgcgggttgggttgct

SEQ ID NO: 10570 - DNA, 21 bp, Artificial Sequence
  Synthetic
agtaagactgggtgggcgccg

SEQ ID NO: 10571 - DNA, 21 bp, Artificial Sequence
  Synthetic
agtagggttggttgggtggcg

SEQ ID NO: 10572 - DNA, 21 bp, Artificial Sequence
  Synthetic
agttcgattgggtggagtgcg

SEQ ID NO: 10573 - DNA, 21 bp, Artificial Sequence
  Synthetic
tcttctattgggtggactccg

SEQ ID NO: 10574 - DNA, 21 bp, Artificial Sequence
  Synthetic
tcgaggcaggggtgggcgccg

SEQ ID NO: 10575 - DNA, 21 bp, Artificial Sequence
  Synthetic
tctccgaagggttgggctccg

SEQ ID NO: 10576 - DNA, 21 bp, Artificial Sequence
  Synthetic
tctcctattggttggagtccg

SEQ ID NO: 10577 - DNA, 21 bp, Artificial Sequence
  Synthetic
tcggttgtggggtggtcggcg

SEQ ID NO: 10578 - DNA, 21 bp, Artificial Sequence
  Synthetic
agtgtgctggggtgggctcct

SEQ ID NO: 10579 - DNA, 21 bp, Artificial Sequence
  Synthetic
tcgattgcgggttgggtggct

SEQ ID NO: 10580 - DNA, 21 bp, Artificial Sequence
  Synthetic
tcggctatgggttgggcgccg

SEQ ID NO: 10581 - DNA, 21 bp, Artificial Sequence
  Synthetic
agtgctgttggttgggctgct

SEQ ID NO: 10582 - DNA, 21 bp, Artificial Sequence
  Synthetic
tctgcgcttgggtgggctcct

SEQ ID NO: 10583 - DNA, 21 bp, Artificial Sequence
  Synthetic
agtcttggtggttgggtggct

SEQ ID NO: 10584 - DNA, 21 bp, Artificial Sequence
  Synthetic
tcggttattggttgggctcct

SEQ ID NO: 10585 - DNA, 21 bp, Artificial Sequence
  Synthetic
tcgagtttggggtgggctgcg

SEQ ID NO: 10586 - DNA, 21 bp, Artificial Sequence
  Synthetic
agttcggtgggttggctggct

SEQ ID NO: 10587 - DNA, 21 bp, Artificial Sequence
  Synthetic
agtgctttggggtggtcggcg

SEQ ID NO: 10588 - DNA, 21 bp, Artificial Sequence
  Synthetic
agtcctgtggggtggtcgccg

SEQ ID NO: 10589 - DNA, 21 bp, Artificial Sequence
  Synthetic
tctgagttgggttggagtccg

SEQ ID NO: 10590 - DNA, 21 bp, Artificial Sequence
  Synthetic
agtaaggttgggtggacggct

SEQ ID NO: 10591 - DNA, 21 bp, Artificial Sequence
  Synthetic
tcgcttgtgggttgggctgct

SEQ ID NO: 10592 - DNA, 21 bp, Artificial Sequence
  Synthetic
tcggagagtgggtgggtggct

SEQ ID NO: 10593 - DNA, 21 bp, Artificial Sequence
  Synthetic
tctactattgggtggattgcg

SEQ ID NO: 10594 - DNA, 21 bp, Artificial Sequence
  Synthetic
agtgcgatgggttgggttgcg

SEQ ID NO: 10595 - DNA, 21 bp, Artificial Sequence
  Synthetic
tcggttgtggggtgggcggcg

SEQ ID NO: 10596 - DNA, 21 bp, Artificial Sequence
  Synthetic
tctcctattggttggagtgcg

SEQ ID NO: 10597 - DNA, 21 bp, Artificial Sequence
  Synthetic
tcggatcggggttggacggct

SEQ ID NO: 10598 - DNA, 21 bp, Artificial Sequence
  Synthetic
tctaaggttgggtgggcgccg

SEQ ID NO: 10599 - DNA, 21 bp, Artificial Sequence
  Synthetic
agtaggactgggtggacggcg

SEQ ID NO: 10600 - DNA, 21 bp, Artificial Sequence
  Synthetic
tcgattgtggggtgggctgcg

SEQ ID NO: 10601 - DNA, 21 bp, Artificial Sequence
  Synthetic
agtattcatgggtgggcgcct

SEQ ID NO: 10602 - DNA, 21 bp, Artificial Sequence
  Synthetic
agtggtattgggtggactgcg

SEQ ID NO: 10603 - DNA, 21 bp, Artificial Sequence
  Synthetic
tctttgcaggggtgggttgcg

SEQ ID NO: 10604 - DNA, 21 bp, Artificial Sequence
  Synthetic
agtaatactgggtgggcgccg

SEQ ID NO: 10605 - DNA, 21 bp, Artificial Sequence
  Synthetic
tcgaaggctgggtgggcgccg

SEQ ID NO: 10606 - DNA, 21 bp, Artificial Sequence
  Synthetic
agtgagcttggttggattccg

SEQ ID NO: 10607 - DNA, 21 bp, Artificial Sequence
  Synthetic
agtgggaatgggtgggttgcg

SEQ ID NO: 10608 - DNA, 21 bp, Artificial Sequence
  Synthetic
agtctgcatgggtgggctgct

SEQ ID NO: 10609 - DNA, 21 bp, Artificial Sequence
  Synthetic
agtgttttggggtggactgcg

SEQ ID NO: 10610 - DNA, 21 bp, Artificial Sequence
  Synthetic
tcgctggttgggtgggctgcg

SEQ ID NO: 10611 - DNA, 21 bp, Artificial Sequence
  Synthetic
tcgcttgtggggtgggcgcct

SEQ ID NO: 10612 - DNA, 21 bp, Artificial Sequence
  Synthetic
agtgcgactggttgggttgct

SEQ ID NO: 10613 - DNA, 21 bp, Artificial Sequence
  Synthetic
agttcgcttggttgggctgct

SEQ ID NO: 10614 - DNA, 21 bp, Artificial Sequence
  Synthetic
tctgaggtggggtgggctgct

SEQ ID NO: 10615 - DNA, 21 bp, Artificial Sequence
  Synthetic
agttctcctggttgggttgcg

SEQ ID NO: 10616 - DNA, 21 bp, Artificial Sequence
  Synthetic
tcgtctcatggttggattgct

SEQ ID NO: 10617 - DNA, 21 bp, Artificial Sequence
  Synthetic
tctggtcctggttgggttgct

SEQ ID NO: 10618 - DNA, 21 bp, Artificial Sequence
  Synthetic
tcggattcggggtgggtggcg

SEQ ID NO: 10619 - DNA, 21 bp, Artificial Sequence
  Synthetic
tcgtttcctggttggagtgcg

SEQ ID NO: 10620 - DNA, 21 bp, Artificial Sequence
  Synthetic
tcgattagtgggtgggcgccg

SEQ ID NO: 10621 - DNA, 21 bp, Artificial Sequence
  Synthetic
tcggatttgggttggcatcct

SEQ ID NO: 10622 - DNA, 21 bp, Artificial Sequence
  Synthetic
agtacgcatgggtgggcggcg

SEQ ID NO: 10623 - DNA, 21 bp, Artificial Sequence
  Synthetic
tctccgggtggttggccgccg

SEQ ID NO: 10624 - DNA, 21 bp, Artificial Sequence
  Synthetic
tctgatgttggttggtctccg

SEQ ID NO: 10625 - DNA, 21 bp, Artificial Sequence
  Synthetic
tcgcatgcggggtgggcggcg

SEQ ID NO: 10626 - protein, 7 aa, Artificial Sequence
  Synthetic
VKFGYSS

SEQ ID NO: 10627 - protein, 7 aa, Artificial Sequence
  Synthetic
NKYGYSQ

SEQ ID NO: 10628 - protein, 7 aa, Artificial Sequence
  Synthetic
QKFGYSQ

SEQ ID NO: 10629 - protein, 7 aa, Artificial Sequence
  Synthetic
MRLGYSQ

SEQ ID NO: 10630 - protein, 7 aa, Artificial Sequence
  Synthetic
QKYGYSS

SEQ ID NO: 10631 - protein, 7 aa, Artificial Sequence
  Synthetic
LKFGYST

SEQ ID NO: 10632 - protein, 7 aa, Artificial Sequence
  Synthetic
NKYGYST

SEQ ID NO: 10633 - protein, 7 aa, Artificial Sequence
  Synthetic
SKHGYSQ

SEQ ID NO: 10634 - protein, 7 aa, Artificial Sequence
  Synthetic
VKYGYSQ

SEQ ID NO: 10635 - protein, 7 aa, Artificial Sequence
  Synthetic
LKYGYST

SEQ ID NO: 10636 - protein, 7 aa, Artificial Sequence
  Synthetic
MKIGYSS

SEQ ID NO: 10637 - protein, 7 aa, Artificial Sequence
  Synthetic
VRMGYSQ

SEQ ID NO: 10638 - protein, 7 aa, Artificial Sequence
  Synthetic
QRTGYSQ

SEQ ID NO: 10639 - protein, 7 aa, Artificial Sequence
  Synthetic
IRLGYSS

SEQ ID NO: 10640 - protein, 7 aa, Artificial Sequence
  Synthetic
QKYGYSQ

SEQ ID NO: 10641 - protein, 7 aa, Artificial Sequence
  Synthetic
SRIGYST

SEQ ID NO: 10642 - protein, 7 aa, Artificial Sequence
  Synthetic
NKYGYST

SEQ ID NO: 10643 - protein, 7 aa, Artificial Sequence
  Synthetic
QRHGYSQ

SEQ ID NO: 10644 - protein, 7 aa, Artificial Sequence
  Synthetic
HRVGYSQ

SEQ ID NO: 10645 - protein, 7 aa, Artificial Sequence
  Synthetic
MRVGYSQ

SEQ ID NO: 10646 - protein, 7 aa, Artificial Sequence
  Synthetic
DRFGYSQ

SEQ ID NO: 10647 - protein, 7 aa, Artificial Sequence
  Synthetic
QDLLNMR

SEQ ID NO: 10648 - protein, 7 aa, Artificial Sequence
  Synthetic
LRHGYSQ

SEQ ID NO: 10649 - protein, 7 aa, Artificial Sequence
  Synthetic
EKVGYSQ

SEQ ID NO: 10650 - protein, 7 aa, Artificial Sequence
  Synthetic
TRTGYSQ

SEQ ID NO: 10651 - protein, 7 aa, Artificial Sequence
  Synthetic
AKYGYSQ

SEQ ID NO: 10652 - protein, 7 aa, Artificial Sequence
  Synthetic
VRHGYSQ

SEQ ID NO: 10653 - protein, 7 aa, Artificial Sequence
  Synthetic
QKLGYSQ

SEQ ID NO: 10654 - protein, 7 aa, Artificial Sequence
  Synthetic
MKFGYSQ

SEQ ID NO: 10655 - protein, 7 aa, Artificial Sequence
  Synthetic
QKYGYSQ

SEQ ID NO: 10656 - protein, 7 aa, Artificial Sequence
  Synthetic
NRIGYSS

SEQ ID NO: 10657 - protein, 7 aa, Artificial Sequence
  Synthetic
FKMGYSQ

SEQ ID NO: 10658 - protein, 7 aa, Artificial Sequence
  Synthetic
NRVGFSQ

SEQ ID NO: 10659 - protein, 7 aa, Artificial Sequence
  Synthetic
MRIGYSQ

SEQ ID NO: 10660 - protein, 7 aa, Artificial Sequence
  Synthetic
VRVGYSQ

SEQ ID NO: 10661 - protein, 7 aa, Artificial Sequence
  Synthetic
LKYGYST

SEQ ID NO: 10662 - protein, 7 aa, Artificial Sequence
  Synthetic
QRAGYSQ

SEQ ID NO: 10663 - protein, 7 aa, Artificial Sequence
  Synthetic
EKFGYST

SEQ ID NO: 10664 - protein, 7 aa, Artificial Sequence
  Synthetic
NRVGFSQ

SEQ ID NO: 10665 - protein, 7 aa, Artificial Sequence
  Synthetic
WRIGYSQ

SEQ ID NO: 10666 - protein, 7 aa, Artificial Sequence
  Synthetic
DKPGYSQ

SEQ ID NO: 10667 - protein, 7 aa, Artificial Sequence
  Synthetic
LRGGYST

SEQ ID NO: 10668 - protein, 7 aa, Artificial Sequence
  Synthetic
TKFGYST

SEQ ID NO: 10669 - protein, 7 aa, Artificial Sequence
  Synthetic
KSVGSVY

SEQ ID NO: 10670 - protein, 7 aa, Artificial Sequence
  Synthetic
TRVGYSQ

SEQ ID NO: 10671 - protein, 7 aa, Artificial Sequence
  Synthetic
HRTGYSS

SEQ ID NO: 10672 - protein, 7 aa, Artificial Sequence
  Synthetic
IRTGYSQ

SEQ ID NO: 10673 - protein, 7 aa, Artificial Sequence
  Synthetic
IRVGYSQ

SEQ ID NO: 10674 - protein, 7 aa, Artificial Sequence
  Synthetic
IKYGYST

SEQ ID NO: 10675 - protein, 7 aa, Artificial Sequence
  Synthetic
LKTGYSQ

SEQ ID NO: 10676 - protein, 7 aa, Artificial Sequence
  Synthetic
QRSGYSQ

SEQ ID NO: 10677 - protein, 7 aa, Artificial Sequence
  Synthetic
WKIGYSQ

SEQ ID NO: 10678 - protein, 7 aa, Artificial Sequence
  Synthetic
MRTGYSQ

SEQ ID NO: 10679 - protein, 7 aa, Artificial Sequence
  Synthetic
LRHGYST

SEQ ID NO: 10680 - protein, 7 aa, Artificial Sequence
  Synthetic
PKYSVNV

SEQ ID NO: 10681 - protein, 7 aa, Artificial Sequence
  Synthetic
IKTGYSS

SEQ ID NO: 10682 - protein, 7 aa, Artificial Sequence
  Synthetic
TRIGYSS

SEQ ID NO: 10683 - protein, 7 aa, Artificial Sequence
  Synthetic
LRVGYSS

SEQ ID NO: 10684 - protein, 7 aa, Artificial Sequence
  Synthetic
LRTGYST

SEQ ID NO: 10685 - protein, 7 aa, Artificial Sequence
  Synthetic
MKLGYSS

SEQ ID NO: 10686 - protein, 7 aa, Artificial Sequence
  Synthetic
HRTGYSQ

SEQ ID NO: 10687 - protein, 7 aa, Artificial Sequence
  Synthetic
IKAGYSQ

SEQ ID NO: 10688 - protein, 7 aa, Artificial Sequence
  Synthetic
MKVGYSQ

SEQ ID NO: 10689 - protein, 7 aa, Artificial Sequence
  Synthetic
YTLSQGW

SEQ ID NO: 10690 - protein, 7 aa, Artificial Sequence
  Synthetic
VRMGYSS

SEQ ID NO: 10691 - protein, 7 aa, Artificial Sequence
  Synthetic
IRIGYSQ

SEQ ID NO: 10692 - protein, 7 aa, Artificial Sequence
  Synthetic
QKAGYSQ

SEQ ID NO: 10693 - protein, 7 aa, Artificial Sequence
  Synthetic
LRVGYSQ

SEQ ID NO: 10694 - protein, 7 aa, Artificial Sequence
  Synthetic
IRVGYSQ

SEQ ID NO: 10695 - protein, 7 aa, Artificial Sequence
  Synthetic
TRPGYSQ

SEQ ID NO: 10696 - protein, 7 aa, Artificial Sequence
  Synthetic
MRPGYSQ

SEQ ID NO: 10697 - protein, 7 aa, Artificial Sequence
  Synthetic
ARLGYSS

SEQ ID NO: 10698 - protein, 7 aa, Artificial Sequence
  Synthetic
VKLGYSQ

SEQ ID NO: 10699 - protein, 7 aa, Artificial Sequence
  Synthetic
TRGGYST

SEQ ID NO: 10700 - protein, 7 aa, Artificial Sequence
  Synthetic
IRIGYSS

SEQ ID NO: 10701 - protein, 7 aa, Artificial Sequence
  Synthetic
TRGGYSQ

SEQ ID NO: 10702 - protein, 7 aa, Artificial Sequence
  Synthetic
FKSGYSQ

SEQ ID NO: 10703 - protein, 7 aa, Artificial Sequence
  Synthetic
FRVGYSQ

SEQ ID NO: 10704 - protein, 7 aa, Artificial Sequence
  Synthetic
SRTGYSS

SEQ ID NO: 10705 - protein, 7 aa, Artificial Sequence
  Synthetic
LLKGYAQ

SEQ ID NO: 10706 - protein, 7 aa, Artificial Sequence
  Synthetic
QRIGYSS

SEQ ID NO: 10707 - protein, 7 aa, Artificial Sequence
  Synthetic
VKMGYSQ

SEQ ID NO: 10708 - protein, 7 aa, Artificial Sequence
  Synthetic
SKAGYSQ

SEQ ID NO: 10709 - protein, 7 aa, Artificial Sequence
  Synthetic
QKPGYSQ

SEQ ID NO: 10710 - protein, 7 aa, Artificial Sequence
  Synthetic
TKAGYSQ

SEQ ID NO: 10711 - protein, 7 aa, Artificial Sequence
  Synthetic
YRHGYSQ

SEQ ID NO: 10712 - protein, 7 aa, Artificial Sequence
  Synthetic
QRIGYSQ

SEQ ID NO: 10713 - protein, 7 aa, Artificial Sequence
  Synthetic
MRIGYSS

SEQ ID NO: 10714 - protein, 7 aa, Artificial Sequence
  Synthetic
WKSGYSQ

SEQ ID NO: 10715 - protein, 7 aa, Artificial Sequence
  Synthetic
VKVGYSQ

SEQ ID NO: 10716 - protein, 7 aa, Artificial Sequence
  Synthetic
FKVGYSQ

SEQ ID NO: 10717 - protein, 7 aa, Artificial Sequence
  Synthetic
IRIGYST

SEQ ID NO: 10718 - protein, 7 aa, Artificial Sequence
  Synthetic
EKYGYST

SEQ ID NO: 10719 - protein, 7 aa, Artificial Sequence
  Synthetic
YRTGYSQ

SEQ ID NO: 10720 - protein, 7 aa, Artificial Sequence
  Synthetic
MRGGYSQ

SEQ ID NO: 10721 - protein, 7 aa, Artificial Sequence
  Synthetic
TKFGYSS

SEQ ID NO: 10722 - protein, 7 aa, Artificial Sequence
  Synthetic
FKHGYSQ

SEQ ID NO: 10723 - protein, 7 aa, Artificial Sequence
  Synthetic
TKQGYST

SEQ ID NO: 10724 - protein, 7 aa, Artificial Sequence
  Synthetic
TRTGYSS

SEQ ID NO: 10725 - protein, 7 aa, Artificial Sequence
  Synthetic
NKMGYST

SEQ ID NO: 10726 - protein, 7 aa, Artificial Sequence
  Synthetic
TKPGYSQ

SEQ ID NO: 10727 - protein, 7 aa, Artificial Sequence
  Synthetic
NKIGYSQ

SEQ ID NO: 10728 - protein, 7 aa, Artificial Sequence
  Synthetic
TRAGYSS

SEQ ID NO: 10729 - protein, 7 aa, Artificial Sequence
  Synthetic
LKYGYSS

SEQ ID NO: 10730 - protein, 7 aa, Artificial Sequence
  Synthetic
ARIGYSQ

SEQ ID NO: 10731 - protein, 7 aa, Artificial Sequence
  Synthetic
QKAGYSQ

SEQ ID NO: 10732 - protein, 7 aa, Artificial Sequence
  Synthetic
QRPGYSQ

SEQ ID NO: 10733 - protein, 7 aa, Artificial Sequence
  Synthetic
VRLGYSS

SEQ ID NO: 10734 - protein, 7 aa, Artificial Sequence
  Synthetic
WKTGYSQ

SEQ ID NO: 10735 - protein, 7 aa, Artificial Sequence
  Synthetic
IKMGYST

SEQ ID NO: 10736 - protein, 7 aa, Artificial Sequence
  Synthetic
VKLGYSQ

SEQ ID NO: 10737 - protein, 7 aa, Artificial Sequence
  Synthetic
TRIGYSQ

SEQ ID NO: 10738 - protein, 7 aa, Artificial Sequence
  Synthetic
WKHGYSQ

SEQ ID NO: 10739 - protein, 7 aa, Artificial Sequence
  Synthetic
QITNYHV

SEQ ID NO: 10740 - protein, 7 aa, Artificial Sequence
  Synthetic
LKMGYSQ

SEQ ID NO: 10741 - protein, 7 aa, Artificial Sequence
  Synthetic
NRTGYSQ

SEQ ID NO: 10742 - protein, 7 aa, Artificial Sequence
  Synthetic
LRIGYSQ

SEQ ID NO: 10743 - protein, 7 aa, Artificial Sequence
  Synthetic
QRIGYSS

SEQ ID NO: 10744 - protein, 7 aa, Artificial Sequence
  Synthetic
VRVGYSS

SEQ ID NO: 10745 - protein, 7 aa, Artificial Sequence
  Synthetic
LKVNYSQ

SEQ ID NO: 10746 - protein, 7 aa, Artificial Sequence
  Synthetic
SRIGYSQ

SEQ ID NO: 10747 - protein, 7 aa, Artificial Sequence
  Synthetic
KSVGSVY

SEQ ID NO: 10748 - protein, 7 aa, Artificial Sequence
  Synthetic
NRMGYST

SEQ ID NO: 10749 - protein, 7 aa, Artificial Sequence
  Synthetic
YRVGYSQ

SEQ ID NO: 10750 - protein, 7 aa, Artificial Sequence
  Synthetic
MRAGYST

SEQ ID NO: 10751 - protein, 7 aa, Artificial Sequence
  Synthetic
MKTGYSQ

SEQ ID NO: 10752 - protein, 7 aa, Artificial Sequence
  Synthetic
VRQGYSQ

SEQ ID NO: 10753 - protein, 7 aa, Artificial Sequence
  Synthetic
SKIGYSQ

SEQ ID NO: 10754 - protein, 7 aa, Artificial Sequence
  Synthetic
LRTGYSQ

SEQ ID NO: 10755 - protein, 7 aa, Artificial Sequence
  Synthetic
VKSGYSQ

SEQ ID NO: 10756 - protein, 7 aa, Artificial Sequence
  Synthetic
LKIGYSQ

SEQ ID NO: 10757 - protein, 7 aa, Artificial Sequence
  Synthetic
AKAGYSQ

SEQ ID NO: 10758 - protein, 7 aa, Artificial Sequence
  Synthetic
VRMGYSS

SEQ ID NO: 10759 - protein, 7 aa, Artificial Sequence
  Synthetic
FKAGYSQ

SEQ ID NO: 10760 - protein, 7 aa, Artificial Sequence
  Synthetic
KSAGSIY

SEQ ID NO: 10761 - protein, 7 aa, Artificial Sequence
  Synthetic
LKMGYSS

SEQ ID NO: 10762 - protein, 7 aa, Artificial Sequence
  Synthetic
SKIGYSS

SEQ ID NO: 10763 - protein, 7 aa, Artificial Sequence
  Synthetic
NRVGYSQ

SEQ ID NO: 10764 - protein, 7 aa, Artificial Sequence
  Synthetic
VKTGYSQ

SEQ ID NO: 10765 - protein, 7 aa, Artificial Sequence
  Synthetic
TKLGYST

SEQ ID NO: 10766 - protein, 7 aa, Artificial Sequence
  Synthetic
TRTGYST

SEQ ID NO: 10767 - protein, 7 aa, Artificial Sequence
  Synthetic
QRAGYSS

SEQ ID NO: 10768 - protein, 7 aa, Artificial Sequence
  Synthetic
ARAGYSQ

SEQ ID NO: 10769 - protein, 7 aa, Artificial Sequence
  Synthetic
SKYGYSQ

SEQ ID NO: 10770 - protein, 7 aa, Artificial Sequence
  Synthetic
WRTGYSQ

SEQ ID NO: 10771 - protein, 7 aa, Artificial Sequence
  Synthetic
MKPGYSQ

SEQ ID NO: 10772 - protein, 7 aa, Artificial Sequence
  Synthetic
LKPGYSQ

SEQ ID NO: 10773 - protein, 7 aa, Artificial Sequence
  Synthetic
LRSGYSQ

SEQ ID NO: 10774 - protein, 7 aa, Artificial Sequence
  Synthetic
DRFGYST

SEQ ID NO: 10775 - protein, 7 aa, Artificial Sequence
  Synthetic
SARGYST

SEQ ID NO: 10776 - protein, 7 aa, Artificial Sequence
  Synthetic
VRIGYSQ

SEQ ID NO: 10777 - protein, 7 aa, Artificial Sequence
  Synthetic
IRMGYSS

SEQ ID NO: 10778 - protein, 7 aa, Artificial Sequence
  Synthetic
IRIGYSQ

SEQ ID NO: 10779 - protein, 7 aa, Artificial Sequence
  Synthetic
SRVGYSQ

SEQ ID NO: 10780 - protein, 7 aa, Artificial Sequence
  Synthetic
LRAGYSQ

SEQ ID NO: 10781 - protein, 7 aa, Artificial Sequence
  Synthetic
TSKGYSS

SEQ ID NO: 10782 - protein, 7 aa, Artificial Sequence
  Synthetic
IKTGYSQ

SEQ ID NO: 10783 - protein, 7 aa, Artificial Sequence
  Synthetic
LKSGYSQ

SEQ ID NO: 10784 - protein, 7 aa, Artificial Sequence
  Synthetic
LKIGYSS

SEQ ID NO: 10785 - protein, 7 aa, Artificial Sequence
  Synthetic
WKTGYSQ

SEQ ID NO: 10786 - protein, 7 aa, Artificial Sequence
  Synthetic
FKAGYSQ

SEQ ID NO: 10787 - protein, 7 aa, Artificial Sequence
  Synthetic
MRIGYST

SEQ ID NO: 10788 - protein, 7 aa, Artificial Sequence
  Synthetic
VRMGYST

SEQ ID NO: 10789 - protein, 7 aa, Artificial Sequence
  Synthetic
LLKGYSQ

SEQ ID NO: 10790 - protein, 7 aa, Artificial Sequence
  Synthetic
MKAGYSQ

SEQ ID NO: 10791 - protein, 7 aa, Artificial Sequence
  Synthetic
SKAGYST

SEQ ID NO: 10792 - protein, 7 aa, Artificial Sequence
  Synthetic
IKMGYST

SEQ ID NO: 10793 - protein, 7 aa, Artificial Sequence
  Synthetic
HKIGYSS

SEQ ID NO: 10794 - protein, 7 aa, Artificial Sequence
  Synthetic
TQHGYSS

SEQ ID NO: 10795 - protein, 7 aa, Artificial Sequence
  Synthetic
RWNPDSA

SEQ ID NO: 10796 - protein, 7 aa, Artificial Sequence
  Synthetic
TMKGFAQ

SEQ ID NO: 10797 - protein, 7 aa, Artificial Sequence
  Synthetic
SRPGYSQ

SEQ ID NO: 10798 - protein, 7 aa, Artificial Sequence
  Synthetic
PKYGYSS

SEQ ID NO: 10799 - protein, 7 aa, Artificial Sequence
  Synthetic
QRVGYSQ

SEQ ID NO: 10800 - protein, 7 aa, Artificial Sequence
  Synthetic
AKYGYSS

SEQ ID NO: 10801 - protein, 7 aa, Artificial Sequence
  Synthetic
VKIGYSQ

SEQ ID NO: 10802 - protein, 7 aa, Artificial Sequence
  Synthetic
PKHGYSS

SEQ ID NO: 10803 - protein, 7 aa, Artificial Sequence
  Synthetic
MRIGYST

SEQ ID NO: 10804 - protein, 7 aa, Artificial Sequence
  Synthetic
HKTGYSQ

SEQ ID NO: 10805 - protein, 7 aa, Artificial Sequence
  Synthetic
QKTGYSQ

SEQ ID NO: 10806 - protein, 7 aa, Artificial Sequence
  Synthetic
QKVGYSQ

SEQ ID NO: 10807 - protein, 7 aa, Artificial Sequence
  Synthetic
VKHGYST

SEQ ID NO: 10808 - protein, 7 aa, Artificial Sequence
  Synthetic
QKIGYSQ

SEQ ID NO: 10809 - protein, 7 aa, Artificial Sequence
  Synthetic
YTLSQGW

SEQ ID NO: 10810 - protein, 7 aa, Artificial Sequence
  Synthetic
IRTGYSS

SEQ ID NO: 10811 - protein, 7 aa, Artificial Sequence
  Synthetic
TKQGYST

SEQ ID NO: 10812 - protein, 7 aa, Artificial Sequence
  Synthetic
VRQGYSQ

SEQ ID NO: 10813 - protein, 7 aa, Artificial Sequence
  Synthetic
HKAGYSQ

SEQ ID NO: 10814 - protein, 7 aa, Artificial Sequence
  Synthetic
VRVGYSQ

SEQ ID NO: 10815 - protein, 7 aa, Artificial Sequence
  Synthetic
MRVGYSS

SEQ ID NO: 10816 - protein, 7 aa, Artificial Sequence
  Synthetic
AKVGYSQ

SEQ ID NO: 10817 - protein, 7 aa, Artificial Sequence
  Synthetic
LRQGYST

SEQ ID NO: 10818 - protein, 7 aa, Artificial Sequence
  Synthetic
VRAGYSQ

SEQ ID NO: 10819 - protein, 7 aa, Artificial Sequence
  Synthetic
TKIGYSQ

SEQ ID NO: 10820 - protein, 7 aa, Artificial Sequence
  Synthetic
VRQGYST

SEQ ID NO: 10821 - protein, 7 aa, Artificial Sequence
  Synthetic
VKYGYSS

SEQ ID NO: 10822 - protein, 7 aa, Artificial Sequence
  Synthetic
VRLGYSS

SEQ ID NO: 10823 - protein, 7 aa, Artificial Sequence
  Synthetic
VRMGYST

SEQ ID NO: 10824 - protein, 7 aa, Artificial Sequence
  Synthetic
LRQGYSS

SEQ ID NO: 10825 - protein, 7 aa, Artificial Sequence
  Synthetic
LKFGYSQ

SEQ ID NO: 10826 - protein, 7 aa, Artificial Sequence
  Synthetic
LRIGYSS

SEQ ID NO: 10827 - protein, 7 aa, Artificial Sequence
  Synthetic
ARIGYSQ

SEQ ID NO: 10828 - protein, 7 aa, Artificial Sequence
  Synthetic
LKAGYSS

SEQ ID NO: 10829 - protein, 7 aa, Artificial Sequence
  Synthetic
MKSGYSQ

SEQ ID NO: 10830 - protein, 7 aa, Artificial Sequence
  Synthetic
ERHGYSQ

SEQ ID NO: 10831 - protein, 7 aa, Artificial Sequence
  Synthetic
TKIGYSS

SEQ ID NO: 10832 - protein, 7 aa, Artificial Sequence
  Synthetic
MRVGYSQ

SEQ ID NO: 10833 - protein, 7 aa, Artificial Sequence
  Synthetic
HKIGYST

SEQ ID NO: 10834 - protein, 7 aa, Artificial Sequence
  Synthetic
IRLGYSQ

SEQ ID NO: 10835 - protein, 7 aa, Artificial Sequence
  Synthetic
QRTGYSQ

SEQ ID NO: 10836 - protein, 7 aa, Artificial Sequence
  Synthetic
MKIGYSQ

SEQ ID NO: 10837 - protein, 7 aa, Artificial Sequence
  Synthetic
ILKGYAM

SEQ ID NO: 10838 - protein, 7 aa, Artificial Sequence
  Synthetic
WSSYQAS

SEQ ID NO: 10839 - protein, 7 aa, Artificial Sequence
  Synthetic
LRPGYSQ

SEQ ID NO: 10840 - protein, 7 aa, Artificial Sequence
  Synthetic
THKGYSS

SEQ ID NO: 10841 - protein, 7 aa, Artificial Sequence
  Synthetic
TKVGYSQ

SEQ ID NO: 10842 - protein, 7 aa, Artificial Sequence
  Synthetic
LKVGYSS

SEQ ID NO: 10843 - protein, 7 aa, Artificial Sequence
  Synthetic
TRSGYST

SEQ ID NO: 10844 - protein, 7 aa, Artificial Sequence
  Synthetic
LKVGYSQ

SEQ ID NO: 10845 - protein, 7 aa, Artificial Sequence
  Synthetic
LRGGYSQ

SEQ ID NO: 10846 - protein, 7 aa, Artificial Sequence
  Synthetic
LKLGYST

SEQ ID NO: 10847 - protein, 7 aa, Artificial Sequence
  Synthetic
FRAGYSQ

SEQ ID NO: 10848 - protein, 7 aa, Artificial Sequence
  Synthetic
HRPGYSQ

SEQ ID NO: 10849 - protein, 7 aa, Artificial Sequence
  Synthetic
SRSGYSQ

SEQ ID NO: 10850 - protein, 7 aa, Artificial Sequence
  Synthetic
IKQGYSQ

SEQ ID NO: 10851 - protein, 7 aa, Artificial Sequence
  Synthetic
VKHGYSS

SEQ ID NO: 10852 - protein, 7 aa, Artificial Sequence
  Synthetic
QKHGYSQ

SEQ ID NO: 10853 - protein, 7 aa, Artificial Sequence
  Synthetic
IMRGYSS

SEQ ID NO: 10854 - protein, 7 aa, Artificial Sequence
  Synthetic
TKAGYSS

SEQ ID NO: 10855 - protein, 7 aa, Artificial Sequence
  Synthetic
IKQGYSS

SEQ ID NO: 10856 - protein, 7 aa, Artificial Sequence
  Synthetic
QRIGYST

SEQ ID NO: 10857 - protein, 7 aa, Artificial Sequence
  Synthetic
HKIGYST

SEQ ID NO: 10858 - protein, 7 aa, Artificial Sequence
  Synthetic
EKFGYSS

SEQ ID NO: 10859 - protein, 7 aa, Artificial Sequence
  Synthetic
VRTGYSQ

SEQ ID NO: 10860 - protein, 7 aa, Artificial Sequence
  Synthetic
IKVGYSQ

SEQ ID NO: 10861 - protein, 7 aa, Artificial Sequence
  Synthetic
DRQGYSQ

SEQ ID NO: 10862 - protein, 7 aa, Artificial Sequence
  Synthetic
IRMGYST

SEQ ID NO: 10863 - protein, 7 aa, Artificial Sequence
  Synthetic
TRQGYSQ

SEQ ID NO: 10864 - protein, 7 aa, Artificial Sequence
  Synthetic
IKHGYST

SEQ ID NO: 10865 - protein, 7 aa, Artificial Sequence
  Synthetic
NKVGYAQ

SEQ ID NO: 10866 - protein, 7 aa, Artificial Sequence
  Synthetic
VRQGYSS

SEQ ID NO: 10867 - protein, 7 aa, Artificial Sequence
  Synthetic
FKIGYSQ

SEQ ID NO: 10868 - protein, 7 aa, Artificial Sequence
  Synthetic
IRSGYST

SEQ ID NO: 10869 - protein, 7 aa, Artificial Sequence
  Synthetic
TKQGYSQ

SEQ ID NO: 10870 - protein, 7 aa, Artificial Sequence
  Synthetic
LRAGYST

SEQ ID NO: 10871 - protein, 7 aa, Artificial Sequence
  Synthetic
EKLGYSQ

SEQ ID NO: 10872 - protein, 7 aa, Artificial Sequence
  Synthetic
TRSGYSS

SEQ ID NO: 10873 - protein, 7 aa, Artificial Sequence
  Synthetic
VRPGYSQ

SEQ ID NO: 10874 - protein, 7 aa, Artificial Sequence
  Synthetic
GKYGYSQ

SEQ ID NO: 10875 - protein, 7 aa, Artificial Sequence
  Synthetic
VKAGYSQ

SEQ ID NO: 10876 - protein, 7 aa, Artificial Sequence
  Synthetic
SRSGYST

SEQ ID NO: 10877 - protein, 7 aa, Artificial Sequence
  Synthetic
TRQGYST

SEQ ID NO: 10878 - protein, 7 aa, Artificial Sequence
  Synthetic
HRMGYSS

SEQ ID NO: 10879 - protein, 7 aa, Artificial Sequence
  Synthetic
YRSGYSQ

SEQ ID NO: 10880 - protein, 7 aa, Artificial Sequence
  Synthetic
LRVGYSQ

SEQ ID NO: 10881 - protein, 7 aa, Artificial Sequence
  Synthetic
NKHGYSS

SEQ ID NO: 10882 - protein, 7 aa, Artificial Sequence
  Synthetic
SKPGYSQ

SEQ ID NO: 10883 - protein, 7 aa, Artificial Sequence
  Synthetic
HKVGYSQ

SEQ ID NO: 10884 - protein, 7 aa, Artificial Sequence
  Synthetic
FRIGYSQ

SEQ ID NO: 10885 - protein, 7 aa, Artificial Sequence
  Synthetic
ERIGYSQ

SEQ ID NO: 10886 - protein, 7 aa, Artificial Sequence
  Synthetic
TRQGYSS

SEQ ID NO: 10887 - protein, 7 aa, Artificial Sequence
  Synthetic
IRAGYSQ

SEQ ID NO: 10888 - protein, 7 aa, Artificial Sequence
  Synthetic
MRTGYSQ

SEQ ID NO: 10889 - protein, 7 aa, Artificial Sequence
  Synthetic
PRVGYSQ

SEQ ID NO: 10890 - protein, 7 aa, Artificial Sequence
  Synthetic
QRAGYSS

SEQ ID NO: 10891 - protein, 7 aa, Artificial Sequence
  Synthetic
TKLGYSS

SEQ ID NO: 10892 - protein, 7 aa, Artificial Sequence
  Synthetic
FKIGYSQ

SEQ ID NO: 10893 - protein, 7 aa, Artificial Sequence
  Synthetic
LKAGYSQ

SEQ ID NO: 10894 - protein, 7 aa, Artificial Sequence
  Synthetic
ILKGYAM

SEQ ID NO: 10895 - protein, 7 aa, Artificial Sequence
  Synthetic
VRTGYSQ

SEQ ID NO: 10896 - protein, 7 aa, Artificial Sequence
  Synthetic
TKHGYSQ

SEQ ID NO: 10897 - protein, 7 aa, Artificial Sequence
  Synthetic
IKMGYSS

SEQ ID NO: 10898 - protein, 7 aa, Artificial Sequence
  Synthetic
IKVGYSQ

SEQ ID NO: 10899 - protein, 7 aa, Artificial Sequence
  Synthetic
ERQGYSQ

SEQ ID NO: 10900 - protein, 7 aa, Artificial Sequence
  Synthetic
IRGGYSS

SEQ ID NO: 10901 - protein, 7 aa, Artificial Sequence
  Synthetic
TKMGYSQ

SEQ ID NO: 10902 - protein, 7 aa, Artificial Sequence
  Synthetic
QKIGYSQ

SEQ ID NO: 10903 - protein, 7 aa, Artificial Sequence
  Synthetic
HKIGYSQ

SEQ ID NO: 10904 - protein, 7 aa, Artificial Sequence
  Synthetic
SRAGYSS

SEQ ID NO: 10905 - protein, 7 aa, Artificial Sequence
  Synthetic
FRHGYSQ

SEQ ID NO: 10906 - protein, 7 aa, Artificial Sequence
  Synthetic
LKLGYSQ

SEQ ID NO: 10907 - protein, 7 aa, Artificial Sequence
  Synthetic
TKHGYSS

SEQ ID NO: 10908 - protein, 7 aa, Artificial Sequence
  Synthetic
VKSGYSQ

SEQ ID NO: 10909 - protein, 7 aa, Artificial Sequence
  Synthetic
LKMGYSQ

SEQ ID NO: 10910 - protein, 7 aa, Artificial Sequence
  Synthetic
TRSGYST

SEQ ID NO: 10911 - protein, 7 aa, Artificial Sequence
  Synthetic
TKTGYST

SEQ ID NO: 10912 - protein, 7 aa, Artificial Sequence
  Synthetic
TRAGYST

SEQ ID NO: 10913 - protein, 7 aa, Artificial Sequence
  Synthetic
VKMGYSQ

SEQ ID NO: 10914 - protein, 7 aa, Artificial Sequence
  Synthetic
LKSGYSQ

SEQ ID NO: 10915 - protein, 7 aa, Artificial Sequence
  Synthetic
DKTGYSQ

SEQ ID NO: 10916 - protein, 7 aa, Artificial Sequence
  Synthetic
LKHGYSS

SEQ ID NO: 10917 - protein, 7 aa, Artificial Sequence
  Synthetic
DRIGYSQ

SEQ ID NO: 10918 - protein, 7 aa, Artificial Sequence
  Synthetic
IKSGYSS

SEQ ID NO: 10919 - protein, 7 aa, Artificial Sequence
  Synthetic
QKHGYSQ

SEQ ID NO: 10920 - protein, 7 aa, Artificial Sequence
  Synthetic
FKTGYSQ

SEQ ID NO: 10921 - protein, 7 aa, Artificial Sequence
  Synthetic
NRAGYST

SEQ ID NO: 10922 - protein, 7 aa, Artificial Sequence
  Synthetic
LKAGYSQ

SEQ ID NO: 10923 - protein, 7 aa, Artificial Sequence
  Synthetic
ERMGYST

SEQ ID NO: 10924 - protein, 7 aa, Artificial Sequence
  Synthetic
MKTGYST

SEQ ID NO: 10925 - protein, 7 aa, Artificial Sequence
  Synthetic
FRTGYSQ

SEQ ID NO: 10926 - protein, 7 aa, Artificial Sequence
  Synthetic
VRLGYSQ

SEQ ID NO: 10927 - protein, 7 aa, Artificial Sequence
  Synthetic
MRPGYSQ

SEQ ID NO: 10928 - protein, 7 aa, Artificial Sequence
  Synthetic
LRAGYSS

SEQ ID NO: 10929 - protein, 7 aa, Artificial Sequence
  Synthetic
MKAGYSS

SEQ ID NO: 10930 - protein, 7 aa, Artificial Sequence
  Synthetic
GRLGYSQ

SEQ ID NO: 10931 - protein, 7 aa, Artificial Sequence
  Synthetic
TKIGYSQ

SEQ ID NO: 10932 - protein, 7 aa, Artificial Sequence
  Synthetic
LRQGYSS

SEQ ID NO: 10933 - protein, 7 aa, Artificial Sequence
  Synthetic
VRIGYST

SEQ ID NO: 10934 - protein, 7 aa, Artificial Sequence
  Synthetic
TKIGYSS

SEQ ID NO: 10935 - protein, 7 aa, Artificial Sequence
  Synthetic
MKIGYST

SEQ ID NO: 10936 - protein, 7 aa, Artificial Sequence
  Synthetic
LRIGYSQ

SEQ ID NO: 10937 - protein, 7 aa, Artificial Sequence
  Synthetic
IRTGYSS

SEQ ID NO: 10938 - protein, 7 aa, Artificial Sequence
  Synthetic
LRTGYSQ

SEQ ID NO: 10939 - protein, 7 aa, Artificial Sequence
  Synthetic
TRVGYST

SEQ ID NO: 10940 - protein, 7 aa, Artificial Sequence
  Synthetic
NRIGYSQ

SEQ ID NO: 10941 - protein, 7 aa, Artificial Sequence
  Synthetic
TKIGYST

SEQ ID NO: 10942 - protein, 7 aa, Artificial Sequence
  Synthetic
MRAGYSS

SEQ ID NO: 10943 - protein, 7 aa, Artificial Sequence
  Synthetic
MKYGYST

SEQ ID NO: 10944 - protein, 7 aa, Artificial Sequence
  Synthetic
DRVGYSQ

SEQ ID NO: 10945 - protein, 7 aa, Artificial Sequence
  Synthetic
QKPGYSQ

SEQ ID NO: 10946 - protein, 7 aa, Artificial Sequence
  Synthetic
MRSGYSQ

SEQ ID NO: 10947 - protein, 7 aa, Artificial Sequence
  Synthetic
VRGGYSQ

SEQ ID NO: 10948 - protein, 7 aa, Artificial Sequence
  Synthetic
FKTGYSQ

SEQ ID NO: 10949 - protein, 7 aa, Artificial Sequence
  Synthetic
VRIGYSS

SEQ ID NO: 10950 - protein, 7 aa, Artificial Sequence
  Synthetic
IRAGYST

SEQ ID NO: 10951 - protein, 7 aa, Artificial Sequence
  Synthetic
NKFGYSQ

SEQ ID NO: 10952 - protein, 7 aa, Artificial Sequence
  Synthetic
QRQGYSQ

SEQ ID NO: 10953 - protein, 7 aa, Artificial Sequence
  Synthetic
LKQGYSQ

SEQ ID NO: 10954 - protein, 7 aa, Artificial Sequence
  Synthetic
TKTGYSS

SEQ ID NO: 10955 - protein, 7 aa, Artificial Sequence
  Synthetic
VRGGYSQ

SEQ ID NO: 10956 - protein, 7 aa, Artificial Sequence
  Synthetic
IRSGYSQ

SEQ ID NO: 10957 - protein, 7 aa, Artificial Sequence
  Synthetic
QKVGYSQ

SEQ ID NO: 10958 - protein, 7 aa, Artificial Sequence
  Synthetic
LREGYSQ

SEQ ID NO: 10959 - protein, 7 aa, Artificial Sequence
  Synthetic
TKPGYSQ

SEQ ID NO: 10960 - protein, 7 aa, Artificial Sequence
  Synthetic
LRHGYST

SEQ ID NO: 10961 - protein, 7 aa, Artificial Sequence
  Synthetic
PRMGYSS

SEQ ID NO: 10962 - protein, 7 aa, Artificial Sequence
  Synthetic
TKHGYST

SEQ ID NO: 10963 - protein, 7 aa, Artificial Sequence
  Synthetic
LRLGYST

SEQ ID NO: 10964 - protein, 7 aa, Artificial Sequence
  Synthetic
IRQGYSS

SEQ ID NO: 10965 - protein, 7 aa, Artificial Sequence
  Synthetic
LKQGYSS

SEQ ID NO: 10966 - protein, 7 aa, Artificial Sequence
  Synthetic
SKIGYST

SEQ ID NO: 10967 - protein, 7 aa, Artificial Sequence
  Synthetic
MKAGYSS

SEQ ID NO: 10968 - protein, 7 aa, Artificial Sequence
  Synthetic
TKSGYST

SEQ ID NO: 10969 - protein, 7 aa, Artificial Sequence
  Synthetic
EKHGYSQ

SEQ ID NO: 10970 - protein, 7 aa, Artificial Sequence
  Synthetic
LKTGYSQ

SEQ ID NO: 10971 - protein, 7 aa, Artificial Sequence
  Synthetic
LKVGYSQ

SEQ ID NO: 10972 - protein, 7 aa, Artificial Sequence
  Synthetic
SRAGYSS

SEQ ID NO: 10973 - protein, 7 aa, Artificial Sequence
  Synthetic
EKVGYSQ

SEQ ID NO: 10974 - protein, 7 aa, Artificial Sequence
  Synthetic
WGTPPRG

SEQ ID NO: 10975 - protein, 7 aa, Artificial Sequence
  Synthetic
TKYGYST

SEQ ID NO: 10976 - protein, 7 aa, Artificial Sequence
  Synthetic
IKHGYST

SEQ ID NO: 10977 - protein, 7 aa, Artificial Sequence
  Synthetic
LKAGYSS

SEQ ID NO: 10978 - protein, 7 aa, Artificial Sequence
  Synthetic
TKTGYSQ

SEQ ID NO: 10979 - protein, 7 aa, Artificial Sequence
  Synthetic
WKAGYSQ

SEQ ID NO: 10980 - protein, 7 aa, Artificial Sequence
  Synthetic
VKAGYSS

SEQ ID NO: 10981 - protein, 7 aa, Artificial Sequence
  Synthetic
TRMGYSS

SEQ ID NO: 10982 - protein, 7 aa, Artificial Sequence
  Synthetic
YRVGYST

SEQ ID NO: 10983 - protein, 7 aa, Artificial Sequence
  Synthetic
GKIGYSQ

SEQ ID NO: 10984 - protein, 7 aa, Artificial Sequence
  Synthetic
MKAGYSQ

SEQ ID NO: 10985 - protein, 7 aa, Artificial Sequence
  Synthetic
VKQGYSQ

SEQ ID NO: 10986 - protein, 7 aa, Artificial Sequence
  Synthetic
EKYGYSQ

SEQ ID NO: 10987 - protein, 7 aa, Artificial Sequence
  Synthetic
LKGGYSQ

SEQ ID NO: 10988 - protein, 7 aa, Artificial Sequence
  Synthetic
HKTGYSQ

SEQ ID NO: 10989 - protein, 7 aa, Artificial Sequence
  Synthetic
TRMGYST

SEQ ID NO: 10990 - protein, 7 aa, Artificial Sequence
  Synthetic
VRAGYSS

SEQ ID NO: 10991 - protein, 7 aa, Artificial Sequence
  Synthetic
VRAGYSQ

SEQ ID NO: 10992 - protein, 7 aa, Artificial Sequence
  Synthetic
LKQGYSQ

SEQ ID NO: 10993 - protein, 7 aa, Artificial Sequence
  Synthetic
TRAGYSQ

SEQ ID NO: 10994 - protein, 7 aa, Artificial Sequence
  Synthetic
VKNGYSQ

SEQ ID NO: 10995 - protein, 7 aa, Artificial Sequence
  Synthetic
VNRGYSS

SEQ ID NO: 10996 - protein, 7 aa, Artificial Sequence
  Synthetic
IKQGYSQ

SEQ ID NO: 10997 - protein, 7 aa, Artificial Sequence
  Synthetic
LRMGYST

SEQ ID NO: 10998 - protein, 7 aa, Artificial Sequence
  Synthetic
SRPGYSS

SEQ ID NO: 10999 - protein, 7 aa, Artificial Sequence
  Synthetic
VKHGYSQ

SEQ ID NO: 11000 - protein, 7 aa, Artificial Sequence
  Synthetic
VRSGYSQ

SEQ ID NO: 11001 - protein, 7 aa, Artificial Sequence
  Synthetic
VKIGYSQ

SEQ ID NO: 11002 - protein, 7 aa, Artificial Sequence
  Synthetic
TRQGYSS

SEQ ID NO: 11003 - protein, 7 aa, Artificial Sequence
  Synthetic
IKHGYSS

SEQ ID NO: 11004 - protein, 7 aa, Artificial Sequence
  Synthetic
WKSGYSQ

SEQ ID NO: 11005 - protein, 7 aa, Artificial Sequence
  Synthetic
TKAGYST

SEQ ID NO: 11006 - protein, 7 aa, Artificial Sequence
  Synthetic
MRSGYSQ

SEQ ID NO: 11007 - protein, 7 aa, Artificial Sequence
  Synthetic
TKMGYST

SEQ ID NO: 11008 - protein, 7 aa, Artificial Sequence
  Synthetic
IKFGYSQ

SEQ ID NO: 11009 - protein, 7 aa, Artificial Sequence
  Synthetic
TRNGYSQ

SEQ ID NO: 11010 - protein, 7 aa, Artificial Sequence
  Synthetic
VKPGYSQ

SEQ ID NO: 11011 - protein, 7 aa, Artificial Sequence
  Synthetic
LKYGYSS

SEQ ID NO: 11012 - protein, 7 aa, Artificial Sequence
  Synthetic
IRPGYSQ

SEQ ID NO: 11013 - protein, 7 aa, Artificial Sequence
  Synthetic
TKAGYSS

SEQ ID NO: 11014 - protein, 7 aa, Artificial Sequence
  Synthetic
IKAGYSS

SEQ ID NO: 11015 - protein, 7 aa, Artificial Sequence
  Synthetic
TRVGYSS

SEQ ID NO: 11016 - protein, 7 aa, Artificial Sequence
  Synthetic
TRIGYST

SEQ ID NO: 11017 - protein, 7 aa, Artificial Sequence
  Synthetic
VKMGYSS

SEQ ID NO: 11018 - protein, 7 aa, Artificial Sequence
  Synthetic
TRTGYSQ

SEQ ID NO: 11019 - protein, 7 aa, Artificial Sequence
  Synthetic
MRAGYSQ

SEQ ID NO: 11020 - protein, 7 aa, Artificial Sequence
  Synthetic
TRIGYSS

SEQ ID NO: 11021 - protein, 7 aa, Artificial Sequence
  Synthetic
WRSGYSQ

SEQ ID NO: 11022 - protein, 7 aa, Artificial Sequence
  Synthetic
TKHGYSQ

SEQ ID NO: 11023 - protein, 7 aa, Artificial Sequence
  Synthetic
IKAGYSQ

SEQ ID NO: 11024 - protein, 7 aa, Artificial Sequence
  Synthetic
TRPGYSQ

SEQ ID NO: 11025 - protein, 7 aa, Artificial Sequence
  Synthetic
VRAGYST

SEQ ID NO: 11026 - protein, 7 aa, Artificial Sequence
  Synthetic
IKSGYSQ

SEQ ID NO: 11027 - protein, 7 aa, Artificial Sequence
  Synthetic
ELKNYHT

SEQ ID NO: 11028 - protein, 7 aa, Artificial Sequence
  Synthetic
IMRGYSS

SEQ ID NO: 11029 - protein, 7 aa, Artificial Sequence
  Synthetic
RGTGLSQ

SEQ ID NO: 11030 - protein, 7 aa, Artificial Sequence
  Synthetic
NRVGYST

SEQ ID NO: 11031 - protein, 7 aa, Artificial Sequence
  Synthetic
SRIGYSQ

SEQ ID NO: 11032 - protein, 7 aa, Artificial Sequence
  Synthetic
LRQGYSQ

SEQ ID NO: 11033 - protein, 7 aa, Artificial Sequence
  Synthetic
IRHGYST

SEQ ID NO: 11034 - protein, 7 aa, Artificial Sequence
  Synthetic
VRQGYSS

SEQ ID NO: 11035 - protein, 7 aa, Artificial Sequence
  Synthetic
MKTGYSQ

SEQ ID NO: 11036 - protein, 7 aa, Artificial Sequence
  Synthetic
GRLGYST

SEQ ID NO: 11037 - protein, 7 aa, Artificial Sequence
  Synthetic
ERIGYSQ

SEQ ID NO: 11038 - protein, 7 aa, Artificial Sequence
  Synthetic
LRSGYSQ

SEQ ID NO: 11039 - protein, 7 aa, Artificial Sequence
  Synthetic
QKMGYSS

SEQ ID NO: 11040 - protein, 7 aa, Artificial Sequence
  Synthetic
TKSGYST

SEQ ID NO: 11041 - protein, 7 aa, Artificial Sequence
  Synthetic
PRVGYSS

SEQ ID NO: 11042 - protein, 7 aa, Artificial Sequence
  Synthetic
EKYGYST

SEQ ID NO: 11043 - protein, 7 aa, Artificial Sequence
  Synthetic
FRAGYSQ

SEQ ID NO: 11044 - protein, 7 aa, Artificial Sequence
  Synthetic
ERMGYSQ

SEQ ID NO: 11045 - protein, 7 aa, Artificial Sequence
  Synthetic
DRIGYSQ

SEQ ID NO: 11046 - protein, 7 aa, Artificial Sequence
  Synthetic
LRHGYSS

SEQ ID NO: 11047 - protein, 7 aa, Artificial Sequence
  Synthetic
MRVGYSS

SEQ ID NO: 11048 - protein, 7 aa, Artificial Sequence
  Synthetic
DRMGYSS

SEQ ID NO: 11049 - protein, 7 aa, Artificial Sequence
  Synthetic
LRAGYSS

SEQ ID NO: 11050 - protein, 7 aa, Artificial Sequence
  Synthetic
IRTGYSQ

SEQ ID NO: 11051 - protein, 7 aa, Artificial Sequence
  Synthetic
NKPGYSQ

SEQ ID NO: 11052 - protein, 7 aa, Artificial Sequence
  Synthetic
TQKGYSS

SEQ ID NO: 11053 - protein, 7 aa, Artificial Sequence
  Synthetic
NRVGYSQ

SEQ ID NO: 11054 - protein, 7 aa, Artificial Sequence
  Synthetic
TRVGYSQ

SEQ ID NO: 11055 - protein, 7 aa, Artificial Sequence
  Synthetic
TRTGYSS

SEQ ID NO: 11056 - protein, 7 aa, Artificial Sequence
  Synthetic
RYVGESS

SEQ ID NO: 11057 - protein, 7 aa, Artificial Sequence
  Synthetic
SRSGYSQ

SEQ ID NO: 11058 - protein, 7 aa, Artificial Sequence
  Synthetic
RYPGMSS

SEQ ID NO: 11059 - protein, 7 aa, Artificial Sequence
  Synthetic
TRVGYSS

SEQ ID NO: 11060 - protein, 7 aa, Artificial Sequence
  Synthetic
SRSGYSS

SEQ ID NO: 11061 - protein, 7 aa, Artificial Sequence
  Synthetic
NRVGYSS

SEQ ID NO: 11062 - protein, 7 aa, Artificial Sequence
  Synthetic
GRIGYSQ

SEQ ID NO: 11063 - protein, 7 aa, Artificial Sequence
  Synthetic
IKTGYSS

SEQ ID NO: 11064 - protein, 7 aa, Artificial Sequence
  Synthetic
MRTGYSS

SEQ ID NO: 11065 - protein, 7 aa, Artificial Sequence
  Synthetic
LKHGYSQ

SEQ ID NO: 11066 - protein, 7 aa, Artificial Sequence
  Synthetic
VKTGYSQ

SEQ ID NO: 11067 - protein, 7 aa, Artificial Sequence
  Synthetic
TKHGYSS

SEQ ID NO: 11068 - protein, 7 aa, Artificial Sequence
  Synthetic
LKPGYSQ

SEQ ID NO: 11069 - protein, 7 aa, Artificial Sequence
  Synthetic
IKTGYSQ

SEQ ID NO: 11070 - protein, 7 aa, Artificial Sequence
  Synthetic
LRAGYSQ

SEQ ID NO: 11071 - protein, 7 aa, Artificial Sequence
  Synthetic
NKVGYSQ

SEQ ID NO: 11072 - protein, 7 aa, Artificial Sequence
  Synthetic
IRAGYSS

SEQ ID NO: 11073 - protein, 7 aa, Artificial Sequence
  Synthetic
TKVGYSQ

SEQ ID NO: 11074 - protein, 7 aa, Artificial Sequence
  Synthetic
NRTGYST

SEQ ID NO: 11075 - protein, 7 aa, Artificial Sequence
  Synthetic
ERTGYSQ

SEQ ID NO: 11076 - protein, 7 aa, Artificial Sequence
  Synthetic
LRNGYSQ

SEQ ID NO: 11077 - protein, 7 aa, Artificial Sequence
  Synthetic
IRQGYSS

SEQ ID NO: 11078 - protein, 7 aa, Artificial Sequence
  Synthetic
VKHGYSS

SEQ ID NO: 11079 - protein, 7 aa, Artificial Sequence
  Synthetic
VKHGYST

SEQ ID NO: 11080 - protein, 7 aa, Artificial Sequence
  Synthetic
LARGYST

SEQ ID NO: 11081 - protein, 7 aa, Artificial Sequence
  Synthetic
VKFGYST

SEQ ID NO: 11082 - protein, 7 aa, Artificial Sequence
  Synthetic
IRQGYSQ

SEQ ID NO: 11083 - protein, 7 aa, Artificial Sequence
  Synthetic
IRLGYSS

SEQ ID NO: 11084 - protein, 7 aa, Artificial Sequence
  Synthetic
LRMGYSQ

SEQ ID NO: 11085 - protein, 7 aa, Artificial Sequence
  Synthetic
LKGGYSQ

SEQ ID NO: 11086 - protein, 7 aa, Artificial Sequence
  Synthetic
DRLGYST

SEQ ID NO: 11087 - protein, 7 aa, Artificial Sequence
  Synthetic
PKVGYSQ

SEQ ID NO: 11088 - protein, 7 aa, Artificial Sequence
  Synthetic
VKQGYSQ

SEQ ID NO: 11089 - protein, 7 aa, Artificial Sequence
  Synthetic
TKVGYST

SEQ ID NO: 11090 - protein, 7 aa, Artificial Sequence
  Synthetic
IRSGYSS

SEQ ID NO: 11091 - protein, 7 aa, Artificial Sequence
  Synthetic
TKMGYST

SEQ ID NO: 11092 - protein, 7 aa, Artificial Sequence
  Synthetic
SKYGYSQ

SEQ ID NO: 11093 - protein, 7 aa, Artificial Sequence
  Synthetic
EKHGYSQ

SEQ ID NO: 11094 - protein, 7 aa, Artificial Sequence
  Synthetic
ARTGYSQ

SEQ ID NO: 11095 - protein, 7 aa, Artificial Sequence
  Synthetic
FKPGYSQ

SEQ ID NO: 11096 - protein, 7 aa, Artificial Sequence
  Synthetic
QKQGYSQ

SEQ ID NO: 11097 - protein, 7 aa, Artificial Sequence
  Synthetic
QKQGYSQ

SEQ ID NO: 11098 - protein, 7 aa, Artificial Sequence
  Synthetic
LRTGYSS

SEQ ID NO: 11099 - protein, 7 aa, Artificial Sequence
  Synthetic
TKQGYSS

SEQ ID NO: 11100 - protein, 7 aa, Artificial Sequence
  Synthetic
TKSGYSS

SEQ ID NO: 11101 - protein, 7 aa, Artificial Sequence
  Synthetic
IASGYSQ

SEQ ID NO: 11102 - protein, 7 aa, Artificial Sequence
  Synthetic
QKIGYST

SEQ ID NO: 11103 - protein, 7 aa, Artificial Sequence
  Synthetic
ERHGYSQ

SEQ ID NO: 11104 - protein, 7 aa, Artificial Sequence
  Synthetic
QKMGYSQ

SEQ ID NO: 11105 - protein, 7 aa, Artificial Sequence
  Synthetic
THKGYSS

SEQ ID NO: 11106 - protein, 7 aa, Artificial Sequence
  Synthetic
FKMGYSQ

SEQ ID NO: 11107 - protein, 7 aa, Artificial Sequence
  Synthetic
ERAGYSQ

SEQ ID NO: 11108 - protein, 7 aa, Artificial Sequence
  Synthetic
VKSGYSS

SEQ ID NO: 11109 - protein, 7 aa, Artificial Sequence
  Synthetic
SKPGYSQ

SEQ ID NO: 11110 - protein, 7 aa, Artificial Sequence
  Synthetic
TKAGYSQ

SEQ ID NO: 11111 - protein, 7 aa, Artificial Sequence
  Synthetic
LRNGYSQ

SEQ ID NO: 11112 - protein, 7 aa, Artificial Sequence
  Synthetic
VKTGYSS

SEQ ID NO: 11113 - protein, 7 aa, Artificial Sequence
  Synthetic
TSKGYSS

SEQ ID NO: 11114 - protein, 7 aa, Artificial Sequence
  Synthetic
TKQGYSS

SEQ ID NO: 11115 - protein, 7 aa, Artificial Sequence
  Synthetic
IKAGYSS

SEQ ID NO: 11116 - protein, 7 aa, Artificial Sequence
  Synthetic
VRAGYSS

SEQ ID NO: 11117 - protein, 7 aa, Artificial Sequence
  Synthetic
YKIGYST

SEQ ID NO: 11118 - protein, 7 aa, Artificial Sequence
  Synthetic
HKPGYSQ

SEQ ID NO: 11119 - protein, 7 aa, Artificial Sequence
  Synthetic
LRTGYSS

SEQ ID NO: 11120 - protein, 7 aa, Artificial Sequence
  Synthetic
QRMGYSS

SEQ ID NO: 11121 - protein, 7 aa, Artificial Sequence
  Synthetic
VKGGYSQ

SEQ ID NO: 11122 - protein, 7 aa, Artificial Sequence
  Synthetic
FRSNGSI

SEQ ID NO: 11123 - protein, 7 aa, Artificial Sequence
  Synthetic
FRTGYSQ

SEQ ID NO: 11124 - protein, 7 aa, Artificial Sequence
  Synthetic
MRSGYSS

SEQ ID NO: 11125 - protein, 7 aa, Artificial Sequence
  Synthetic
VKQGYSS

SEQ ID NO: 11126 - protein, 7 aa, Artificial Sequence
  Synthetic
AKYGYST

SEQ ID NO: 11127 - protein, 7 aa, Artificial Sequence
  Synthetic
QRIGYSQ

SEQ ID NO: 11128 - protein, 7 aa, Artificial Sequence
  Synthetic
MRAGYSQ

SEQ ID NO: 11129 - protein, 7 aa, Artificial Sequence
  Synthetic
LKTGYSS

SEQ ID NO: 11130 - protein, 7 aa, Artificial Sequence
  Synthetic
MKYGYSS

SEQ ID NO: 11131 - protein, 7 aa, Artificial Sequence
  Synthetic
FRSGYST

SEQ ID NO: 11132 - protein, 7 aa, Artificial Sequence
  Synthetic
VRLGYST

SEQ ID NO: 11133 - protein, 7 aa, Artificial Sequence
  Synthetic
TKVGYSS

SEQ ID NO: 11134 - protein, 7 aa, Artificial Sequence
  Synthetic
LKHGYST

SEQ ID NO: 11135 - protein, 7 aa, Artificial Sequence
  Synthetic
NKIGYSS

SEQ ID NO: 11136 - protein, 7 aa, Artificial Sequence
  Synthetic
EKTGYSQ

SEQ ID NO: 11137 - protein, 7 aa, Artificial Sequence
  Synthetic
TKMGYSS

SEQ ID NO: 11138 - protein, 7 aa, Artificial Sequence
  Synthetic
TKTGYSS

SEQ ID NO: 11139 - protein, 7 aa, Artificial Sequence
  Synthetic
TRNGYST

SEQ ID NO: 11140 - protein, 7 aa, Artificial Sequence
  Synthetic
MKHGYSS

SEQ ID NO: 11141 - protein, 7 aa, Artificial Sequence
  Synthetic
TMKGFAQ

SEQ ID NO: 11142 - protein, 7 aa, Artificial Sequence
  Synthetic
IRVGYSS

SEQ ID NO: 11143 - protein, 7 aa, Artificial Sequence
  Synthetic
MKSGYSS

SEQ ID NO: 11144 - protein, 7 aa, Artificial Sequence
  Synthetic
TKYGYSQ

SEQ ID NO: 11145 - protein, 7 aa, Artificial Sequence
  Synthetic
TQRGYSS

SEQ ID NO: 11146 - protein, 7 aa, Artificial Sequence
  Synthetic
TRIGYSQ

SEQ ID NO: 11147 - protein, 7 aa, Artificial Sequence
  Synthetic
VRSGYSQ

SEQ ID NO: 11148 - protein, 7 aa, Artificial Sequence
  Synthetic
IREGYSQ

SEQ ID NO: 11149 - protein, 7 aa, Artificial Sequence
  Synthetic
IRMGYSS

SEQ ID NO: 11150 - protein, 7 aa, Artificial Sequence
  Synthetic
EKQGYSQ

SEQ ID NO: 11151 - protein, 7 aa, Artificial Sequence
  Synthetic
DKPGYSQ

SEQ ID NO: 11152 - protein, 7 aa, Artificial Sequence
  Synthetic
DRHGYST

SEQ ID NO: 11153 - protein, 7 aa, Artificial Sequence
  Synthetic
VKLGYSS

SEQ ID NO: 11154 - protein, 7 aa, Artificial Sequence
  Synthetic
VKPGYSQ

SEQ ID NO: 11155 - protein, 7 aa, Artificial Sequence
  Synthetic
SRPGYSQ

SEQ ID NO: 11156 - protein, 7 aa, Artificial Sequence
  Synthetic
EILMKRN

SEQ ID NO: 11157 - protein, 7 aa, Artificial Sequence
  Synthetic
LRQGYSQ

SEQ ID NO: 11158 - protein, 7 aa, Artificial Sequence
  Synthetic
IRQGYSQ

SEQ ID NO: 11159 - protein, 7 aa, Artificial Sequence
  Synthetic
INYSQTL

SEQ ID NO: 11160 - protein, 7 aa, Artificial Sequence
  Synthetic
LKPGYSS

SEQ ID NO: 11161 - protein, 7 aa, Artificial Sequence
  Synthetic
IKQGYSS

SEQ ID NO: 11162 - protein, 7 aa, Artificial Sequence
  Synthetic
YRLGYSQ

SEQ ID NO: 11163 - protein, 7 aa, Artificial Sequence
  Synthetic
ERMGYSS

SEQ ID NO: 11164 - protein, 7 aa, Artificial Sequence
  Synthetic
TRLGYST

SEQ ID NO: 11165 - protein, 7 aa, Artificial Sequence
  Synthetic
MKQGYSS

SEQ ID NO: 11166 - protein, 7 aa, Artificial Sequence
  Synthetic
LKMGYST

SEQ ID NO: 11167 - protein, 7 aa, Artificial Sequence
  Synthetic
VNRGYSS

SEQ ID NO: 11168 - protein, 7 aa, Artificial Sequence
  Synthetic
LKHGYSQ

SEQ ID NO: 11169 - protein, 7 aa, Artificial Sequence
  Synthetic
GKVGYSQ

SEQ ID NO: 11170 - protein, 7 aa, Artificial Sequence
  Synthetic
MKIGYSQ

SEQ ID NO: 11171 - protein, 7 aa, Artificial Sequence
  Synthetic
TIARMLT

SEQ ID NO: 11172 - protein, 7 aa, Artificial Sequence
  Synthetic
TKSGYSQ

SEQ ID NO: 11173 - protein, 7 aa, Artificial Sequence
  Synthetic
SRIGYSS

SEQ ID NO: 11174 - protein, 7 aa, Artificial Sequence
  Synthetic
TNKGYST

SEQ ID NO: 11175 - protein, 7 aa, Artificial Sequence
  Synthetic
FKHGYST

SEQ ID NO: 11176 - protein, 7 aa, Artificial Sequence
  Synthetic
LRHGYSQ

SEQ ID NO: 11177 - protein, 7 aa, Artificial Sequence
  Synthetic
ERVGYSS

SEQ ID NO: 11178 - protein, 7 aa, Artificial Sequence
  Synthetic
VRVGYST

SEQ ID NO: 11179 - protein, 7 aa, Artificial Sequence
  Synthetic
QKLGYST

SEQ ID NO: 11180 - protein, 7 aa, Artificial Sequence
  Synthetic
WRVGYSQ

SEQ ID NO: 11181 - protein, 7 aa, Artificial Sequence
  Synthetic
ERMGYSS

SEQ ID NO: 11182 - protein, 7 aa, Artificial Sequence
  Synthetic
IRGGYSQ

SEQ ID NO: 11183 - protein, 7 aa, Artificial Sequence
  Synthetic
SKVGYST

SEQ ID NO: 11184 - protein, 7 aa, Artificial Sequence
  Synthetic
VRAGYST

SEQ ID NO: 11185 - protein, 7 aa, Artificial Sequence
  Synthetic
LKIGYSS

SEQ ID NO: 11186 - protein, 7 aa, Artificial Sequence
  Synthetic
WNVTAGY

SEQ ID NO: 11187 - protein, 7 aa, Artificial Sequence
  Synthetic
IKHGYSS

SEQ ID NO: 11188 - protein, 7 aa, Artificial Sequence
  Synthetic
IGQTRYN

SEQ ID NO: 11189 - protein, 7 aa, Artificial Sequence
  Synthetic
ERHGYSS

SEQ ID NO: 11190 - protein, 7 aa, Artificial Sequence
  Synthetic
MRQGYSQ

SEQ ID NO: 11191 - protein, 7 aa, Artificial Sequence
  Synthetic
SKVGYSQ

SEQ ID NO: 11192 - protein, 7 aa, Artificial Sequence
  Synthetic
EKIGYSQ

SEQ ID NO: 11193 - protein, 7 aa, Artificial Sequence
  Synthetic
IKHGYSQ

SEQ ID NO: 11194 - protein, 7 aa, Artificial Sequence
  Synthetic
MKSGYST

SEQ ID NO: 11195 - protein, 7 aa, Artificial Sequence
  Synthetic
AKMGYSQ

SEQ ID NO: 11196 - protein, 7 aa, Artificial Sequence
  Synthetic
EKFGYSS

SEQ ID NO: 11197 - protein, 7 aa, Artificial Sequence
  Synthetic
TRAGYSQ

SEQ ID NO: 11198 - protein, 7 aa, Artificial Sequence
  Synthetic
LRMGYSS

SEQ ID NO: 11199 - protein, 7 aa, Artificial Sequence
  Synthetic
TKMGYSQ

SEQ ID NO: 11200 - protein, 7 aa, Artificial Sequence
  Synthetic
EKHGYSS

SEQ ID NO: 11201 - protein, 7 aa, Artificial Sequence
  Synthetic
IKPGYSQ

SEQ ID NO: 11202 - protein, 7 aa, Artificial Sequence
  Synthetic
VKTGYSS

SEQ ID NO: 11203 - protein, 7 aa, Artificial Sequence
  Synthetic
TKYGYST

SEQ ID NO: 11204 - protein, 7 aa, Artificial Sequence
  Synthetic
QKHGYSS

SEQ ID NO: 11205 - protein, 7 aa, Artificial Sequence
  Synthetic
PRVGYSS

SEQ ID NO: 11206 - protein, 7 aa, Artificial Sequence
  Synthetic
TKGGYSQ

SEQ ID NO: 11207 - protein, 7 aa, Artificial Sequence
  Synthetic
IRAGWSQ

SEQ ID NO: 11208 - protein, 7 aa, Artificial Sequence
  Synthetic
DRHGYSQ

SEQ ID NO: 11209 - protein, 7 aa, Artificial Sequence
  Synthetic
ERHGYST

SEQ ID NO: 11210 - protein, 7 aa, Artificial Sequence
  Synthetic
NKVGYAQ

SEQ ID NO: 11211 - protein, 7 aa, Artificial Sequence
  Synthetic
DRFGYSS

SEQ ID NO: 11212 - protein, 7 aa, Artificial Sequence
  Synthetic
EKHGYSS

SEQ ID NO: 11213 - protein, 7 aa, Artificial Sequence
  Synthetic
YKIGYSQ

SEQ ID NO: 11214 - protein, 7 aa, Artificial Sequence
  Synthetic
TKFGYST

SEQ ID NO: 11215 - protein, 7 aa, Artificial Sequence
  Synthetic
QRMGYSS

SEQ ID NO: 11216 - protein, 7 aa, Artificial Sequence
  Synthetic
TKLGYSS

SEQ ID NO: 11217 - protein, 7 aa, Artificial Sequence
  Synthetic
EKIGYSS

SEQ ID NO: 11218 - protein, 7 aa, Artificial Sequence
  Synthetic
ISRGMAQ

SEQ ID NO: 11219 - protein, 7 aa, Artificial Sequence
  Synthetic
EKYGYSS

SEQ ID NO: 11220 - protein, 7 aa, Artificial Sequence
  Synthetic
IKQGYST

SEQ ID NO: 11221 - protein, 7 aa, Artificial Sequence
  Synthetic
DRPGYSQ

SEQ ID NO: 11222 - protein, 7 aa, Artificial Sequence
  Synthetic
YKQGYSQ

SEQ ID NO: 11223 - protein, 7 aa, Artificial Sequence
  Synthetic
DRIGYSS

SEQ ID NO: 11224 - protein, 7 aa, Artificial Sequence
  Synthetic
NRIGYSQ

SEQ ID NO: 11225 - protein, 7 aa, Artificial Sequence
  Synthetic
IRAGYSQ

SEQ ID NO: 11226 - protein, 7 aa, Artificial Sequence
  Synthetic
ERIGYSS

SEQ ID NO: 11227 - protein, 7 aa, Artificial Sequence
  Synthetic
YKHGYSS

SEQ ID NO: 11228 - protein, 7 aa, Artificial Sequence
  Synthetic
VRNGYSS

SEQ ID NO: 11229 - protein, 7 aa, Artificial Sequence
  Synthetic
YRLGYSQ

SEQ ID NO: 11230 - protein, 7 aa, Artificial Sequence
  Synthetic
MKAGYST

SEQ ID NO: 11231 - protein, 7 aa, Artificial Sequence
  Synthetic
IRMGYSQ

SEQ ID NO: 11232 - protein, 7 aa, Artificial Sequence
  Synthetic
IRHGYSQ

SEQ ID NO: 11233 - protein, 7 aa, Artificial Sequence
  Synthetic
PRIGYSS

SEQ ID NO: 11234 - protein, 7 aa, Artificial Sequence
  Synthetic
NKIGYSS

SEQ ID NO: 11235 - protein, 7 aa, Artificial Sequence
  Synthetic
VKAGYSQ

SEQ ID NO: 11236 - protein, 7 aa, Artificial Sequence
  Synthetic
ERLGYST

SEQ ID NO: 11237 - protein, 7 aa, Artificial Sequence
  Synthetic
FKAGYST

SEQ ID NO: 11238 - protein, 7 aa, Artificial Sequence
  Synthetic
LRLGYSS

SEQ ID NO: 11239 - protein, 7 aa, Artificial Sequence
  Synthetic
TKIGYST

SEQ ID NO: 11240 - protein, 7 aa, Artificial Sequence
  Synthetic
DKIGYSS

SEQ ID NO: 11241 - protein, 7 aa, Artificial Sequence
  Synthetic
IRTGLAQ

SEQ ID NO: 11242 - protein, 7 aa, Artificial Sequence
  Synthetic
NKSGYSQ

SEQ ID NO: 11243 - protein, 7 aa, Artificial Sequence
  Synthetic
KYPGSST

SEQ ID NO: 11244 - protein, 7 aa, Artificial Sequence
  Synthetic
LSYGASQ

SEQ ID NO: 11245 - protein, 7 aa, Artificial Sequence
  Synthetic
MRIGYSQ

SEQ ID NO: 11246 - protein, 7 aa, Artificial Sequence
  Synthetic
TKYGYSQ

SEQ ID NO: 11247 - protein, 7 aa, Artificial Sequence
  Synthetic
LKLGYST

SEQ ID NO: 11248 - protein, 7 aa, Artificial Sequence
  Synthetic
WTTKDGY

SEQ ID NO: 11249 - protein, 7 aa, Artificial Sequence
  Synthetic
EKSGYSQ

SEQ ID NO: 11250 - protein, 7 aa, Artificial Sequence
  Synthetic
MKVGYST

SEQ ID NO: 11251 - protein, 7 aa, Artificial Sequence
  Synthetic
RYVGESS

SEQ ID NO: 11252 - protein, 7 aa, Artificial Sequence
  Synthetic
VRIGYSQ

SEQ ID NO: 11253 - protein, 7 aa, Artificial Sequence
  Synthetic
TYQGYSS

SEQ ID NO: 11254 - protein, 7 aa, Artificial Sequence
  Synthetic
QKQGYSS

SEQ ID NO: 11255 - protein, 7 aa, Artificial Sequence
  Synthetic
LRLGYSQ

SEQ ID NO: 11256 - protein, 7 aa, Artificial Sequence
  Synthetic
SKQGYSS

SEQ ID NO: 11257 - protein, 7 aa, Artificial Sequence
  Synthetic
VKVGYSQ

SEQ ID NO: 11258 - protein, 7 aa, Artificial Sequence
  Synthetic
TRMGYSQ

SEQ ID NO: 11259 - protein, 7 aa, Artificial Sequence
  Synthetic
WRTGYST

SEQ ID NO: 11260 - protein, 7 aa, Artificial Sequence
  Synthetic
TRHGYSS

SEQ ID NO: 11261 - protein, 7 aa, Artificial Sequence
  Synthetic
DRGGYSQ

SEQ ID NO: 11262 - protein, 7 aa, Artificial Sequence
  Synthetic
IRHGYSS

SEQ ID NO: 11263 - protein, 7 aa, Artificial Sequence
  Synthetic
TKLGYSQ

SEQ ID NO: 11264 - protein, 7 aa, Artificial Sequence
  Synthetic
LKMGYSS

SEQ ID NO: 11265 - protein, 7 aa, Artificial Sequence
  Synthetic
SKIGYSQ

SEQ ID NO: 11266 - protein, 7 aa, Artificial Sequence
  Synthetic
QKAGYSS

SEQ ID NO: 11267 - protein, 7 aa, Artificial Sequence
  Synthetic
MKQGYSQ

SEQ ID NO: 11268 - protein, 7 aa, Artificial Sequence
  Synthetic
NKTGYST

SEQ ID NO: 11269 - protein, 7 aa, Artificial Sequence
  Synthetic
FKHGYSS

SEQ ID NO: 11270 - protein, 7 aa, Artificial Sequence
  Synthetic
NKVGYSQ

SEQ ID NO: 11271 - protein, 7 aa, Artificial Sequence
  Synthetic
IRNGYSQ

SEQ ID NO: 11272 - protein, 7 aa, Artificial Sequence
  Synthetic
ERAGYSS

SEQ ID NO: 11273 - protein, 7 aa, Artificial Sequence
  Synthetic
IKYGYSQ

SEQ ID NO: 11274 - protein, 7 aa, Artificial Sequence
  Synthetic
VRHGYST

SEQ ID NO: 11275 - protein, 7 aa, Artificial Sequence
  Synthetic
NKAGYST

SEQ ID NO: 11276 - protein, 7 aa, Artificial Sequence
  Synthetic
LRHGMSQ

SEQ ID NO: 11277 - protein, 7 aa, Artificial Sequence
  Synthetic
DRFGYSQ

SEQ ID NO: 11278 - protein, 7 aa, Artificial Sequence
  Synthetic
NRQGYSQ

SEQ ID NO: 11279 - protein, 7 aa, Artificial Sequence
  Synthetic
MKYGYSQ

SEQ ID NO: 11280 - protein, 7 aa, Artificial Sequence
  Synthetic
VKMGYSS

SEQ ID NO: 11281 - protein, 7 aa, Artificial Sequence
  Synthetic
ERTGYSS

SEQ ID NO: 11282 - protein, 7 aa, Artificial Sequence
  Synthetic
ERPGYSQ

SEQ ID NO: 11283 - protein, 7 aa, Artificial Sequence
  Synthetic
QRVGYSQ

SEQ ID NO: 11284 - protein, 7 aa, Artificial Sequence
  Synthetic
DRAGYSS

SEQ ID NO: 11285 - protein, 7 aa, Artificial Sequence
  Synthetic
AGIGRAQ

SEQ ID NO: 11286 - protein, 7 aa, Artificial Sequence
  Synthetic
DRFGYSS

SEQ ID NO: 11287 - protein, 7 aa, Artificial Sequence
  Synthetic
FKHGYSQ

SEQ ID NO: 11288 - protein, 7 aa, Artificial Sequence
  Synthetic
ERVGYSQ

SEQ ID NO: 11289 - protein, 7 aa, Artificial Sequence
  Synthetic
TYQGYSS

SEQ ID NO: 11290 - protein, 7 aa, Artificial Sequence
  Synthetic
DRHGYSS

SEQ ID NO: 11291 - protein, 7 aa, Artificial Sequence
  Synthetic
SRNGYSQ

SEQ ID NO: 11292 - protein, 7 aa, Artificial Sequence
  Synthetic
TKQGYSQ

SEQ ID NO: 11293 - protein, 7 aa, Artificial Sequence
  Synthetic
NKTGYSQ

SEQ ID NO: 11294 - protein, 7 aa, Artificial Sequence
  Synthetic
ERHGYSS

SEQ ID NO: 11295 - protein, 7 aa, Artificial Sequence
  Synthetic
NKFGYST

SEQ ID NO: 11296 - protein, 7 aa, Artificial Sequence
  Synthetic
YKVGYSQ

SEQ ID NO: 11297 - protein, 7 aa, Artificial Sequence
  Synthetic
DRIGYST

SEQ ID NO: 11298 - protein, 7 aa, Artificial Sequence
  Synthetic
VKMGYST

SEQ ID NO: 11299 - protein, 7 aa, Artificial Sequence
  Synthetic
TKAGYST

SEQ ID NO: 11300 - protein, 7 aa, Artificial Sequence
  Synthetic
MKQGYSQ

SEQ ID NO: 11301 - protein, 7 aa, Artificial Sequence
  Synthetic
VKLGYST

SEQ ID NO: 11302 - protein, 7 aa, Artificial Sequence
  Synthetic
ERLGYSS

SEQ ID NO: 11303 - protein, 7 aa, Artificial Sequence
  Synthetic
NRMGYSQ

SEQ ID NO: 11304 - protein, 7 aa, Artificial Sequence
  Synthetic
DRHGYSQ

SEQ ID NO: 11305 - protein, 7 aa, Artificial Sequence
  Synthetic
TQMGYSS

SEQ ID NO: 11306 - protein, 7 aa, Artificial Sequence
  Synthetic
FRSGYSQ

SEQ ID NO: 11307 - protein, 7 aa, Artificial Sequence
  Synthetic
SRMGYST

SEQ ID NO: 11308 - protein, 7 aa, Artificial Sequence
  Synthetic
TQQGWSS

SEQ ID NO: 11309 - protein, 7 aa, Artificial Sequence
  Synthetic
LKFGYSQ

SEQ ID NO: 11310 - protein, 7 aa, Artificial Sequence
  Synthetic
SRTGYST

SEQ ID NO: 11311 - protein, 7 aa, Artificial Sequence
  Synthetic
NKYGYSQ

SEQ ID NO: 11312 - protein, 7 aa, Artificial Sequence
  Synthetic
MKHGYST

SEQ ID NO: 11313 - protein, 7 aa, Artificial Sequence
  Synthetic
LRMGYAQ

SEQ ID NO: 11314 - protein, 7 aa, Artificial Sequence
  Synthetic
MKMGYSQ

SEQ ID NO: 11315 - protein, 7 aa, Artificial Sequence
  Synthetic
THQGYSS

SEQ ID NO: 11316 - protein, 7 aa, Artificial Sequence
  Synthetic
ERAGYSS

SEQ ID NO: 11317 - protein, 7 aa, Artificial Sequence
  Synthetic
ERAGYSQ

SEQ ID NO: 11318 - protein, 7 aa, Artificial Sequence
  Synthetic
NRQGYST

SEQ ID NO: 11319 - protein, 7 aa, Artificial Sequence
  Synthetic
TKTGWSA

SEQ ID NO: 11320 - protein, 7 aa, Artificial Sequence
  Synthetic
ERQGYSQ

SEQ ID NO: 11321 - protein, 7 aa, Artificial Sequence
  Synthetic
LSYSASL

SEQ ID NO: 11322 - protein, 7 aa, Artificial Sequence
  Synthetic
DRSGYSS

SEQ ID NO: 11323 - protein, 7 aa, Artificial Sequence
  Synthetic
EKIGYSS

SEQ ID NO: 11324 - protein, 7 aa, Artificial Sequence
  Synthetic
NKFGYSS

SEQ ID NO: 11325 - protein, 7 aa, Artificial Sequence
  Synthetic
RVSNLHT

SEQ ID NO: 11326 - protein, 7 aa, Artificial Sequence
  Synthetic
IRHGYSS

SEQ ID NO: 11327 - protein, 7 aa, Artificial Sequence
  Synthetic
VRHGYSS

SEQ ID NO: 11328 - protein, 7 aa, Artificial Sequence
  Synthetic
TRAGYST

SEQ ID NO: 11329 - protein, 7 aa, Artificial Sequence
  Synthetic
VKYGYST

SEQ ID NO: 11330 - protein, 7 aa, Artificial Sequence
  Synthetic
ERIGYST

SEQ ID NO: 11331 - protein, 7 aa, Artificial Sequence
  Synthetic
MKYGYSQ

SEQ ID NO: 11332 - protein, 7 aa, Artificial Sequence
  Synthetic
IKSGYSQ

SEQ ID NO: 11333 - protein, 7 aa, Artificial Sequence
  Synthetic
SKMGYSQ

SEQ ID NO: 11334 - protein, 7 aa, Artificial Sequence
  Synthetic
HKAGYSQ

SEQ ID NO: 11335 - protein, 7 aa, Artificial Sequence
  Synthetic
IRIGYST

SEQ ID NO: 11336 - protein, 7 aa, Artificial Sequence
  Synthetic
LKEGYSQ

SEQ ID NO: 11337 - protein, 7 aa, Artificial Sequence
  Synthetic
IKLGYST

SEQ ID NO: 11338 - protein, 7 aa, Artificial Sequence
  Synthetic
MRAGYST

SEQ ID NO: 11339 - protein, 7 aa, Artificial Sequence
  Synthetic
WKVGYSQ

SEQ ID NO: 11340 - protein, 7 aa, Artificial Sequence
  Synthetic
NRMGYSS

SEQ ID NO: 11341 - protein, 7 aa, Artificial Sequence
  Synthetic
DRLGYSQ

SEQ ID NO: 11342 - protein, 7 aa, Artificial Sequence
  Synthetic
IKAGYST

SEQ ID NO: 11343 - protein, 7 aa, Artificial Sequence
  Synthetic
DRVGYSS

SEQ ID NO: 11344 - protein, 7 aa, Artificial Sequence
  Synthetic
ERVGYSS

SEQ ID NO: 11345 - protein, 7 aa, Artificial Sequence
  Synthetic
QRQGYSQ

SEQ ID NO: 11346 - protein, 7 aa, Artificial Sequence
  Synthetic
LKTGYST

SEQ ID NO: 11347 - protein, 7 aa, Artificial Sequence
  Synthetic
QKYGYST

SEQ ID NO: 11348 - protein, 7 aa, Artificial Sequence
  Synthetic
EKQGYSS

SEQ ID NO: 11349 - protein, 7 aa, Artificial Sequence
  Synthetic
IRVGYST

SEQ ID NO: 11350 - protein, 7 aa, Artificial Sequence
  Synthetic
DKHGYSQ

SEQ ID NO: 11351 - protein, 7 aa, Artificial Sequence
  Synthetic
NRLGYSQ

SEQ ID NO: 11352 - protein, 7 aa, Artificial Sequence
  Synthetic
TQQGYST

SEQ ID NO: 11353 - protein, 7 aa, Artificial Sequence
  Synthetic
DKVGYST

SEQ ID NO: 11354 - protein, 7 aa, Artificial Sequence
  Synthetic
SKSGYSA

SEQ ID NO: 11355 - protein, 7 aa, Artificial Sequence
  Synthetic
FRTGMSQ

SEQ ID NO: 11356 - protein, 7 aa, Artificial Sequence
  Synthetic
SKFGYSQ

SEQ ID NO: 11357 - protein, 7 aa, Artificial Sequence
  Synthetic
MKYGYSS

SEQ ID NO: 11358 - protein, 7 aa, Artificial Sequence
  Synthetic
NRSGYSQ

SEQ ID NO: 11359 - protein, 7 aa, Artificial Sequence
  Synthetic
DKFGYST

SEQ ID NO: 11360 - protein, 7 aa, Artificial Sequence
  Synthetic
IRDGYSQ

SEQ ID NO: 11361 - protein, 7 aa, Artificial Sequence
  Synthetic
LKVGYST

SEQ ID NO: 11362 - protein, 7 aa, Artificial Sequence
  Synthetic
YKAGYSQ

SEQ ID NO: 11363 - protein, 7 aa, Artificial Sequence
  Synthetic
PRQGYSS

SEQ ID NO: 11364 - protein, 7 aa, Artificial Sequence
  Synthetic
GRMGYST

SEQ ID NO: 11365 - protein, 7 aa, Artificial Sequence
  Synthetic
DRAGYSS

SEQ ID NO: 11366 - protein, 7 aa, Artificial Sequence
  Synthetic
WTTKDGY

SEQ ID NO: 11367 - protein, 7 aa, Artificial Sequence
  Synthetic
MKHGYSQ

SEQ ID NO: 11368 - protein, 7 aa, Artificial Sequence
  Synthetic
EKIGYST

SEQ ID NO: 11369 - protein, 7 aa, Artificial Sequence
  Synthetic
ERSGYSQ

SEQ ID NO: 11370 - protein, 7 aa, Artificial Sequence
  Synthetic
SYHGQAS

SEQ ID NO: 11371 - protein, 7 aa, Artificial Sequence
  Synthetic
IASGYSQ

SEQ ID NO: 11372 - protein, 7 aa, Artificial Sequence
  Synthetic
QYVRALS

SEQ ID NO: 11373 - protein, 7 aa, Artificial Sequence
  Synthetic
FKAGYSS

SEQ ID NO: 11374 - protein, 7 aa, Artificial Sequence
  Synthetic
MKLGYSQ

SEQ ID NO: 11375 - protein, 7 aa, Artificial Sequence
  Synthetic
DRQGYSQ

SEQ ID NO: 11376 - protein, 7 aa, Artificial Sequence
  Synthetic
LRHGMSQ

SEQ ID NO: 11377 - protein, 7 aa, Artificial Sequence
  Synthetic
HKQGYST

SEQ ID NO: 11378 - protein, 7 aa, Artificial Sequence
  Synthetic
EKPGYSQ

SEQ ID NO: 11379 - protein, 7 aa, Artificial Sequence
  Synthetic
GRVGYSS

SEQ ID NO: 11380 - protein, 7 aa, Artificial Sequence
  Synthetic
DRTGYSS

SEQ ID NO: 11381 - protein, 7 aa, Artificial Sequence
  Synthetic
IKHGYSQ

SEQ ID NO: 11382 - protein, 7 aa, Artificial Sequence
  Synthetic
IKQGYST

SEQ ID NO: 11383 - protein, 7 aa, Artificial Sequence
  Synthetic
EKLGYSS

SEQ ID NO: 11384 - protein, 7 aa, Artificial Sequence
  Synthetic
KSAGSIY

SEQ ID NO: 11385 - protein, 7 aa, Artificial Sequence
  Synthetic
EKHGYST

SEQ ID NO: 11386 - protein, 7 aa, Artificial Sequence
  Synthetic
IVYGQAQ

SEQ ID NO: 11387 - protein, 7 aa, Artificial Sequence
  Synthetic
PRSGYSQ

SEQ ID NO: 11388 - protein, 7 aa, Artificial Sequence
  Synthetic
QKVGYSS

SEQ ID NO: 11389 - protein, 7 aa, Artificial Sequence
  Synthetic
VRHGYSQ

SEQ ID NO: 11390 - protein, 7 aa, Artificial Sequence
  Synthetic
TKFGYSS

SEQ ID NO: 11391 - protein, 7 aa, Artificial Sequence
  Synthetic
ELYKLPT

SEQ ID NO: 11392 - protein, 7 aa, Artificial Sequence
  Synthetic
NRMGYSS

SEQ ID NO: 11393 - protein, 7 aa, Artificial Sequence
  Synthetic
TKHGYST

SEQ ID NO: 11394 - protein, 7 aa, Artificial Sequence
  Synthetic
EKIGYSQ

SEQ ID NO: 11395 - protein, 7 aa, Artificial Sequence
  Synthetic
TQQGYSS

SEQ ID NO: 11396 - protein, 7 aa, Artificial Sequence
  Synthetic
NKMGYSQ

SEQ ID NO: 11397 - protein, 7 aa, Artificial Sequence
  Synthetic
MRQGYSQ

SEQ ID NO: 11398 - protein, 7 aa, Artificial Sequence
  Synthetic
SKFGYSQ

SEQ ID NO: 11399 - protein, 7 aa, Artificial Sequence
  Synthetic
HKMGYST

SEQ ID NO: 11400 - protein, 7 aa, Artificial Sequence
  Synthetic
EKAGYSQ

SEQ ID NO: 11401 - protein, 7 aa, Artificial Sequence
  Synthetic
VKQGYST

SEQ ID NO: 11402 - protein, 7 aa, Artificial Sequence
  Synthetic
ERMGRAQ

SEQ ID NO: 11403 - protein, 7 aa, Artificial Sequence
  Synthetic
FRTGMSQ

SEQ ID NO: 11404 - protein, 7 aa, Artificial Sequence
  Synthetic
WRQGYSS

SEQ ID NO: 11405 - protein, 7 aa, Artificial Sequence
  Synthetic
MKMGYSS

SEQ ID NO: 11406 - protein, 7 aa, Artificial Sequence
  Synthetic
LKYGYSQ

SEQ ID NO: 11407 - protein, 7 aa, Artificial Sequence
  Synthetic
NRIGYSS

SEQ ID NO: 11408 - protein, 7 aa, Artificial Sequence
  Synthetic
DRVGYST

SEQ ID NO: 11409 - protein, 7 aa, Artificial Sequence
  Synthetic
HKMGYSS

SEQ ID NO: 11410 - protein, 7 aa, Artificial Sequence
  Synthetic
YKTGYSQ

SEQ ID NO: 11411 - protein, 7 aa, Artificial Sequence
  Synthetic
FRNGYSQ

SEQ ID NO: 11412 - protein, 7 aa, Artificial Sequence
  Synthetic
HKQGYST

SEQ ID NO: 11413 - protein, 7 aa, Artificial Sequence
  Synthetic
IKSGYST

SEQ ID NO: 11414 - protein, 7 aa, Artificial Sequence
  Synthetic
SKYYDSS

SEQ ID NO: 11415 - protein, 7 aa, Artificial Sequence
  Synthetic
INYSQTL

SEQ ID NO: 11416 - protein, 7 aa, Artificial Sequence
  Synthetic
WKMGYSS

SEQ ID NO: 11417 - protein, 7 aa, Artificial Sequence
  Synthetic
ERNGYSQ

SEQ ID NO: 11418 - protein, 7 aa, Artificial Sequence
  Synthetic
DKFGYSS

SEQ ID NO: 11419 - protein, 7 aa, Artificial Sequence
  Synthetic
SRAGYSQ

SEQ ID NO: 11420 - protein, 7 aa, Artificial Sequence
  Synthetic
LLKGYAQ

SEQ ID NO: 11421 - protein, 7 aa, Artificial Sequence
  Synthetic
WKHGYSQ

SEQ ID NO: 11422 - protein, 7 aa, Artificial Sequence
  Synthetic
TQIGYSS

SEQ ID NO: 11423 - protein, 7 aa, Artificial Sequence
  Synthetic
LRTGWSA

SEQ ID NO: 11424 - protein, 7 aa, Artificial Sequence
  Synthetic
WKAGYST

SEQ ID NO: 11425 - protein, 7 aa, Artificial Sequence
  Synthetic
TNQGYSS

SEQ ID NO: 11426 - protein, 7 aa, Artificial Sequence
  Synthetic
MKHGYSS

SEQ ID NO: 11427 - protein, 7 aa, Artificial Sequence
  Synthetic
SKYGYSS

SEQ ID NO: 11428 - protein, 7 aa, Artificial Sequence
  Synthetic
IRYGYSS

SEQ ID NO: 11429 - protein, 7 aa, Artificial Sequence
  Synthetic
DRTLRHD

SEQ ID NO: 11430 - protein, 7 aa, Artificial Sequence
  Synthetic
WKTGYST

SEQ ID NO: 11431 - protein, 7 aa, Artificial Sequence
  Synthetic
YRQGYSQ

SEQ ID NO: 11432 - protein, 7 aa, Artificial Sequence
  Synthetic
EKTGYSS

SEQ ID NO: 11433 - protein, 7 aa, Artificial Sequence
  Synthetic
TKTGYSQ

SEQ ID NO: 11434 - protein, 7 aa, Artificial Sequence
  Synthetic
AKHGYSS

SEQ ID NO: 11435 - protein, 7 aa, Artificial Sequence
  Synthetic
TQIGYSS

SEQ ID NO: 11436 - protein, 7 aa, Artificial Sequence
  Synthetic
TRLGYSQ

SEQ ID NO: 11437 - protein, 7 aa, Artificial Sequence
  Synthetic
FRPAGSQ

SEQ ID NO: 11438 - protein, 7 aa, Artificial Sequence
  Synthetic
ERTGYST

SEQ ID NO: 11439 - protein, 7 aa, Artificial Sequence
  Synthetic
GRQGYSQ

SEQ ID NO: 11440 - protein, 7 aa, Artificial Sequence
  Synthetic
WGTPPRG

SEQ ID NO: 11441 - protein, 7 aa, Artificial Sequence
  Synthetic
WKAGYST

SEQ ID NO: 11442 - protein, 7 aa, Artificial Sequence
  Synthetic
MKHGYSQ

SEQ ID NO: 11443 - protein, 7 aa, Artificial Sequence
  Synthetic
ERVGYSQ

SEQ ID NO: 11444 - protein, 7 aa, Artificial Sequence
  Synthetic
LRHGLST

SEQ ID NO: 11445 - protein, 7 aa, Artificial Sequence
  Synthetic
DRVGYSS

SEQ ID NO: 11446 - protein, 7 aa, Artificial Sequence
  Synthetic
HKYGYSQ

SEQ ID NO: 11447 - protein, 7 aa, Artificial Sequence
  Synthetic
EKLGYSQ

SEQ ID NO: 11448 - protein, 7 aa, Artificial Sequence
  Synthetic
EKPGYSQ

SEQ ID NO: 11449 - protein, 7 aa, Artificial Sequence
  Synthetic
MRMGYSQ

SEQ ID NO: 11450 - protein, 7 aa, Artificial Sequence
  Synthetic
QKYGYST

SEQ ID NO: 11451 - protein, 7 aa, Artificial Sequence
  Synthetic
MKMGYSQ

SEQ ID NO: 11452 - protein, 7 aa, Artificial Sequence
  Synthetic
HKLGYSS

SEQ ID NO: 11453 - protein, 7 aa, Artificial Sequence
  Synthetic
IKYGYSS

SEQ ID NO: 11454 - protein, 7 aa, Artificial Sequence
  Synthetic
DKVGYSQ

SEQ ID NO: 11455 - protein, 7 aa, Artificial Sequence
  Synthetic
DRLGYSS

SEQ ID NO: 11456 - protein, 7 aa, Artificial Sequence
  Synthetic
ELYKLPT

SEQ ID NO: 11457 - protein, 7 aa, Artificial Sequence
  Synthetic
QRHGYST

SEQ ID NO: 11458 - protein, 7 aa, Artificial Sequence
  Synthetic
LRGGYSQ

SEQ ID NO: 11459 - protein, 7 aa, Artificial Sequence
  Synthetic
EKVGYSS

SEQ ID NO: 11460 - protein, 7 aa, Artificial Sequence
  Synthetic
IKYAGSQ

SEQ ID NO: 11461 - protein, 7 aa, Artificial Sequence
  Synthetic
EKFGYST

SEQ ID NO: 11462 - protein, 7 aa, Artificial Sequence
  Synthetic
IKSGYST

SEQ ID NO: 11463 - protein, 7 aa, Artificial Sequence
  Synthetic
IKYGYSS

SEQ ID NO: 11464 - protein, 7 aa, Artificial Sequence
  Synthetic
TQQGYSS

SEQ ID NO: 11465 - protein, 7 aa, Artificial Sequence
  Synthetic
TQQGYSS

SEQ ID NO: 11466 - protein, 7 aa, Artificial Sequence
  Synthetic
VKLGYST

SEQ ID NO: 11467 - protein, 7 aa, Artificial Sequence
  Synthetic
DRVGYSQ

SEQ ID NO: 11468 - protein, 7 aa, Artificial Sequence
  Synthetic
DKHGYST

SEQ ID NO: 11469 - protein, 7 aa, Artificial Sequence
  Synthetic
MRQGYST

SEQ ID NO: 11470 - protein, 7 aa, Artificial Sequence
  Synthetic
PRIGYSQ

SEQ ID NO: 11471 - protein, 7 aa, Artificial Sequence
  Synthetic
EKIGYST

SEQ ID NO: 11472 - protein, 7 aa, Artificial Sequence
  Synthetic
VKTGYST

SEQ ID NO: 11473 - protein, 7 aa, Artificial Sequence
  Synthetic
RYTADAS

SEQ ID NO: 11474 - protein, 7 aa, Artificial Sequence
  Synthetic
YGSLSAL

SEQ ID NO: 11475 - protein, 7 aa, Artificial Sequence
  Synthetic
FREGYSQ

SEQ ID NO: 11476 - protein, 7 aa, Artificial Sequence
  Synthetic
DKIGYSQ

SEQ ID NO: 11477 - protein, 7 aa, Artificial Sequence
  Synthetic
IRAGWSQ

SEQ ID NO: 11478 - protein, 7 aa, Artificial Sequence
  Synthetic
NKHGYSS

SEQ ID NO: 11479 - protein, 7 aa, Artificial Sequence
  Synthetic
GSEVGRW

SEQ ID NO: 11480 - protein, 7 aa, Artificial Sequence
  Synthetic
IKTGYST

SEQ ID NO: 11481 - protein, 7 aa, Artificial Sequence
  Synthetic
LMKGWAS

SEQ ID NO: 11482 - protein, 7 aa, Artificial Sequence
  Synthetic
IKEGYSQ

SEQ ID NO: 11483 - protein, 7 aa, Artificial Sequence
  Synthetic
DKVGYSS

SEQ ID NO: 11484 - protein, 7 aa, Artificial Sequence
  Synthetic
VKAGYST

SEQ ID NO: 11485 - protein, 7 aa, Artificial Sequence
  Synthetic
KKEGYSQ

SEQ ID NO: 11486 - protein, 7 aa, Artificial Sequence
  Synthetic
KKVGYSQ

SEQ ID NO: 11487 - protein, 7 aa, Artificial Sequence
  Synthetic
DKAGYSQ

SEQ ID NO: 11488 - protein, 7 aa, Artificial Sequence
  Synthetic
WKQMGAA

SEQ ID NO: 11489 - protein, 7 aa, Artificial Sequence
  Synthetic
IKVGYSS

SEQ ID NO: 11490 - protein, 7 aa, Artificial Sequence
  Synthetic
QRGGYSQ

SEQ ID NO: 11491 - protein, 7 aa, Artificial Sequence
  Synthetic
IRHGYSQ

SEQ ID NO: 11492 - protein, 7 aa, Artificial Sequence
  Synthetic
IKAGYST

SEQ ID NO: 11493 - protein, 7 aa, Artificial Sequence
  Synthetic
VKTGYST

SEQ ID NO: 11494 - protein, 7 aa, Artificial Sequence
  Synthetic
TRVGDYL

SEQ ID NO: 11495 - protein, 7 aa, Artificial Sequence
  Synthetic
TQLGYSS

SEQ ID NO: 11496 - protein, 7 aa, Artificial Sequence
  Synthetic
EKAGYSS

SEQ ID NO: 11497 - protein, 7 aa, Artificial Sequence
  Synthetic
NRMGYSQ

SEQ ID NO: 11498 - protein, 7 aa, Artificial Sequence
  Synthetic
TKFGYSQ

SEQ ID NO: 11499 - protein, 7 aa, Artificial Sequence
  Synthetic
FRQGYSQ

SEQ ID NO: 11500 - protein, 7 aa, Artificial Sequence
  Synthetic
TRQGYSQ

SEQ ID NO: 11501 - protein, 7 aa, Artificial Sequence
  Synthetic
VKHGYSQ

SEQ ID NO: 11502 - protein, 7 aa, Artificial Sequence
  Synthetic
DKAGYST

SEQ ID NO: 11503 - protein, 7 aa, Artificial Sequence
  Synthetic
ERYGYST

SEQ ID NO: 11504 - protein, 7 aa, Artificial Sequence
  Synthetic
GKAGYST

SEQ ID NO: 11505 - protein, 7 aa, Artificial Sequence
  Synthetic
YKHGYSS

SEQ ID NO: 11506 - protein, 7 aa, Artificial Sequence
  Synthetic
VREGYSS

SEQ ID NO: 11507 - protein, 7 aa, Artificial Sequence
  Synthetic
FKQGYST

SEQ ID NO: 11508 - protein, 7 aa, Artificial Sequence
  Synthetic
FRVGYST

SEQ ID NO: 11509 - protein, 7 aa, Artificial Sequence
  Synthetic
DKAGYSS

SEQ ID NO: 11510 - protein, 7 aa, Artificial Sequence
  Synthetic
ERYGGSI

SEQ ID NO: 11511 - protein, 7 aa, Artificial Sequence
  Synthetic
PRIGYSQ

SEQ ID NO: 11512 - protein, 7 aa, Artificial Sequence
  Synthetic
WRSLGAA

SEQ ID NO: 11513 - protein, 7 aa, Artificial Sequence
  Synthetic
VKYGYSS

SEQ ID NO: 11514 - protein, 7 aa, Artificial Sequence
  Synthetic
MRLGYST

SEQ ID NO: 11515 - protein, 7 aa, Artificial Sequence
  Synthetic
MKMGYST

SEQ ID NO: 11516 - protein, 7 aa, Artificial Sequence
  Synthetic
DKAGYSS

SEQ ID NO: 11517 - protein, 7 aa, Artificial Sequence
  Synthetic
NENSGRW

SEQ ID NO: 11518 - protein, 7 aa, Artificial Sequence
  Synthetic
TKWGYSQ

SEQ ID NO: 11519 - protein, 7 aa, Artificial Sequence
  Synthetic
EKQGYST

SEQ ID NO: 11520 - protein, 7 aa, Artificial Sequence
  Synthetic
YKFGYSQ

SEQ ID NO: 11521 - DNA, 21 bp, Artificial Sequence
  Synthetic
gtgaaattcgggtattcctcc

SEQ ID NO: 11522 - DNA, 21 bp, Artificial Sequence
  Synthetic
aataaatatgggtattcccag

SEQ ID NO: 11523 - DNA, 21 bp, Artificial Sequence
  Synthetic
cagaaattcgggtattcccag

SEQ ID NO: 11524 - DNA, 21 bp, Artificial Sequence
  Synthetic
atgaggttggggtattcccag

SEQ ID NO: 11525 - DNA, 21 bp, Artificial Sequence
  Synthetic
cagaaatatgggtattcctcc

SEQ ID NO: 11526 - DNA, 21 bp, Artificial Sequence
  Synthetic
ctgaagtttggctactcaacc

SEQ ID NO: 11527 - DNA, 21 bp, Artificial Sequence
  Synthetic
aacaagtacggctactcaacc

SEQ ID NO: 11528 - DNA, 21 bp, Artificial Sequence
  Synthetic
tccaaacacgggtattcccag

SEQ ID NO: 11529 - DNA, 21 bp, Artificial Sequence
  Synthetic
gtaaagtacggctactcacaa

SEQ ID NO: 11530 - DNA, 21 bp, Artificial Sequence
  Synthetic
ttgaaatatgggtattccacg

SEQ ID NO: 11531 - DNA, 21 bp, Artificial Sequence
  Synthetic
atgaaaatagggtattcctcc

SEQ ID NO: 11532 - DNA, 21 bp, Artificial Sequence
  Synthetic
gtgaggatggggtattcccag

SEQ ID NO: 11533 - DNA, 21 bp, Artificial Sequence
  Synthetic
caacgcaccggctactcacaa

SEQ ID NO: 11534 - DNA, 21 bp, Artificial Sequence
  Synthetic
ataaggttggggtattcctcc

SEQ ID NO: 11535 - DNA, 21 bp, Artificial Sequence
  Synthetic
cagaaatatgggtattcccag

SEQ ID NO: 11536 - DNA, 21 bp, Artificial Sequence
  Synthetic
tccaggatagggtattccacg

SEQ ID NO: 11537 - DNA, 21 bp, Artificial Sequence
  Synthetic
aataaatatgggtattccacg

SEQ ID NO: 11538 - DNA, 21 bp, Artificial Sequence
  Synthetic
caacgccatggctactcacaa

SEQ ID NO: 11539 - DNA, 21 bp, Artificial Sequence
  Synthetic
cacagggtggggtattcccag

SEQ ID NO: 11540 - DNA, 21 bp, Artificial Sequence
  Synthetic
atgagggtggggtattcccag

SEQ ID NO: 11541 - DNA, 21 bp, Artificial Sequence
  Synthetic
gataggttcgggtattcccag

SEQ ID NO: 11542 - DNA, 21 bp, Artificial Sequence
  Synthetic
caggatttgttgaatatgagg

SEQ ID NO: 11543 - DNA, 21 bp, Artificial Sequence
  Synthetic
ttgaggcacgggtattcccag

SEQ ID NO: 11544 - DNA, 21 bp, Artificial Sequence
  Synthetic
gaaaaggtaggctactcacaa

SEQ ID NO: 11545 - DNA, 21 bp, Artificial Sequence
  Synthetic
acgaggacggggtattcccag

SEQ ID NO: 11546 - DNA, 21 bp, Artificial Sequence
  Synthetic
gcgaaatatgggtattcccag

SEQ ID NO: 11547 - DNA, 21 bp, Artificial Sequence
  Synthetic
gtgaggcacgggtattcccag

SEQ ID NO: 11548 - DNA, 21 bp, Artificial Sequence
  Synthetic
cagaaattggggtattcccag

SEQ ID NO: 11549 - DNA, 21 bp, Artificial Sequence
  Synthetic
atgaagtttggctactcacaa

SEQ ID NO: 11550 - DNA, 21 bp, Artificial Sequence
  Synthetic
caaaagtacggctactcacaa

SEQ ID NO: 11551 - DNA, 21 bp, Artificial Sequence
  Synthetic
aaccgcatcggctactcatca

SEQ ID NO: 11552 - DNA, 21 bp, Artificial Sequence
  Synthetic
tttaagatgggctactcacaa

SEQ ID NO: 11553 - DNA, 21 bp, Artificial Sequence
  Synthetic
aatagggtggggttctcccag

SEQ ID NO: 11554 - DNA, 21 bp, Artificial Sequence
  Synthetic
atgaggatagggtattcccag

SEQ ID NO: 11555 - DNA, 21 bp, Artificial Sequence
  Synthetic
gtacgcgtaggctactcacaa

SEQ ID NO: 11556 - DNA, 21 bp, Artificial Sequence
  Synthetic
ctgaagtacggctactcaacc

SEQ ID NO: 11557 - DNA, 21 bp, Artificial Sequence
  Synthetic
cagagggcggggtattcccag

SEQ ID NO: 11558 - DNA, 21 bp, Artificial Sequence
  Synthetic
gagaaattcgggtattccacg

SEQ ID NO: 11559 - DNA, 21 bp, Artificial Sequence
  Synthetic
aaccgcgtaggcttttcacaa

SEQ ID NO: 11560 - DNA, 21 bp, Artificial Sequence
  Synthetic
tggcgcatcggctactcacaa

SEQ ID NO: 11561 - DNA, 21 bp, Artificial Sequence
  Synthetic
gataaaccggggtattcccag

SEQ ID NO: 11562 - DNA, 21 bp, Artificial Sequence
  Synthetic
ttgaggggggggtattccacg

SEQ ID NO: 11563 - DNA, 21 bp, Artificial Sequence
  Synthetic
accaagtttggctactcaacc

SEQ ID NO: 11564 - DNA, 21 bp, Artificial Sequence
  Synthetic
aagtcagtaggctcagtatac

SEQ ID NO: 11565 - DNA, 21 bp, Artificial Sequence
  Synthetic
acgagggtggggtattcccag

SEQ ID NO: 11566 - DNA, 21 bp, Artificial Sequence
  Synthetic
cacaggacggggtattcctcc

SEQ ID NO: 11567 - DNA, 21 bp, Artificial Sequence
  Synthetic
ataaggacggggtattcccag

SEQ ID NO: 11568 - DNA, 21 bp, Artificial Sequence
  Synthetic
atccgcgtaggctactcacaa

SEQ ID NO: 11569 - DNA, 21 bp, Artificial Sequence
  Synthetic
atcaagtacggctactcaacc

SEQ ID NO: 11570 - DNA, 21 bp, Artificial Sequence
  Synthetic
ctgaagaccggctactcacaa

SEQ ID NO: 11571 - DNA, 21 bp, Artificial Sequence
  Synthetic
caacgctcaggctactcacaa

SEQ ID NO: 11572 - DNA, 21 bp, Artificial Sequence
  Synthetic
tggaaaatagggtattcccag

SEQ ID NO: 11573 - DNA, 21 bp, Artificial Sequence
  Synthetic
atgcgcaccggctactcacaa

SEQ ID NO: 11574 - DNA, 21 bp, Artificial Sequence
  Synthetic
ctgcgccatggctactcaacc

SEQ ID NO: 11575 - DNA, 21 bp, Artificial Sequence
  Synthetic
ccgaaatattccgtgaatgtg

SEQ ID NO: 11576 - DNA, 21 bp, Artificial Sequence
  Synthetic
ataaaaacggggtattcctcc

SEQ ID NO: 11577 - DNA, 21 bp, Artificial Sequence
  Synthetic
acccgcatcggctactcatca

SEQ ID NO: 11578 - DNA, 21 bp, Artificial Sequence
  Synthetic
ctgcgcgtaggctactcatca

SEQ ID NO: 11579 - DNA, 21 bp, Artificial Sequence
  Synthetic
ctgcgcaccggctactcaacc

SEQ ID NO: 11580 - DNA, 21 bp, Artificial Sequence
  Synthetic
atgaaattggggtattcctcc

SEQ ID NO: 11581 - DNA, 21 bp, Artificial Sequence
  Synthetic
cacaggacggggtattcccag

SEQ ID NO: 11582 - DNA, 21 bp, Artificial Sequence
  Synthetic
atcaaggccggctactcacaa

SEQ ID NO: 11583 - DNA, 21 bp, Artificial Sequence
  Synthetic
atgaaggtaggctactcacaa

SEQ ID NO: 11584 - DNA, 21 bp, Artificial Sequence
  Synthetic
tatacgttgtcccaggggtgg

SEQ ID NO: 11585 - DNA, 21 bp, Artificial Sequence
  Synthetic
gtacgcatgggctactcatca

SEQ ID NO: 11586 - DNA, 21 bp, Artificial Sequence
  Synthetic
ataaggatagggtattcccag

SEQ ID NO: 11587 - DNA, 21 bp, Artificial Sequence
  Synthetic
caaaaggccggctactcacaa

SEQ ID NO: 11588 - DNA, 21 bp, Artificial Sequence
  Synthetic
ttgagggtggggtattcccag

SEQ ID NO: 11589 - DNA, 21 bp, Artificial Sequence
  Synthetic
ataagggtggggtattcccag

SEQ ID NO: 11590 - DNA, 21 bp, Artificial Sequence
  Synthetic
acgaggccggggtattcccag

SEQ ID NO: 11591 - DNA, 21 bp, Artificial Sequence
  Synthetic
atgaggccggggtattcccag

SEQ ID NO: 11592 - DNA, 21 bp, Artificial Sequence
  Synthetic
gcgaggttggggtattcctcc

SEQ ID NO: 11593 - DNA, 21 bp, Artificial Sequence
  Synthetic
gtaaagctgggctactcacaa

SEQ ID NO: 11594 - DNA, 21 bp, Artificial Sequence
  Synthetic
acccgcggcggctactcaacc

SEQ ID NO: 11595 - DNA, 21 bp, Artificial Sequence
  Synthetic
atccgcatcggctactcatca

SEQ ID NO: 11596 - DNA, 21 bp, Artificial Sequence
  Synthetic
acccgcggcggctactcacaa

SEQ ID NO: 11597 - DNA, 21 bp, Artificial Sequence
  Synthetic
ttcaaatccgggtattcccag

SEQ ID NO: 11598 - DNA, 21 bp, Artificial Sequence
  Synthetic
tttcgcgtaggctactcacaa

SEQ ID NO: 11599 - DNA, 21 bp, Artificial Sequence
  Synthetic
tcacgcaccggctactcatca

SEQ ID NO: 11600 - DNA, 21 bp, Artificial Sequence
  Synthetic
ctgctgaagggctacgcccaa

SEQ ID NO: 11601 - DNA, 21 bp, Artificial Sequence
  Synthetic
cagaggatagggtattcctcc

SEQ ID NO: 11602 - DNA, 21 bp, Artificial Sequence
  Synthetic
gtgaaaatggggtattcccag

SEQ ID NO: 11603 - DNA, 21 bp, Artificial Sequence
  Synthetic
tccaaagcggggtattcccag

SEQ ID NO: 11604 - DNA, 21 bp, Artificial Sequence
  Synthetic
cagaaaccggggtattcccag

SEQ ID NO: 11605 - DNA, 21 bp, Artificial Sequence
  Synthetic
accaaggccggctactcacaa

SEQ ID NO: 11606 - DNA, 21 bp, Artificial Sequence
  Synthetic
tataggcacgggtattcccag

SEQ ID NO: 11607 - DNA, 21 bp, Artificial Sequence
  Synthetic
cagaggatagggtattcccag

SEQ ID NO: 11608 - DNA, 21 bp, Artificial Sequence
  Synthetic
atgcgcatcggctactcatca

SEQ ID NO: 11609 - DNA, 21 bp, Artificial Sequence
  Synthetic
tggaaatccgggtattcccag

SEQ ID NO: 11610 - DNA, 21 bp, Artificial Sequence
  Synthetic
gtgaaagtggggtattcccag

SEQ ID NO: 11611 - DNA, 21 bp, Artificial Sequence
  Synthetic
ttcaaagtggggtattcccag

SEQ ID NO: 11612 - DNA, 21 bp, Artificial Sequence
  Synthetic
atccgcatcggctactcaacc

SEQ ID NO: 11613 - DNA, 21 bp, Artificial Sequence
  Synthetic
gaaaagtacggctactcaacc

SEQ ID NO: 11614 - DNA, 21 bp, Artificial Sequence
  Synthetic
tataggacggggtattcccag

SEQ ID NO: 11615 - DNA, 21 bp, Artificial Sequence
  Synthetic
atgaggggggggtattcccag

SEQ ID NO: 11616 - DNA, 21 bp, Artificial Sequence
  Synthetic
accaagtttggctactcatca

SEQ ID NO: 11617 - DNA, 21 bp, Artificial Sequence
  Synthetic
ttcaaacacgggtattcccag

SEQ ID NO: 11618 - DNA, 21 bp, Artificial Sequence
  Synthetic
acgaaacaggggtattccacg

SEQ ID NO: 11619 - DNA, 21 bp, Artificial Sequence
  Synthetic
acccgcaccggctactcatca

SEQ ID NO: 11620 - DNA, 21 bp, Artificial Sequence
  Synthetic
aacaagatgggctactcaacc

SEQ ID NO: 11621 - DNA, 21 bp, Artificial Sequence
  Synthetic
accaagcccggctactcacaa

SEQ ID NO: 11622 - DNA, 21 bp, Artificial Sequence
  Synthetic
aataaaatagggtattcccag

SEQ ID NO: 11623 - DNA, 21 bp, Artificial Sequence
  Synthetic
acgagggcggggtattcctcc

SEQ ID NO: 11624 - DNA, 21 bp, Artificial Sequence
  Synthetic
ttgaaatatgggtattcctcc

SEQ ID NO: 11625 - DNA, 21 bp, Artificial Sequence
  Synthetic
gcgaggatagggtattcccag

SEQ ID NO: 11626 - DNA, 21 bp, Artificial Sequence
  Synthetic
cagaaagcggggtattcccag

SEQ ID NO: 11627 - DNA, 21 bp, Artificial Sequence
  Synthetic
caacgccccggctactcacaa

SEQ ID NO: 11628 - DNA, 21 bp, Artificial Sequence
  Synthetic
gtacgcctgggctactcatca

SEQ ID NO: 11629 - DNA, 21 bp, Artificial Sequence
  Synthetic
tggaaaacggggtattcccag

SEQ ID NO: 11630 - DNA, 21 bp, Artificial Sequence
  Synthetic
ataaaaatggggtattccacg

SEQ ID NO: 11631 - DNA, 21 bp, Artificial Sequence
  Synthetic
gtgaaattggggtattcccag

SEQ ID NO: 11632 - DNA, 21 bp, Artificial Sequence
  Synthetic
acgaggatagggtattcccag

SEQ ID NO: 11633 - DNA, 21 bp, Artificial Sequence
  Synthetic
tggaaacacgggtattcccag

SEQ ID NO: 11634 - DNA, 21 bp, Artificial Sequence
  Synthetic
cagataacgaattatcacgtg

SEQ ID NO: 11635 - DNA, 21 bp, Artificial Sequence
  Synthetic
ctgaagatgggctactcacaa

SEQ ID NO: 11636 - DNA, 21 bp, Artificial Sequence
  Synthetic
aataggacggggtattcccag

SEQ ID NO: 11637 - DNA, 21 bp, Artificial Sequence
  Synthetic
ctgcgcatcggctactcacaa

SEQ ID NO: 11638 - DNA, 21 bp, Artificial Sequence
  Synthetic
caacgcatcggctactcatca

SEQ ID NO: 11639 - DNA, 21 bp, Artificial Sequence
  Synthetic
gtgagggtggggtattcctcc

SEQ ID NO: 11640 - DNA, 21 bp, Artificial Sequence
  Synthetic
ttgaaagtgaattattcccag

SEQ ID NO: 11641 - DNA, 21 bp, Artificial Sequence
  Synthetic
tcacgcatcggctactcacaa

SEQ ID NO: 11642 - DNA, 21 bp, Artificial Sequence
  Synthetic
aaatccgtggggtccgtgtat

SEQ ID NO: 11643 - DNA, 21 bp, Artificial Sequence
  Synthetic
aaccgcatgggctactcaacc

SEQ ID NO: 11644 - DNA, 21 bp, Artificial Sequence
  Synthetic
taccgcgtaggctactcacaa

SEQ ID NO: 11645 - DNA, 21 bp, Artificial Sequence
  Synthetic
atgcgcgccggctactcaacc

SEQ ID NO: 11646 - DNA, 21 bp, Artificial Sequence
  Synthetic
atgaaaacggggtattcccag

SEQ ID NO: 11647 - DNA, 21 bp, Artificial Sequence
  Synthetic
gtacgccaaggctactcacaa

SEQ ID NO: 11648 - DNA, 21 bp, Artificial Sequence
  Synthetic
tcaaagatcggctactcacaa

SEQ ID NO: 11649 - DNA, 21 bp, Artificial Sequence
  Synthetic
ctgcgcaccggctactcacaa

SEQ ID NO: 11650 - DNA, 21 bp, Artificial Sequence
  Synthetic
gtgaaatccgggtattcccag

SEQ ID NO: 11651 - DNA, 21 bp, Artificial Sequence
  Synthetic
ctgaagatcggctactcacaa

SEQ ID NO: 11652 - DNA, 21 bp, Artificial Sequence
  Synthetic
gccaaggccggctactcacaa

SEQ ID NO: 11653 - DNA, 21 bp, Artificial Sequence
  Synthetic
gtgaggatggggtattcctcc

SEQ ID NO: 11654 - DNA, 21 bp, Artificial Sequence
  Synthetic
ttcaaagcggggtattcccag

SEQ ID NO: 11655 - DNA, 21 bp, Artificial Sequence
  Synthetic
aaatccgcggggtccatatat

SEQ ID NO: 11656 - DNA, 21 bp, Artificial Sequence
  Synthetic
ctgaagatgggctactcatca

SEQ ID NO: 11657 - DNA, 21 bp, Artificial Sequence
  Synthetic
tcaaagatcggctactcatca

SEQ ID NO: 11658 - DNA, 21 bp, Artificial Sequence
  Synthetic
aatagggtggggtattcccag

SEQ ID NO: 11659 - DNA, 21 bp, Artificial Sequence
  Synthetic
gtgaaaacggggtattcccag

SEQ ID NO: 11660 - DNA, 21 bp, Artificial Sequence
  Synthetic
accaagctgggctactcaacc

SEQ ID NO: 11661 - DNA, 21 bp, Artificial Sequence
  Synthetic
acgaggacggggtattccacg

SEQ ID NO: 11662 - DNA, 21 bp, Artificial Sequence
  Synthetic
cagagggcggggtattcctcc

SEQ ID NO: 11663 - DNA, 21 bp, Artificial Sequence
  Synthetic
gcccgcgccggctactcacaa

SEQ ID NO: 11664 - DNA, 21 bp, Artificial Sequence
  Synthetic
tccaaatatgggtattcccag

SEQ ID NO: 11665 - DNA, 21 bp, Artificial Sequence
  Synthetic
tggaggacggggtattcccag

SEQ ID NO: 11666 - DNA, 21 bp, Artificial Sequence
  Synthetic
atgaaaccggggtattcccag

SEQ ID NO: 11667 - DNA, 21 bp, Artificial Sequence
  Synthetic
ctgaagcccggctactcacaa

SEQ ID NO: 11668 - DNA, 21 bp, Artificial Sequence
  Synthetic
ttgaggtccgggtattcccag

SEQ ID NO: 11669 - DNA, 21 bp, Artificial Sequence
  Synthetic
gataggttcgggtattccacg

SEQ ID NO: 11670 - DNA, 21 bp, Artificial Sequence
  Synthetic
tcagcccgcggctactcaacc

SEQ ID NO: 11671 - DNA, 21 bp, Artificial Sequence
  Synthetic
gtacgcatcggctactcacaa

SEQ ID NO: 11672 - DNA, 21 bp, Artificial Sequence
  Synthetic
atccgcatgggctactcatca

SEQ ID NO: 11673 - DNA, 21 bp, Artificial Sequence
  Synthetic
atccgcatcggctactcacaa

SEQ ID NO: 11674 - DNA, 21 bp, Artificial Sequence
  Synthetic
tcacgcgtaggctactcacaa

SEQ ID NO: 11675 - DNA, 21 bp, Artificial Sequence
  Synthetic
ctgcgcgccggctactcacaa

SEQ ID NO: 11676 - DNA, 21 bp, Artificial Sequence
  Synthetic
acgtccaaagggtattcctcc

SEQ ID NO: 11677 - DNA, 21 bp, Artificial Sequence
  Synthetic
atcaagaccggctactcacaa

SEQ ID NO: 11678 - DNA, 21 bp, Artificial Sequence
  Synthetic
ttgaaatccgggtattcccag

SEQ ID NO: 11679 - DNA, 21 bp, Artificial Sequence
  Synthetic
ctgaagatcggctactcatca

SEQ ID NO: 11680 - DNA, 21 bp, Artificial Sequence
  Synthetic
tggaagaccggctactcacaa

SEQ ID NO: 11681 - DNA, 21 bp, Artificial Sequence
  Synthetic
tttaaggccggctactcacaa

SEQ ID NO: 11682 - DNA, 21 bp, Artificial Sequence
  Synthetic
atgaggatagggtattccacg

SEQ ID NO: 11683 - DNA, 21 bp, Artificial Sequence
  Synthetic
gtgaggatggggtattccacg

SEQ ID NO: 11684 - DNA, 21 bp, Artificial Sequence
  Synthetic
ttgttgaaagggtattcccag

SEQ ID NO: 11685 - DNA, 21 bp, Artificial Sequence
  Synthetic
atgaaggccggctactcacaa

SEQ ID NO: 11686 - DNA, 21 bp, Artificial Sequence
  Synthetic
tccaaagcggggtattccacg

SEQ ID NO: 11687 - DNA, 21 bp, Artificial Sequence
  Synthetic
atcaagatgggctactcaacc

SEQ ID NO: 11688 - DNA, 21 bp, Artificial Sequence
  Synthetic
cataagatcggctactcatca

SEQ ID NO: 11689 - DNA, 21 bp, Artificial Sequence
  Synthetic
acgcagcacgggtattcctcc

SEQ ID NO: 11690 - DNA, 21 bp, Artificial Sequence
  Synthetic
cgctggaaccccgactcagcc

SEQ ID NO: 11691 - DNA, 21 bp, Artificial Sequence
  Synthetic
acgatgaaagggttcgcgcag

SEQ ID NO: 11692 - DNA, 21 bp, Artificial Sequence
  Synthetic
tcacgccccggctactcacaa

SEQ ID NO: 11693 - DNA, 21 bp, Artificial Sequence
  Synthetic
ccgaaatatgggtattcctcc

SEQ ID NO: 11694 - DNA, 21 bp, Artificial Sequence
  Synthetic
caacgcgtaggctactcacaa

SEQ ID NO: 11695 - DNA, 21 bp, Artificial Sequence
  Synthetic
gcgaaatatgggtattcctcc

SEQ ID NO: 11696 - DNA, 21 bp, Artificial Sequence
  Synthetic
gtgaaaatagggtattcccag

SEQ ID NO: 11697 - DNA, 21 bp, Artificial Sequence
  Synthetic
cccaagcatggctactcatca

SEQ ID NO: 11698 - DNA, 21 bp, Artificial Sequence
  Synthetic
atgcgcatcggctactcaacc

SEQ ID NO: 11699 - DNA, 21 bp, Artificial Sequence
  Synthetic
cacaaaacggggtattcccag

SEQ ID NO: 11700 - DNA, 21 bp, Artificial Sequence
  Synthetic
cagaaaacggggtattcccag

SEQ ID NO: 11701 - DNA, 21 bp, Artificial Sequence
  Synthetic
cagaaagtggggtattcccag

SEQ ID NO: 11702 - DNA, 21 bp, Artificial Sequence
  Synthetic
gtgaaacacgggtattccacg

SEQ ID NO: 11703 - DNA, 21 bp, Artificial Sequence
  Synthetic
cagaaaatagggtattcccag

SEQ ID NO: 11704 - DNA, 21 bp, Artificial Sequence
  Synthetic
tacaccctgtcacaaggctgg

SEQ ID NO: 11705 - DNA, 21 bp, Artificial Sequence
  Synthetic
ataaggacggggtattcctcc

SEQ ID NO: 11706 - DNA, 21 bp, Artificial Sequence
  Synthetic
accaagcaaggctactcaacc

SEQ ID NO: 11707 - DNA, 21 bp, Artificial Sequence
  Synthetic
gtgaggcaggggtattcccag

SEQ ID NO: 11708 - DNA, 21 bp, Artificial Sequence
  Synthetic
cacaaagcggggtattcccag

SEQ ID NO: 11709 - DNA, 21 bp, Artificial Sequence
  Synthetic
gtgagggtggggtattcccag

SEQ ID NO: 11710 - DNA, 21 bp, Artificial Sequence
  Synthetic
atgcgcgtaggctactcatca

SEQ ID NO: 11711 - DNA, 21 bp, Artificial Sequence
  Synthetic
gcgaaagtggggtattcccag

SEQ ID NO: 11712 - DNA, 21 bp, Artificial Sequence
  Synthetic
ttgaggcaggggtattccacg

SEQ ID NO: 11713 - DNA, 21 bp, Artificial Sequence
  Synthetic
gtgagggcggggtattcccag

SEQ ID NO: 11714 - DNA, 21 bp, Artificial Sequence
  Synthetic
accaagatcggctactcacaa

SEQ ID NO: 11715 - DNA, 21 bp, Artificial Sequence
  Synthetic
gtgaggcaggggtattccacg

SEQ ID NO: 11716 - DNA, 21 bp, Artificial Sequence
  Synthetic
gtaaagtacggctactcatca

SEQ ID NO: 11717 - DNA, 21 bp, Artificial Sequence
  Synthetic
gtgaggttggggtattcctcc

SEQ ID NO: 11718 - DNA, 21 bp, Artificial Sequence
  Synthetic
gtacgcatgggctactcaacc

SEQ ID NO: 11719 - DNA, 21 bp, Artificial Sequence
  Synthetic
ttgaggcaggggtattcctcc

SEQ ID NO: 11720 - DNA, 21 bp, Artificial Sequence
  Synthetic
ctgaagtttggctactcacaa

SEQ ID NO: 11721 - DNA, 21 bp, Artificial Sequence
  Synthetic
ttgaggatagggtattcctcc

SEQ ID NO: 11722 - DNA, 21 bp, Artificial Sequence
  Synthetic
gcccgcatcggctactcacaa

SEQ ID NO: 11723 - DNA, 21 bp, Artificial Sequence
  Synthetic
ctgaaggccggctactcatca

SEQ ID NO: 11724 - DNA, 21 bp, Artificial Sequence
  Synthetic
atgaagtcaggctactcacaa

SEQ ID NO: 11725 - DNA, 21 bp, Artificial Sequence
  Synthetic
gagaggcacgggtattcccag

SEQ ID NO: 11726 - DNA, 21 bp, Artificial Sequence
  Synthetic
acgaaaatagggtattcctcc

SEQ ID NO: 11727 - DNA, 21 bp, Artificial Sequence
  Synthetic
atgcgcgtaggctactcacaa

SEQ ID NO: 11728 - DNA, 21 bp, Artificial Sequence
  Synthetic
cacaaaatagggtattccacg

SEQ ID NO: 11729 - DNA, 21 bp, Artificial Sequence
  Synthetic
ataaggttggggtattcccag

SEQ ID NO: 11730 - DNA, 21 bp, Artificial Sequence
  Synthetic
cagaggacggggtattcccag

SEQ ID NO: 11731 - DNA, 21 bp, Artificial Sequence
  Synthetic
atgaagatcggctactcacaa

SEQ ID NO: 11732 - DNA, 21 bp, Artificial Sequence
  Synthetic
atcctgaagggctacgccatg

SEQ ID NO: 11733 - DNA, 21 bp, Artificial Sequence
  Synthetic
tggtcatcataccaagcctca

SEQ ID NO: 11734 - DNA, 21 bp, Artificial Sequence
  Synthetic
ttgaggccggggtattcccag

SEQ ID NO: 11735 - DNA, 21 bp, Artificial Sequence
  Synthetic
acgcacaaagggtattcctcc

SEQ ID NO: 11736 - DNA, 21 bp, Artificial Sequence
  Synthetic
accaaggtaggctactcacaa

SEQ ID NO: 11737 - DNA, 21 bp, Artificial Sequence
  Synthetic
ctgaaggtaggctactcatca

SEQ ID NO: 11738 - DNA, 21 bp, Artificial Sequence
  Synthetic
acccgctcaggctactcaacc

SEQ ID NO: 11739 - DNA, 21 bp, Artificial Sequence
  Synthetic
ttgaaagtggggtattcccag

SEQ ID NO: 11740 - DNA, 21 bp, Artificial Sequence
  Synthetic
ctgcgcggcggctactcacaa

SEQ ID NO: 11741 - DNA, 21 bp, Artificial Sequence
  Synthetic
ctgaagctgggctactcaacc

SEQ ID NO: 11742 - DNA, 21 bp, Artificial Sequence
  Synthetic
ttcagggcggggtattcccag

SEQ ID NO: 11743 - DNA, 21 bp, Artificial Sequence
  Synthetic
cacaggccggggtattcccag

SEQ ID NO: 11744 - DNA, 21 bp, Artificial Sequence
  Synthetic
tccaggtccgggtattcccag

SEQ ID NO: 11745 - DNA, 21 bp, Artificial Sequence
  Synthetic
atcaagcaaggctactcacaa

SEQ ID NO: 11746 - DNA, 21 bp, Artificial Sequence
  Synthetic
gtaaagcatggctactcatca

SEQ ID NO: 11747 - DNA, 21 bp, Artificial Sequence
  Synthetic
caaaagcatggctactcacaa

SEQ ID NO: 11748 - DNA, 21 bp, Artificial Sequence
  Synthetic
atcatgcgcggctactcatca

SEQ ID NO: 11749 - DNA, 21 bp, Artificial Sequence
  Synthetic
accaaggccggctactcatca

SEQ ID NO: 11750 - DNA, 21 bp, Artificial Sequence
  Synthetic
atcaagcaaggctactcatca

SEQ ID NO: 11751 - DNA, 21 bp, Artificial Sequence
  Synthetic
cagaggatagggtattccacg

SEQ ID NO: 11752 - DNA, 21 bp, Artificial Sequence
  Synthetic
cataagatcggctactcaacc

SEQ ID NO: 11753 - DNA, 21 bp, Artificial Sequence
  Synthetic
gagaaattcgggtattcctcc

SEQ ID NO: 11754 - DNA, 21 bp, Artificial Sequence
  Synthetic
gtacgcaccggctactcacaa

SEQ ID NO: 11755 - DNA, 21 bp, Artificial Sequence
  Synthetic
ataaaagtggggtattcccag

SEQ ID NO: 11756 - DNA, 21 bp, Artificial Sequence
  Synthetic
gaccgccaaggctactcacaa

SEQ ID NO: 11757 - DNA, 21 bp, Artificial Sequence
  Synthetic
ataaggatggggtattccacg

SEQ ID NO: 11758 - DNA, 21 bp, Artificial Sequence
  Synthetic
acgaggcaggggtattcccag

SEQ ID NO: 11759 - DNA, 21 bp, Artificial Sequence
  Synthetic
ataaaacacgggtattccacg

SEQ ID NO: 11760 - DNA, 21 bp, Artificial Sequence
  Synthetic
aacaaggtaggctacgcccaa

SEQ ID NO: 11761 - DNA, 21 bp, Artificial Sequence
  Synthetic
gtgaggcaggggtattcctcc

SEQ ID NO: 11762 - DNA, 21 bp, Artificial Sequence
  Synthetic
tttaagatcggctactcacaa

SEQ ID NO: 11763 - DNA, 21 bp, Artificial Sequence
  Synthetic
ataaggtccgggtattccacg

SEQ ID NO: 11764 - DNA, 21 bp, Artificial Sequence
  Synthetic
acgaaacaggggtattcccag

SEQ ID NO: 11765 - DNA, 21 bp, Artificial Sequence
  Synthetic
ctgcgcgccggctactcaacc

SEQ ID NO: 11766 - DNA, 21 bp, Artificial Sequence
  Synthetic
gagaaattggggtattcccag

SEQ ID NO: 11767 - DNA, 21 bp, Artificial Sequence
  Synthetic
acgaggtccgggtattcctcc

SEQ ID NO: 11768 - DNA, 21 bp, Artificial Sequence
  Synthetic
gtacgccccggctactcacaa

SEQ ID NO: 11769 - DNA, 21 bp, Artificial Sequence
  Synthetic
gggaaatatgggtattcccag

SEQ ID NO: 11770 - DNA, 21 bp, Artificial Sequence
  Synthetic
gtgaaagcggggtattcccag

SEQ ID NO: 11771 - DNA, 21 bp, Artificial Sequence
  Synthetic
tcacgctcaggctactcaacc

SEQ ID NO: 11772 - DNA, 21 bp, Artificial Sequence
  Synthetic
acgaggcaggggtattccacg

SEQ ID NO: 11773 - DNA, 21 bp, Artificial Sequence
  Synthetic
cacaggatggggtattcctcc

SEQ ID NO: 11774 - DNA, 21 bp, Artificial Sequence
  Synthetic
tataggtccgggtattcccag

SEQ ID NO: 11775 - DNA, 21 bp, Artificial Sequence
  Synthetic
ctgcgcgtaggctactcacaa

SEQ ID NO: 11776 - DNA, 21 bp, Artificial Sequence
  Synthetic
aacaagcatggctactcatca

SEQ ID NO: 11777 - DNA, 21 bp, Artificial Sequence
  Synthetic
tcaaagcccggctactcacaa

SEQ ID NO: 11778 - DNA, 21 bp, Artificial Sequence
  Synthetic
cacaaagtggggtattcccag

SEQ ID NO: 11779 - DNA, 21 bp, Artificial Sequence
  Synthetic
ttcaggatagggtattcccag

SEQ ID NO: 11780 - DNA, 21 bp, Artificial Sequence
  Synthetic
gaacgcatcggctactcacaa

SEQ ID NO: 11781 - DNA, 21 bp, Artificial Sequence
  Synthetic
acgaggcaggggtattcctcc

SEQ ID NO: 11782 - DNA, 21 bp, Artificial Sequence
  Synthetic
atccgcgccggctactcacaa

SEQ ID NO: 11783 - DNA, 21 bp, Artificial Sequence
  Synthetic
atgaggacggggtattcccag

SEQ ID NO: 11784 - DNA, 21 bp, Artificial Sequence
  Synthetic
ccgagggtggggtattcccag

SEQ ID NO: 11785 - DNA, 21 bp, Artificial Sequence
  Synthetic
caacgcgccggctactcatca

SEQ ID NO: 11786 - DNA, 21 bp, Artificial Sequence
  Synthetic
accaagctgggctactcatca

SEQ ID NO: 11787 - DNA, 21 bp, Artificial Sequence
  Synthetic
ttcaaaatagggtattcccag

SEQ ID NO: 11788 - DNA, 21 bp, Artificial Sequence
  Synthetic
ctgaaggccggctactcacaa

SEQ ID NO: 11789 - DNA, 21 bp, Artificial Sequence
  Synthetic
atattgaaagggtatgcgatg

SEQ ID NO: 11790 - DNA, 21 bp, Artificial Sequence
  Synthetic
gtgaggacggggtattcccag

SEQ ID NO: 11791 - DNA, 21 bp, Artificial Sequence
  Synthetic
acgaaacacgggtattcccag

SEQ ID NO: 11792 - DNA, 21 bp, Artificial Sequence
  Synthetic
atcaagatgggctactcatca

SEQ ID NO: 11793 - DNA, 21 bp, Artificial Sequence
  Synthetic
atcaaggtaggctactcacaa

SEQ ID NO: 11794 - DNA, 21 bp, Artificial Sequence
  Synthetic
gaacgccaaggctactcacaa

SEQ ID NO: 11795 - DNA, 21 bp, Artificial Sequence
  Synthetic
ataaggggggggtattcctcc

SEQ ID NO: 11796 - DNA, 21 bp, Artificial Sequence
  Synthetic
acgaaaatggggtattcccag

SEQ ID NO: 11797 - DNA, 21 bp, Artificial Sequence
  Synthetic
caaaagatcggctactcacaa

SEQ ID NO: 11798 - DNA, 21 bp, Artificial Sequence
  Synthetic
cacaaaatagggtattcccag

SEQ ID NO: 11799 - DNA, 21 bp, Artificial Sequence
  Synthetic
tcacgcgccggctactcatca

SEQ ID NO: 11800 - DNA, 21 bp, Artificial Sequence
  Synthetic
tttcgccatggctactcacaa

SEQ ID NO: 11801 - DNA, 21 bp, Artificial Sequence
  Synthetic
ctgaagctgggctactcacaa

SEQ ID NO: 11802 - DNA, 21 bp, Artificial Sequence
  Synthetic
acgaaacacgggtattcctcc

SEQ ID NO: 11803 - DNA, 21 bp, Artificial Sequence
  Synthetic
gtaaagtcaggctactcacaa

SEQ ID NO: 11804 - DNA, 21 bp, Artificial Sequence
  Synthetic
ttgaaaatggggtattcccag

SEQ ID NO: 11805 - DNA, 21 bp, Artificial Sequence
  Synthetic
acgaggtccgggtattccacg

SEQ ID NO: 11806 - DNA, 21 bp, Artificial Sequence
  Synthetic
acgaaaacggggtattccacg

SEQ ID NO: 11807 - DNA, 21 bp, Artificial Sequence
  Synthetic
acgagggcggggtattccacg

SEQ ID NO: 11808 - DNA, 21 bp, Artificial Sequence
  Synthetic
gtaaagatgggctactcacaa

SEQ ID NO: 11809 - DNA, 21 bp, Artificial Sequence
  Synthetic
ctgaagtcaggctactcacaa

SEQ ID NO: 11810 - DNA, 21 bp, Artificial Sequence
  Synthetic
gacaagaccggctactcacaa

SEQ ID NO: 11811 - DNA, 21 bp, Artificial Sequence
  Synthetic
ttgaaacacgggtattcctcc

SEQ ID NO: 11812 - DNA, 21 bp, Artificial Sequence
  Synthetic
gaccgcatcggctactcacaa

SEQ ID NO: 11813 - DNA, 21 bp, Artificial Sequence
  Synthetic
ataaaatccgggtattcctcc

SEQ ID NO: 11814 - DNA, 21 bp, Artificial Sequence
  Synthetic
cagaaacacgggtattcccag

SEQ ID NO: 11815 - DNA, 21 bp, Artificial Sequence
  Synthetic
tttaagaccggctactcacaa

SEQ ID NO: 11816 - DNA, 21 bp, Artificial Sequence
  Synthetic
aatagggcggggtattccacg

SEQ ID NO: 11817 - DNA, 21 bp, Artificial Sequence
  Synthetic
ttgaaagcggggtattcccag

SEQ ID NO: 11818 - DNA, 21 bp, Artificial Sequence
  Synthetic
gaacgcatgggctactcaacc

SEQ ID NO: 11819 - DNA, 21 bp, Artificial Sequence
  Synthetic
atgaaaacggggtattccacg

SEQ ID NO: 11820 - DNA, 21 bp, Artificial Sequence
  Synthetic
ttcaggacggggtattcccag

SEQ ID NO: 11821 - DNA, 21 bp, Artificial Sequence
  Synthetic
gtgaggttggggtattcccag

SEQ ID NO: 11822 - DNA, 21 bp, Artificial Sequence
  Synthetic
atgcgccccggctactcacaa

SEQ ID NO: 11823 - DNA, 21 bp, Artificial Sequence
  Synthetic
ttgagggcggggtattcctcc

SEQ ID NO: 11824 - DNA, 21 bp, Artificial Sequence
  Synthetic
atgaaggccggctactcatca

SEQ ID NO: 11825 - DNA, 21 bp, Artificial Sequence
  Synthetic
gggaggttggggtattcccag

SEQ ID NO: 11826 - DNA, 21 bp, Artificial Sequence
  Synthetic
acgaaaatagggtattcccag

SEQ ID NO: 11827 - DNA, 21 bp, Artificial Sequence
  Synthetic
ctgcgccaaggctactcatca

SEQ ID NO: 11828 - DNA, 21 bp, Artificial Sequence
  Synthetic
gtgaggatagggtattccacg

SEQ ID NO: 11829 - DNA, 21 bp, Artificial Sequence
  Synthetic
accaagatcggctactcatca

SEQ ID NO: 11830 - DNA, 21 bp, Artificial Sequence
  Synthetic
atgaaaatagggtattccacg

SEQ ID NO: 11831 - DNA, 21 bp, Artificial Sequence
  Synthetic
ttgaggatagggtattcccag

SEQ ID NO: 11832 - DNA, 21 bp, Artificial Sequence
  Synthetic
atccgcaccggctactcatca

SEQ ID NO: 11833 - DNA, 21 bp, Artificial Sequence
  Synthetic
ttgaggacggggtattcccag

SEQ ID NO: 11834 - DNA, 21 bp, Artificial Sequence
  Synthetic
acgagggtggggtattccacg

SEQ ID NO: 11835 - DNA, 21 bp, Artificial Sequence
  Synthetic
aaccgcatcggctactcacaa

SEQ ID NO: 11836 - DNA, 21 bp, Artificial Sequence
  Synthetic
acgaaaatagggtattccacg

SEQ ID NO: 11837 - DNA, 21 bp, Artificial Sequence
  Synthetic
atgagggcggggtattcctcc

SEQ ID NO: 11838 - DNA, 21 bp, Artificial Sequence
  Synthetic
atgaaatatgggtattccacg

SEQ ID NO: 11839 - DNA, 21 bp, Artificial Sequence
  Synthetic
gatagggtggggtattcccag

SEQ ID NO: 11840 - DNA, 21 bp, Artificial Sequence
  Synthetic
caaaagcccggctactcacaa

SEQ ID NO: 11841 - DNA, 21 bp, Artificial Sequence
  Synthetic
atgaggtccgggtattcccag

SEQ ID NO: 11842 - DNA, 21 bp, Artificial Sequence
  Synthetic
gtacgcggcggctactcacaa

SEQ ID NO: 11843 - DNA, 21 bp, Artificial Sequence
  Synthetic
ttcaaaacggggtattcccag

SEQ ID NO: 11844 - DNA, 21 bp, Artificial Sequence
  Synthetic
gtgaggatagggtattcctcc

SEQ ID NO: 11845 - DNA, 21 bp, Artificial Sequence
  Synthetic
atccgcgccggctactcaacc

SEQ ID NO: 11846 - DNA, 21 bp, Artificial Sequence
  Synthetic
aataaattcgggtattcccag

SEQ ID NO: 11847 - DNA, 21 bp, Artificial Sequence
  Synthetic
cagaggcaggggtattcccag

SEQ ID NO: 11848 - DNA, 21 bp, Artificial Sequence
  Synthetic
ctgaagcaaggctactcacaa

SEQ ID NO: 11849 - DNA, 21 bp, Artificial Sequence
  Synthetic
acgaaaacggggtattcctcc

SEQ ID NO: 11850 - DNA, 21 bp, Artificial Sequence
  Synthetic
gtgaggggggggtattcccag

SEQ ID NO: 11851 - DNA, 21 bp, Artificial Sequence
  Synthetic
ataaggtccgggtattcccag

SEQ ID NO: 11852 - DNA, 21 bp, Artificial Sequence
  Synthetic
caaaaggtaggctactcacaa

SEQ ID NO: 11853 - DNA, 21 bp, Artificial Sequence
  Synthetic
ttgagggaggggtattcccag

SEQ ID NO: 11854 - DNA, 21 bp, Artificial Sequence
  Synthetic
acgaaaccggggtattcccag

SEQ ID NO: 11855 - DNA, 21 bp, Artificial Sequence
  Synthetic
ttgaggcacgggtattccacg

SEQ ID NO: 11856 - DNA, 21 bp, Artificial Sequence
  Synthetic
ccccgcatgggctactcatca

SEQ ID NO: 11857 - DNA, 21 bp, Artificial Sequence
  Synthetic
acgaaacacgggtattccacg

SEQ ID NO: 11858 - DNA, 21 bp, Artificial Sequence
  Synthetic
ttgaggttggggtattccacg

SEQ ID NO: 11859 - DNA, 21 bp, Artificial Sequence
  Synthetic
atccgccaaggctactcatca

SEQ ID NO: 11860 - DNA, 21 bp, Artificial Sequence
  Synthetic
ttgaaacaggggtattcctcc

SEQ ID NO: 11861 - DNA, 21 bp, Artificial Sequence
  Synthetic
tcaaagatcggctactcaacc

SEQ ID NO: 11862 - DNA, 21 bp, Artificial Sequence
  Synthetic
atgaaagcggggtattcctcc

SEQ ID NO: 11863 - DNA, 21 bp, Artificial Sequence
  Synthetic
acgaaatccgggtattccacg

SEQ ID NO: 11864 - DNA, 21 bp, Artificial Sequence
  Synthetic
gaaaagcatggctactcacaa

SEQ ID NO: 11865 - DNA, 21 bp, Artificial Sequence
  Synthetic
ttgaaaacggggtattcccag

SEQ ID NO: 11866 - DNA, 21 bp, Artificial Sequence
  Synthetic
ctgaaggtaggctactcacaa

SEQ ID NO: 11867 - DNA, 21 bp, Artificial Sequence
  Synthetic
tccagggcggggtattcctcc

SEQ ID NO: 11868 - DNA, 21 bp, Artificial Sequence
  Synthetic
gagaaagtggggtattcccag

SEQ ID NO: 11869 - DNA, 21 bp, Artificial Sequence
  Synthetic
tgggggacgccgccgaggggg

SEQ ID NO: 11870 - DNA, 21 bp, Artificial Sequence
  Synthetic
acgaaatatgggtattccacg

SEQ ID NO: 11871 - DNA, 21 bp, Artificial Sequence
  Synthetic
atcaagcatggctactcaacc

SEQ ID NO: 11872 - DNA, 21 bp, Artificial Sequence
  Synthetic
ttgaaagcggggtattcctcc

SEQ ID NO: 11873 - DNA, 21 bp, Artificial Sequence
  Synthetic
acgaaaacggggtattcccag

SEQ ID NO: 11874 - DNA, 21 bp, Artificial Sequence
  Synthetic
tggaaagcggggtattcccag

SEQ ID NO: 11875 - DNA, 21 bp, Artificial Sequence
  Synthetic
gtgaaagcggggtattcctcc

SEQ ID NO: 11876 - DNA, 21 bp, Artificial Sequence
  Synthetic
acgaggatggggtattcctcc

SEQ ID NO: 11877 - DNA, 21 bp, Artificial Sequence
  Synthetic
tatagggtggggtattccacg

SEQ ID NO: 11878 - DNA, 21 bp, Artificial Sequence
  Synthetic
gggaaaatagggtattcccag

SEQ ID NO: 11879 - DNA, 21 bp, Artificial Sequence
  Synthetic
atgaaagcggggtattcccag

SEQ ID NO: 11880 - DNA, 21 bp, Artificial Sequence
  Synthetic
gtgaaacaggggtattcccag

SEQ ID NO: 11881 - DNA, 21 bp, Artificial Sequence
  Synthetic
gaaaagtacggctactcacaa

SEQ ID NO: 11882 - DNA, 21 bp, Artificial Sequence
  Synthetic
ttgaaaggggggtattcccag

SEQ ID NO: 11883 - DNA, 21 bp, Artificial Sequence
  Synthetic
cataagaccggctactcacaa

SEQ ID NO: 11884 - DNA, 21 bp, Artificial Sequence
  Synthetic
acgaggatggggtattccacg

SEQ ID NO: 11885 - DNA, 21 bp, Artificial Sequence
  Synthetic
gtgagggcggggtattcctcc

SEQ ID NO: 11886 - DNA, 21 bp, Artificial Sequence
  Synthetic
gtacgcgccggctactcacaa

SEQ ID NO: 11887 - DNA, 21 bp, Artificial Sequence
  Synthetic
ttgaaacaggggtattcccag

SEQ ID NO: 11888 - DNA, 21 bp, Artificial Sequence
  Synthetic
acgagggcggggtattcccag

SEQ ID NO: 11889 - DNA, 21 bp, Artificial Sequence
  Synthetic
gtgaaaaatgggtattcccag

SEQ ID NO: 11890 - DNA, 21 bp, Artificial Sequence
  Synthetic
gtgaatagggggtattcctcc

SEQ ID NO: 11891 - DNA, 21 bp, Artificial Sequence
  Synthetic
ataaaacaggggtattcccag

SEQ ID NO: 11892 - DNA, 21 bp, Artificial Sequence
  Synthetic
ttgaggatggggtattccacg

SEQ ID NO: 11893 - DNA, 21 bp, Artificial Sequence
  Synthetic
tccaggccggggtattcctcc

SEQ ID NO: 11894 - DNA, 21 bp, Artificial Sequence
  Synthetic
gtgaaacacgggtattcccag

SEQ ID NO: 11895 - DNA, 21 bp, Artificial Sequence
  Synthetic
gtgaggtccgggtattcccag

SEQ ID NO: 11896 - DNA, 21 bp, Artificial Sequence
  Synthetic
gtaaagatcggctactcacaa

SEQ ID NO: 11897 - DNA, 21 bp, Artificial Sequence
  Synthetic
acccgccaaggctactcatca

SEQ ID NO: 11898 - DNA, 21 bp, Artificial Sequence
  Synthetic
atcaagcatggctactcatca

SEQ ID NO: 11899 - DNA, 21 bp, Artificial Sequence
  Synthetic
tggaagtcaggctactcacaa

SEQ ID NO: 11900 - DNA, 21 bp, Artificial Sequence
  Synthetic
acgaaagcggggtattccacg

SEQ ID NO: 11901 - DNA, 21 bp, Artificial Sequence
  Synthetic
atgcgctcaggctactcacaa

SEQ ID NO: 11902 - DNA, 21 bp, Artificial Sequence
  Synthetic
acgaaaatggggtattccacg

SEQ ID NO: 11903 - DNA, 21 bp, Artificial Sequence
  Synthetic
atcaagtttggctactcacaa

SEQ ID NO: 11904 - DNA, 21 bp, Artificial Sequence
  Synthetic
acgaggaatgggtattcccag

SEQ ID NO: 11905 - DNA, 21 bp, Artificial Sequence
  Synthetic
gtgaaaccggggtattcccag

SEQ ID NO: 11906 - DNA, 21 bp, Artificial Sequence
  Synthetic
ctgaagtacggctactcatca

SEQ ID NO: 11907 - DNA, 21 bp, Artificial Sequence
  Synthetic
atccgccccggctactcacaa

SEQ ID NO: 11908 - DNA, 21 bp, Artificial Sequence
  Synthetic
acgaaagcggggtattcctcc

SEQ ID NO: 11909 - DNA, 21 bp, Artificial Sequence
  Synthetic
ataaaagcggggtattcctcc

SEQ ID NO: 11910 - DNA, 21 bp, Artificial Sequence
  Synthetic
acgagggtggggtattcctcc

SEQ ID NO: 11911 - DNA, 21 bp, Artificial Sequence
  Synthetic
acgaggatagggtattccacg

SEQ ID NO: 11912 - DNA, 21 bp, Artificial Sequence
  Synthetic
gtgaaaatggggtattcctcc

SEQ ID NO: 11913 - DNA, 21 bp, Artificial Sequence
  Synthetic
acccgcaccggctactcacaa

SEQ ID NO: 11914 - DNA, 21 bp, Artificial Sequence
  Synthetic
atgagggcggggtattcccag

SEQ ID NO: 11915 - DNA, 21 bp, Artificial Sequence
  Synthetic
acgaggatagggtattcctcc

SEQ ID NO: 11916 - DNA, 21 bp, Artificial Sequence
  Synthetic
tggcgctcaggctactcacaa

SEQ ID NO: 11917 - DNA, 21 bp, Artificial Sequence
  Synthetic
accaagcatggctactcacaa

SEQ ID NO: 11918 - DNA, 21 bp, Artificial Sequence
  Synthetic
ataaaagcggggtattcccag

SEQ ID NO: 11919 - DNA, 21 bp, Artificial Sequence
  Synthetic
acccgccccggctactcacaa

SEQ ID NO: 11920 - DNA, 21 bp, Artificial Sequence
  Synthetic
gtacgcgccggctactcaacc

SEQ ID NO: 11921 - DNA, 21 bp, Artificial Sequence
  Synthetic
ataaaatccgggtattcccag

SEQ ID NO: 11922 - DNA, 21 bp, Artificial Sequence
  Synthetic
gagttgaaaaattatcacacg

SEQ ID NO: 11923 - DNA, 21 bp, Artificial Sequence
  Synthetic
ataatgagggggtattcctcc

SEQ ID NO: 11924 - DNA, 21 bp, Artificial Sequence
  Synthetic
agggggacggggttgtcccag

SEQ ID NO: 11925 - DNA, 21 bp, Artificial Sequence
  Synthetic
aatagggtggggtattccacg

SEQ ID NO: 11926 - DNA, 21 bp, Artificial Sequence
  Synthetic
tccaggatagggtattcccag

SEQ ID NO: 11927 - DNA, 21 bp, Artificial Sequence
  Synthetic
ctgcgccaaggctactcacaa

SEQ ID NO: 11928 - DNA, 21 bp, Artificial Sequence
  Synthetic
ataaggcacgggtattccacg

SEQ ID NO: 11929 - DNA, 21 bp, Artificial Sequence
  Synthetic
gtacgccaaggctactcatca

SEQ ID NO: 11930 - DNA, 21 bp, Artificial Sequence
  Synthetic
atgaagaccggctactcacaa

SEQ ID NO: 11931 - DNA, 21 bp, Artificial Sequence
  Synthetic
gggaggttggggtattccacg

SEQ ID NO: 11932 - DNA, 21 bp, Artificial Sequence
  Synthetic
gagaggatagggtattcccag

SEQ ID NO: 11933 - DNA, 21 bp, Artificial Sequence
  Synthetic
ctgcgctcaggctactcacaa

SEQ ID NO: 11934 - DNA, 21 bp, Artificial Sequence
  Synthetic
cagaaaatggggtattcctcc

SEQ ID NO: 11935 - DNA, 21 bp, Artificial Sequence
  Synthetic
accaagtcaggctactcaacc

SEQ ID NO: 11936 - DNA, 21 bp, Artificial Sequence
  Synthetic
ccccgcgtaggctactcatca

SEQ ID NO: 11937 - DNA, 21 bp, Artificial Sequence
  Synthetic
gagaaatatgggtattccacg

SEQ ID NO: 11938 - DNA, 21 bp, Artificial Sequence
  Synthetic
tttcgcgccggctactcacaa

SEQ ID NO: 11939 - DNA, 21 bp, Artificial Sequence
  Synthetic
gaacgcatgggctactcacaa

SEQ ID NO: 11940 - DNA, 21 bp, Artificial Sequence
  Synthetic
gataggatagggtattcccag

SEQ ID NO: 11941 - DNA, 21 bp, Artificial Sequence
  Synthetic
ttgaggcacgggtattcctcc

SEQ ID NO: 11942 - DNA, 21 bp, Artificial Sequence
  Synthetic
atgagggtggggtattcctcc

SEQ ID NO: 11943 - DNA, 21 bp, Artificial Sequence
  Synthetic
gataggatggggtattcctcc

SEQ ID NO: 11944 - DNA, 21 bp, Artificial Sequence
  Synthetic
ctgcgcgccggctactcatca

SEQ ID NO: 11945 - DNA, 21 bp, Artificial Sequence
  Synthetic
atccgcaccggctactcacaa

SEQ ID NO: 11946 - DNA, 21 bp, Artificial Sequence
  Synthetic
aataaaccggggtattcccag

SEQ ID NO: 11947 - DNA, 21 bp, Artificial Sequence
  Synthetic
acgcagaaagggtattcctcc

SEQ ID NO: 11948 - DNA, 21 bp, Artificial Sequence
  Synthetic
aaccgcgtaggctactcacaa

SEQ ID NO: 11949 - DNA, 21 bp, Artificial Sequence
  Synthetic
acccgcgtaggctactcacaa

SEQ ID NO: 11950 - DNA, 21 bp, Artificial Sequence
  Synthetic
acgaggacggggtattcctcc

SEQ ID NO: 11951 - DNA, 21 bp, Artificial Sequence
  Synthetic
aggtatgtgggggagtcctcc

SEQ ID NO: 11952 - DNA, 21 bp, Artificial Sequence
  Synthetic
tcacgctcaggctactcacaa

SEQ ID NO: 11953 - DNA, 21 bp, Artificial Sequence
  Synthetic
aggtatccggggatgtcctcc

SEQ ID NO: 11954 - DNA, 21 bp, Artificial Sequence
  Synthetic
acccgcgtaggctactcatca

SEQ ID NO: 11955 - DNA, 21 bp, Artificial Sequence
  Synthetic
tcacgctcaggctactcatca

SEQ ID NO: 11956 - DNA, 21 bp, Artificial Sequence
  Synthetic
aaccgcgtaggctactcatca

SEQ ID NO: 11957 - DNA, 21 bp, Artificial Sequence
  Synthetic
ggccgcatcggctactcacaa

SEQ ID NO: 11958 - DNA, 21 bp, Artificial Sequence
  Synthetic
atcaagaccggctactcatca

SEQ ID NO: 11959 - DNA, 21 bp, Artificial Sequence
  Synthetic
atgcgcaccggctactcatca

SEQ ID NO: 11960 - DNA, 21 bp, Artificial Sequence
  Synthetic
ctgaagcatggctactcacaa

SEQ ID NO: 11961 - DNA, 21 bp, Artificial Sequence
  Synthetic
gtaaagaccggctactcacaa

SEQ ID NO: 11962 - DNA, 21 bp, Artificial Sequence
  Synthetic
accaagcatggctactcatca

SEQ ID NO: 11963 - DNA, 21 bp, Artificial Sequence
  Synthetic
ttgaaaccggggtattcccag

SEQ ID NO: 11964 - DNA, 21 bp, Artificial Sequence
  Synthetic
ataaaaacggggtattcccag

SEQ ID NO: 11965 - DNA, 21 bp, Artificial Sequence
  Synthetic
ttgagggcggggtattcccag

SEQ ID NO: 11966 - DNA, 21 bp, Artificial Sequence
  Synthetic
aacaaggtaggctactcacaa

SEQ ID NO: 11967 - DNA, 21 bp, Artificial Sequence
  Synthetic
ataagggcggggtattcctcc

SEQ ID NO: 11968 - DNA, 21 bp, Artificial Sequence
  Synthetic
acgaaagtggggtattcccag

SEQ ID NO: 11969 - DNA, 21 bp, Artificial Sequence
  Synthetic
aataggacggggtattccacg

SEQ ID NO: 11970 - DNA, 21 bp, Artificial Sequence
  Synthetic
gaacgcaccggctactcacaa

SEQ ID NO: 11971 - DNA, 21 bp, Artificial Sequence
  Synthetic
ttgaggaatgggtattcccag

SEQ ID NO: 11972 - DNA, 21 bp, Artificial Sequence
  Synthetic
ataaggcaggggtattcctcc

SEQ ID NO: 11973 - DNA, 21 bp, Artificial Sequence
  Synthetic
gtgaaacacgggtattcctcc

SEQ ID NO: 11974 - DNA, 21 bp, Artificial Sequence
  Synthetic
gtaaagcatggctactcaacc

SEQ ID NO: 11975 - DNA, 21 bp, Artificial Sequence
  Synthetic
ttggcgagggggtattccacg

SEQ ID NO: 11976 - DNA, 21 bp, Artificial Sequence
  Synthetic
gtgaaattcgggtattccacg

SEQ ID NO: 11977 - DNA, 21 bp, Artificial Sequence
  Synthetic
ataaggcaggggtattcccag

SEQ ID NO: 11978 - DNA, 21 bp, Artificial Sequence
  Synthetic
atccgcctgggctactcatca

SEQ ID NO: 11979 - DNA, 21 bp, Artificial Sequence
  Synthetic
ttgaggatggggtattcccag

SEQ ID NO: 11980 - DNA, 21 bp, Artificial Sequence
  Synthetic
ctgaagggcggctactcacaa

SEQ ID NO: 11981 - DNA, 21 bp, Artificial Sequence
  Synthetic
gataggttggggtattccacg

SEQ ID NO: 11982 - DNA, 21 bp, Artificial Sequence
  Synthetic
ccgaaagtggggtattcccag

SEQ ID NO: 11983 - DNA, 21 bp, Artificial Sequence
  Synthetic
gtaaagcaaggctactcacaa

SEQ ID NO: 11984 - DNA, 21 bp, Artificial Sequence
  Synthetic
accaaggtaggctactcaacc

SEQ ID NO: 11985 - DNA, 21 bp, Artificial Sequence
  Synthetic
atccgctcaggctactcatca

SEQ ID NO: 11986 - DNA, 21 bp, Artificial Sequence
  Synthetic
accaagatgggctactcaacc

SEQ ID NO: 11987 - DNA, 21 bp, Artificial Sequence
  Synthetic
tcaaagtacggctactcacaa

SEQ ID NO: 11988 - DNA, 21 bp, Artificial Sequence
  Synthetic
gagaaacacgggtattcccag

SEQ ID NO: 11989 - DNA, 21 bp, Artificial Sequence
  Synthetic
gcgaggacggggtattcccag

SEQ ID NO: 11990 - DNA, 21 bp, Artificial Sequence
  Synthetic
tttaagcccggctactcacaa

SEQ ID NO: 11991 - DNA, 21 bp, Artificial Sequence
  Synthetic
caaaagcaaggctactcacaa

SEQ ID NO: 11992 - DNA, 21 bp, Artificial Sequence
  Synthetic
cagaaacaggggtattcccag

SEQ ID NO: 11993 - DNA, 21 bp, Artificial Sequence
  Synthetic
ctgcgcaccggctactcatca

SEQ ID NO: 11994 - DNA, 21 bp, Artificial Sequence
  Synthetic
accaagcaaggctactcatca

SEQ ID NO: 11995 - DNA, 21 bp, Artificial Sequence
  Synthetic
accaagtcaggctactcatca

SEQ ID NO: 11996 - DNA, 21 bp, Artificial Sequence
  Synthetic
atcgcctcaggctactcacaa

SEQ ID NO: 11997 - DNA, 21 bp, Artificial Sequence
  Synthetic
cagaaaatagggtattccacg

SEQ ID NO: 11998 - DNA, 21 bp, Artificial Sequence
  Synthetic
gaacgccatggctactcacaa

SEQ ID NO: 11999 - DNA, 21 bp, Artificial Sequence
  Synthetic
cagaaaatggggtattcccag

SEQ ID NO: 12000 - DNA, 21 bp, Artificial Sequence
  Synthetic
acccataagggctactcatca

SEQ ID NO: 12001 - DNA, 21 bp, Artificial Sequence
  Synthetic
ttcaaaatggggtattcccag

SEQ ID NO: 12002 - DNA, 21 bp, Artificial Sequence
  Synthetic
gaacgcgccggctactcacaa

SEQ ID NO: 12003 - DNA, 21 bp, Artificial Sequence
  Synthetic
gtaaagtcaggctactcatca

SEQ ID NO: 12004 - DNA, 21 bp, Artificial Sequence
  Synthetic
tccaaaccggggtattcccag

SEQ ID NO: 12005 - DNA, 21 bp, Artificial Sequence
  Synthetic
acgaaagcggggtattcccag

SEQ ID NO: 12006 - DNA, 21 bp, Artificial Sequence
  Synthetic
ctgcgcaacggctactcacaa

SEQ ID NO: 12007 - DNA, 21 bp, Artificial Sequence
  Synthetic
gtaaagaccggctactcatca

SEQ ID NO: 12008 - DNA, 21 bp, Artificial Sequence
  Synthetic
acctcaaagggctactcatca

SEQ ID NO: 12009 - DNA, 21 bp, Artificial Sequence
  Synthetic
acgaaacaggggtattcctcc

SEQ ID NO: 12010 - DNA, 21 bp, Artificial Sequence
  Synthetic
atcaaggccggctactcatca

SEQ ID NO: 12011 - DNA, 21 bp, Artificial Sequence
  Synthetic
gtacgcgccggctactcatca

SEQ ID NO: 12012 - DNA, 21 bp, Artificial Sequence
  Synthetic
tacaagatcggctactcaacc

SEQ ID NO: 12013 - DNA, 21 bp, Artificial Sequence
  Synthetic
cataagcccggctactcacaa

SEQ ID NO: 12014 - DNA, 21 bp, Artificial Sequence
  Synthetic
ttgaggacggggtattcctcc

SEQ ID NO: 12015 - DNA, 21 bp, Artificial Sequence
  Synthetic
caacgcatgggctactcatca

SEQ ID NO: 12016 - DNA, 21 bp, Artificial Sequence
  Synthetic
gtaaagggcggctactcacaa

SEQ ID NO: 12017 - DNA, 21 bp, Artificial Sequence
  Synthetic
ttcaggtccaatgggtccata

SEQ ID NO: 12018 - DNA, 21 bp, Artificial Sequence
  Synthetic
tttcgcaccggctactcacaa

SEQ ID NO: 12019 - DNA, 21 bp, Artificial Sequence
  Synthetic
atgaggtccgggtattcctcc

SEQ ID NO: 12020 - DNA, 21 bp, Artificial Sequence
  Synthetic
gtaaagcaaggctactcatca

SEQ ID NO: 12021 - DNA, 21 bp, Artificial Sequence
  Synthetic
gccaagtacggctactcaacc

SEQ ID NO: 12022 - DNA, 21 bp, Artificial Sequence
  Synthetic
caacgcatcggctactcacaa

SEQ ID NO: 12023 - DNA, 21 bp, Artificial Sequence
  Synthetic
atgcgcgccggctactcacaa

SEQ ID NO: 12024 - DNA, 21 bp, Artificial Sequence
  Synthetic
ctgaagaccggctactcatca

SEQ ID NO: 12025 - DNA, 21 bp, Artificial Sequence
  Synthetic
atgaagtacggctactcatca

SEQ ID NO: 12026 - DNA, 21 bp, Artificial Sequence
  Synthetic
ttcaggtccgggtattccacg

SEQ ID NO: 12027 - DNA, 21 bp, Artificial Sequence
  Synthetic
gtacgcctgggctactcaacc

SEQ ID NO: 12028 - DNA, 21 bp, Artificial Sequence
  Synthetic
accaaggtaggctactcatca

SEQ ID NO: 12029 - DNA, 21 bp, Artificial Sequence
  Synthetic
ttgaaacacgggtattccacg

SEQ ID NO: 12030 - DNA, 21 bp, Artificial Sequence
  Synthetic
aacaagatcggctactcatca

SEQ ID NO: 12031 - DNA, 21 bp, Artificial Sequence
  Synthetic
gagaaaacggggtattcccag

SEQ ID NO: 12032 - DNA, 21 bp, Artificial Sequence
  Synthetic
acgaaaatggggtattcctcc

SEQ ID NO: 12033 - DNA, 21 bp, Artificial Sequence
  Synthetic
accaagaccggctactcatca

SEQ ID NO: 12034 - DNA, 21 bp, Artificial Sequence
  Synthetic
acgaggaatgggtattccacg

SEQ ID NO: 12035 - DNA, 21 bp, Artificial Sequence
  Synthetic
atgaagcatggctactcatca

SEQ ID NO: 12036 - DNA, 21 bp, Artificial Sequence
  Synthetic
accatgaagggctttgcccaa

SEQ ID NO: 12037 - DNA, 21 bp, Artificial Sequence
  Synthetic
ataagggtggggtattcctcc

SEQ ID NO: 12038 - DNA, 21 bp, Artificial Sequence
  Synthetic
atgaagtcaggctactcatca

SEQ ID NO: 12039 - DNA, 21 bp, Artificial Sequence
  Synthetic
accaagtacggctactcacaa

SEQ ID NO: 12040 - DNA, 21 bp, Artificial Sequence
  Synthetic
acgcagagggggtattcctcc

SEQ ID NO: 12041 - DNA, 21 bp, Artificial Sequence
  Synthetic
acccgcatcggctactcacaa

SEQ ID NO: 12042 - DNA, 21 bp, Artificial Sequence
  Synthetic
gtacgctcaggctactcacaa

SEQ ID NO: 12043 - DNA, 21 bp, Artificial Sequence
  Synthetic
ataagggaggggtattcccag

SEQ ID NO: 12044 - DNA, 21 bp, Artificial Sequence
  Synthetic
ataaggatggggtattcctcc

SEQ ID NO: 12045 - DNA, 21 bp, Artificial Sequence
  Synthetic
gagaaacaggggtattcccag

SEQ ID NO: 12046 - DNA, 21 bp, Artificial Sequence
  Synthetic
gacaagcccggctactcacaa

SEQ ID NO: 12047 - DNA, 21 bp, Artificial Sequence
  Synthetic
gataggcacgggtattccacg

SEQ ID NO: 12048 - DNA, 21 bp, Artificial Sequence
  Synthetic
gtaaagctgggctactcatca

SEQ ID NO: 12049 - DNA, 21 bp, Artificial Sequence
  Synthetic
gtaaagcccggctactcacaa

SEQ ID NO: 12050 - DNA, 21 bp, Artificial Sequence
  Synthetic
tccaggccggggtattcccag

SEQ ID NO: 12051 - DNA, 21 bp, Artificial Sequence
  Synthetic
gagatattgatgaaaaggaat

SEQ ID NO: 12052 - DNA, 21 bp, Artificial Sequence
  Synthetic
ttgaggcaggggtattcccag

SEQ ID NO: 12053 - DNA, 21 bp, Artificial Sequence
  Synthetic
atccgccaaggctactcacaa

SEQ ID NO: 12054 - DNA, 21 bp, Artificial Sequence
  Synthetic
atcaactactcacaaaccctg

SEQ ID NO: 12055 - DNA, 21 bp, Artificial Sequence
  Synthetic
ttgaaaccggggtattcctcc

SEQ ID NO: 12056 - DNA, 21 bp, Artificial Sequence
  Synthetic
ataaaacaggggtattcctcc

SEQ ID NO: 12057 - DNA, 21 bp, Artificial Sequence
  Synthetic
tataggttggggtattcccag

SEQ ID NO: 12058 - DNA, 21 bp, Artificial Sequence
  Synthetic
gagaggatggggtattcctcc

SEQ ID NO: 12059 - DNA, 21 bp, Artificial Sequence
  Synthetic
acgaggttggggtattccacg

SEQ ID NO: 12060 - DNA, 21 bp, Artificial Sequence
  Synthetic
atgaaacaggggtattcctcc

SEQ ID NO: 12061 - DNA, 21 bp, Artificial Sequence
  Synthetic
ttgaaaatggggtattccacg

SEQ ID NO: 12062 - DNA, 21 bp, Artificial Sequence
  Synthetic
gtaaaccgcggctactcatca

SEQ ID NO: 12063 - DNA, 21 bp, Artificial Sequence
  Synthetic
ttgaaacacgggtattcccag

SEQ ID NO: 12064 - DNA, 21 bp, Artificial Sequence
  Synthetic
gggaaagtggggtattcccag

SEQ ID NO: 12065 - DNA, 21 bp, Artificial Sequence
  Synthetic
atgaaaatagggtattcccag

SEQ ID NO: 12066 - DNA, 21 bp, Artificial Sequence
  Synthetic
acgatagcgaggatgttgacg

SEQ ID NO: 12067 - DNA, 21 bp, Artificial Sequence
  Synthetic
accaagtcaggctactcacaa

SEQ ID NO: 12068 - DNA, 21 bp, Artificial Sequence
  Synthetic
tcacgcatcggctactcatca

SEQ ID NO: 12069 - DNA, 21 bp, Artificial Sequence
  Synthetic
acgaataaagggtattccacg

SEQ ID NO: 12070 - DNA, 21 bp, Artificial Sequence
  Synthetic
tttaagcatggctactcaacc

SEQ ID NO: 12071 - DNA, 21 bp, Artificial Sequence
  Synthetic
ctgcgccatggctactcacaa

SEQ ID NO: 12072 - DNA, 21 bp, Artificial Sequence
  Synthetic
gaacgcgtaggctactcatca

SEQ ID NO: 12073 - DNA, 21 bp, Artificial Sequence
  Synthetic
gtgagggtggggtattccacg

SEQ ID NO: 12074 - DNA, 21 bp, Artificial Sequence
  Synthetic
cagaaattggggtattccacg

SEQ ID NO: 12075 - DNA, 21 bp, Artificial Sequence
  Synthetic
tggcgcgtaggctactcacaa

SEQ ID NO: 12076 - DNA, 21 bp, Artificial Sequence
  Synthetic
gaacgcatgggctactcatca

SEQ ID NO: 12077 - DNA, 21 bp, Artificial Sequence
  Synthetic
atccgcggcggctactcacaa

SEQ ID NO: 12078 - DNA, 21 bp, Artificial Sequence
  Synthetic
tccaaagtggggtattccacg

SEQ ID NO: 12079 - DNA, 21 bp, Artificial Sequence
  Synthetic
gtgagggcggggtattccacg

SEQ ID NO: 12080 - DNA, 21 bp, Artificial Sequence
  Synthetic
ttgaaaatagggtattcctcc

SEQ ID NO: 12081 - DNA, 21 bp, Artificial Sequence
  Synthetic
tggaatgtgacggcggggtat

SEQ ID NO: 12082 - DNA, 21 bp, Artificial Sequence
  Synthetic
ataaaacacgggtattcctcc

SEQ ID NO: 12083 - DNA, 21 bp, Artificial Sequence
  Synthetic
atagggcagacgaggtataat

SEQ ID NO: 12084 - DNA, 21 bp, Artificial Sequence
  Synthetic
gaacgccatggctactcatca

SEQ ID NO: 12085 - DNA, 21 bp, Artificial Sequence
  Synthetic
atgaggcaggggtattcccag

SEQ ID NO: 12086 - DNA, 21 bp, Artificial Sequence
  Synthetic
tcaaaggtaggctactcacaa

SEQ ID NO: 12087 - DNA, 21 bp, Artificial Sequence
  Synthetic
gagaaaatagggtattcccag

SEQ ID NO: 12088 - DNA, 21 bp, Artificial Sequence
  Synthetic
atcaagcatggctactcacaa

SEQ ID NO: 12089 - DNA, 21 bp, Artificial Sequence
  Synthetic
atgaagtcaggctactcaacc

SEQ ID NO: 12090 - DNA, 21 bp, Artificial Sequence
  Synthetic
gccaagatgggctactcacaa

SEQ ID NO: 12091 - DNA, 21 bp, Artificial Sequence
  Synthetic
gaaaagtttggctactcatca

SEQ ID NO: 12092 - DNA, 21 bp, Artificial Sequence
  Synthetic
acccgcgccggctactcacaa

SEQ ID NO: 12093 - DNA, 21 bp, Artificial Sequence
  Synthetic
ttgaggatggggtattcctcc

SEQ ID NO: 12094 - DNA, 21 bp, Artificial Sequence
  Synthetic
accaagatgggctactcacaa

SEQ ID NO: 12095 - DNA, 21 bp, Artificial Sequence
  Synthetic
gaaaagcatggctactcatca

SEQ ID NO: 12096 - DNA, 21 bp, Artificial Sequence
  Synthetic
atcaagcccggctactcacaa

SEQ ID NO: 12097 - DNA, 21 bp, Artificial Sequence
  Synthetic
gtgaaaacggggtattcctcc

SEQ ID NO: 12098 - DNA, 21 bp, Artificial Sequence
  Synthetic
accaagtacggctactcaacc

SEQ ID NO: 12099 - DNA, 21 bp, Artificial Sequence
  Synthetic
cagaaacacgggtattcctcc

SEQ ID NO: 12100 - DNA, 21 bp, Artificial Sequence
  Synthetic
ccgagggtggggtattcctcc

SEQ ID NO: 12101 - DNA, 21 bp, Artificial Sequence
  Synthetic
accaagggcggctactcacaa

SEQ ID NO: 12102 - DNA, 21 bp, Artificial Sequence
  Synthetic
ataagggcggggtggtcccag

SEQ ID NO: 12103 - DNA, 21 bp, Artificial Sequence
  Synthetic
gataggcacgggtattcccag

SEQ ID NO: 12104 - DNA, 21 bp, Artificial Sequence
  Synthetic
gaacgccatggctactcaacc

SEQ ID NO: 12105 - DNA, 21 bp, Artificial Sequence
  Synthetic
aataaagtggggtatgcgcag

SEQ ID NO: 12106 - DNA, 21 bp, Artificial Sequence
  Synthetic
gaccgctttggctactcatca

SEQ ID NO: 12107 - DNA, 21 bp, Artificial Sequence
  Synthetic
gagaaacacgggtattcctcc

SEQ ID NO: 12108 - DNA, 21 bp, Artificial Sequence
  Synthetic
tataaaatagggtattcccag

SEQ ID NO: 12109 - DNA, 21 bp, Artificial Sequence
  Synthetic
acgaaattcgggtattccacg

SEQ ID NO: 12110 - DNA, 21 bp, Artificial Sequence
  Synthetic
cagaggatggggtattcctcc

SEQ ID NO: 12111 - DNA, 21 bp, Artificial Sequence
  Synthetic
acgaaattggggtattcctcc

SEQ ID NO: 12112 - DNA, 21 bp, Artificial Sequence
  Synthetic
gagaaaatagggtattcctcc

SEQ ID NO: 12113 - DNA, 21 bp, Artificial Sequence
  Synthetic
atatccagggggatggcgcag

SEQ ID NO: 12114 - DNA, 21 bp, Artificial Sequence
  Synthetic
gaaaagtacggctactcatca

SEQ ID NO: 12115 - DNA, 21 bp, Artificial Sequence
  Synthetic
ataaaacaggggtattccacg

SEQ ID NO: 12116 - DNA, 21 bp, Artificial Sequence
  Synthetic
gataggccggggtattcccag

SEQ ID NO: 12117 - DNA, 21 bp, Artificial Sequence
  Synthetic
tacaagcaaggctactcacaa

SEQ ID NO: 12118 - DNA, 21 bp, Artificial Sequence
  Synthetic
gataggatagggtattcctcc

SEQ ID NO: 12119 - DNA, 21 bp, Artificial Sequence
  Synthetic
aataggatagggtattcccag

SEQ ID NO: 12120 - DNA, 21 bp, Artificial Sequence
  Synthetic
ataagggcggggtattcccag

SEQ ID NO: 12121 - DNA, 21 bp, Artificial Sequence
  Synthetic
gagaggatagggtattcctcc

SEQ ID NO: 12122 - DNA, 21 bp, Artificial Sequence
  Synthetic
tacaagcatggctactcatca

SEQ ID NO: 12123 - DNA, 21 bp, Artificial Sequence
  Synthetic
gtgaggaatgggtattcctcc

SEQ ID NO: 12124 - DNA, 21 bp, Artificial Sequence
  Synthetic
taccgcctgggctactcacaa

SEQ ID NO: 12125 - DNA, 21 bp, Artificial Sequence
  Synthetic
atgaaggccggctactcaacc

SEQ ID NO: 12126 - DNA, 21 bp, Artificial Sequence
  Synthetic
ataaggatggggtattcccag

SEQ ID NO: 12127 - DNA, 21 bp, Artificial Sequence
  Synthetic
ataaggcacgggtattcccag

SEQ ID NO: 12128 - DNA, 21 bp, Artificial Sequence
  Synthetic
ccgaggatagggtattcctcc

SEQ ID NO: 12129 - DNA, 21 bp, Artificial Sequence
  Synthetic
aataaaatagggtattcctcc

SEQ ID NO: 12130 - DNA, 21 bp, Artificial Sequence
  Synthetic
gtaaaggccggctactcacaa

SEQ ID NO: 12131 - DNA, 21 bp, Artificial Sequence
  Synthetic
gagaggttggggtattccacg

SEQ ID NO: 12132 - DNA, 21 bp, Artificial Sequence
  Synthetic
tttaaggccggctactcaacc

SEQ ID NO: 12133 - DNA, 21 bp, Artificial Sequence
  Synthetic
ttgaggttggggtattcctcc

SEQ ID NO: 12134 - DNA, 21 bp, Artificial Sequence
  Synthetic
accaagatcggctactcaacc

SEQ ID NO: 12135 - DNA, 21 bp, Artificial Sequence
  Synthetic
gacaagatcggctactcatca

SEQ ID NO: 12136 - DNA, 21 bp, Artificial Sequence
  Synthetic
ataaggacggggttggcgcag

SEQ ID NO: 12137 - DNA, 21 bp, Artificial Sequence
  Synthetic
aataaatccgggtattcccag

SEQ ID NO: 12138 - DNA, 21 bp, Artificial Sequence
  Synthetic
aagtaccccggctcatcaacc

SEQ ID NO: 12139 - DNA, 21 bp, Artificial Sequence
  Synthetic
ctgtcatacggcgcctcacaa

SEQ ID NO: 12140 - DNA, 21 bp, Artificial Sequence
  Synthetic
atgcgcatcggctactcacaa

SEQ ID NO: 12141 - DNA, 21 bp, Artificial Sequence
  Synthetic
acgaaatatgggtattcccag

SEQ ID NO: 12142 - DNA, 21 bp, Artificial Sequence
  Synthetic
ttgaaattggggtattccacg

SEQ ID NO: 12143 - DNA, 21 bp, Artificial Sequence
  Synthetic
tggaccaccaaggacggctac

SEQ ID NO: 12144 - DNA, 21 bp, Artificial Sequence
  Synthetic
gaaaagtcaggctactcacaa

SEQ ID NO: 12145 - DNA, 21 bp, Artificial Sequence
  Synthetic
atgaaggtaggctactcaacc

SEQ ID NO: 12146 - DNA, 21 bp, Artificial Sequence
  Synthetic
cgctacgtaggcgaatcatca

SEQ ID NO: 12147 - DNA, 21 bp, Artificial Sequence
  Synthetic
gtgaggatagggtattcccag

SEQ ID NO: 12148 - DNA, 21 bp, Artificial Sequence
  Synthetic
acgtatcaggggtattcctcc

SEQ ID NO: 12149 - DNA, 21 bp, Artificial Sequence
  Synthetic
caaaagcaaggctactcatca

SEQ ID NO: 12150 - DNA, 21 bp, Artificial Sequence
  Synthetic
ttgaggttggggtattcccag

SEQ ID NO: 12151 - DNA, 21 bp, Artificial Sequence
  Synthetic
tccaaacaggggtattcctcc

SEQ ID NO: 12152 - DNA, 21 bp, Artificial Sequence
  Synthetic
gtaaaggtaggctactcacaa

SEQ ID NO: 12153 - DNA, 21 bp, Artificial Sequence
  Synthetic
acgaggatggggtattcccag

SEQ ID NO: 12154 - DNA, 21 bp, Artificial Sequence
  Synthetic
tggaggacggggtattccacg

SEQ ID NO: 12155 - DNA, 21 bp, Artificial Sequence
  Synthetic
acgaggcacgggtattcctcc

SEQ ID NO: 12156 - DNA, 21 bp, Artificial Sequence
  Synthetic
gaccgcggcggctactcacaa

SEQ ID NO: 12157 - DNA, 21 bp, Artificial Sequence
  Synthetic
atccgccatggctactcatca

SEQ ID NO: 12158 - DNA, 21 bp, Artificial Sequence
  Synthetic
acgaaattggggtattcccag

SEQ ID NO: 12159 - DNA, 21 bp, Artificial Sequence
  Synthetic
ttgaaaatggggtattcctcc

SEQ ID NO: 12160 - DNA, 21 bp, Artificial Sequence
  Synthetic
tccaaaatagggtattcccag

SEQ ID NO: 12161 - DNA, 21 bp, Artificial Sequence
  Synthetic
caaaaggccggctactcatca

SEQ ID NO: 12162 - DNA, 21 bp, Artificial Sequence
  Synthetic
atgaagcaaggctactcacaa

SEQ ID NO: 12163 - DNA, 21 bp, Artificial Sequence
  Synthetic
aataaaacggggtattccacg

SEQ ID NO: 12164 - DNA, 21 bp, Artificial Sequence
  Synthetic
tttaagcatggctactcatca

SEQ ID NO: 12165 - DNA, 21 bp, Artificial Sequence
  Synthetic
aataaagtggggtattcccag

SEQ ID NO: 12166 - DNA, 21 bp, Artificial Sequence
  Synthetic
atccgcaacggctactcacaa

SEQ ID NO: 12167 - DNA, 21 bp, Artificial Sequence
  Synthetic
gaacgcgccggctactcatca

SEQ ID NO: 12168 - DNA, 21 bp, Artificial Sequence
  Synthetic
atcaagtacggctactcacaa

SEQ ID NO: 12169 - DNA, 21 bp, Artificial Sequence
  Synthetic
gtgaggcacgggtattccacg

SEQ ID NO: 12170 - DNA, 21 bp, Artificial Sequence
  Synthetic
aacaaggccggctactcaacc

SEQ ID NO: 12171 - DNA, 21 bp, Artificial Sequence
  Synthetic
ctgcgccatggcatgtcacaa

SEQ ID NO: 12172 - DNA, 21 bp, Artificial Sequence
  Synthetic
gaccgctttggctactcacaa

SEQ ID NO: 12173 - DNA, 21 bp, Artificial Sequence
  Synthetic
aataggcaggggtattcccag

SEQ ID NO: 12174 - DNA, 21 bp, Artificial Sequence
  Synthetic
atgaagtacggctactcacaa

SEQ ID NO: 12175 - DNA, 21 bp, Artificial Sequence
  Synthetic
gtaaagatgggctactcatca

SEQ ID NO: 12176 - DNA, 21 bp, Artificial Sequence
  Synthetic
gagaggacggggtattcctcc

SEQ ID NO: 12177 - DNA, 21 bp, Artificial Sequence
  Synthetic
gagaggccggggtattcccag

SEQ ID NO: 12178 - DNA, 21 bp, Artificial Sequence
  Synthetic
cagagggtggggtattcccag

SEQ ID NO: 12179 - DNA, 21 bp, Artificial Sequence
  Synthetic
gatagggcggggtattcctcc

SEQ ID NO: 12180 - DNA, 21 bp, Artificial Sequence
  Synthetic
gcggggatagggagggcgcag

SEQ ID NO: 12181 - DNA, 21 bp, Artificial Sequence
  Synthetic
gataggttcgggtattcctcc

SEQ ID NO: 12182 - DNA, 21 bp, Artificial Sequence
  Synthetic
tttaagcatggctactcacaa

SEQ ID NO: 12183 - DNA, 21 bp, Artificial Sequence
  Synthetic
gaacgcgtaggctactcacaa

SEQ ID NO: 12184 - DNA, 21 bp, Artificial Sequence
  Synthetic
acctaccaaggctactcatca

SEQ ID NO: 12185 - DNA, 21 bp, Artificial Sequence
  Synthetic
gataggcacgggtattcctcc

SEQ ID NO: 12186 - DNA, 21 bp, Artificial Sequence
  Synthetic
tcacgcaacggctactcacaa

SEQ ID NO: 12187 - DNA, 21 bp, Artificial Sequence
  Synthetic
accaagcaaggctactcacaa

SEQ ID NO: 12188 - DNA, 21 bp, Artificial Sequence
  Synthetic
aataaaacggggtattcccag

SEQ ID NO: 12189 - DNA, 21 bp, Artificial Sequence
  Synthetic
gagaggcacgggtattcctcc

SEQ ID NO: 12190 - DNA, 21 bp, Artificial Sequence
  Synthetic
aacaagtttggctactcaacc

SEQ ID NO: 12191 - DNA, 21 bp, Artificial Sequence
  Synthetic
tataaagtggggtattcccag

SEQ ID NO: 12192 - DNA, 21 bp, Artificial Sequence
  Synthetic
gataggatagggtattccacg

SEQ ID NO: 12193 - DNA, 21 bp, Artificial Sequence
  Synthetic
gtaaagatgggctactcaacc

SEQ ID NO: 12194 - DNA, 21 bp, Artificial Sequence
  Synthetic
accaaggccggctactcaacc

SEQ ID NO: 12195 - DNA, 21 bp, Artificial Sequence
  Synthetic
atgaaacaggggtattcccag

SEQ ID NO: 12196 - DNA, 21 bp, Artificial Sequence
  Synthetic
gtgaaattggggtattccacg

SEQ ID NO: 12197 - DNA, 21 bp, Artificial Sequence
  Synthetic
gaacgcctgggctactcatca

SEQ ID NO: 12198 - DNA, 21 bp, Artificial Sequence
  Synthetic
aaccgcatgggctactcacaa

SEQ ID NO: 12199 - DNA, 21 bp, Artificial Sequence
  Synthetic
gaccgccatggctactcacaa

SEQ ID NO: 12200 - DNA, 21 bp, Artificial Sequence
  Synthetic
acccaaatgggctactcatca

SEQ ID NO: 12201 - DNA, 21 bp, Artificial Sequence
  Synthetic
tttcgctcaggctactcacaa

SEQ ID NO: 12202 - DNA, 21 bp, Artificial Sequence
  Synthetic
tcacgcatgggctactcaacc

SEQ ID NO: 12203 - DNA, 21 bp, Artificial Sequence
  Synthetic
acccaacaaggctggtcatca

SEQ ID NO: 12204 - DNA, 21 bp, Artificial Sequence
  Synthetic
ttgaaattcgggtattcccag

SEQ ID NO: 12205 - DNA, 21 bp, Artificial Sequence
  Synthetic
tcacgcaccggctactcaacc

SEQ ID NO: 12206 - DNA, 21 bp, Artificial Sequence
  Synthetic
aacaagtacggctactcacaa

SEQ ID NO: 12207 - DNA, 21 bp, Artificial Sequence
  Synthetic
atgaaacacgggtattccacg

SEQ ID NO: 12208 - DNA, 21 bp, Artificial Sequence
  Synthetic
ttgaggatggggtatgcgcag

SEQ ID NO: 12209 - DNA, 21 bp, Artificial Sequence
  Synthetic
atgaagatgggctactcacaa

SEQ ID NO: 12210 - DNA, 21 bp, Artificial Sequence
  Synthetic
acccatcaaggctactcatca

SEQ ID NO: 12211 - DNA, 21 bp, Artificial Sequence
  Synthetic
gagagggcggggtattcctcc

SEQ ID NO: 12212 - DNA, 21 bp, Artificial Sequence
  Synthetic
gagagggcggggtattcccag

SEQ ID NO: 12213 - DNA, 21 bp, Artificial Sequence
  Synthetic
aaccgccaaggctactcaacc

SEQ ID NO: 12214 - DNA, 21 bp, Artificial Sequence
  Synthetic
acgaaaacggggtggtccgcg

SEQ ID NO: 12215 - DNA, 21 bp, Artificial Sequence
  Synthetic
gagaggcaggggtattcccag

SEQ ID NO: 12216 - DNA, 21 bp, Artificial Sequence
  Synthetic
ctgtcatactcagcctcactg

SEQ ID NO: 12217 - DNA, 21 bp, Artificial Sequence
  Synthetic
gataggtccgggtattcctcc

SEQ ID NO: 12218 - DNA, 21 bp, Artificial Sequence
  Synthetic
gaaaagatcggctactcatca

SEQ ID NO: 12219 - DNA, 21 bp, Artificial Sequence
  Synthetic
aataaattcgggtattcctcc

SEQ ID NO: 12220 - DNA, 21 bp, Artificial Sequence
  Synthetic
cgcgtatcaaacctgcatacc

SEQ ID NO: 12221 - DNA, 21 bp, Artificial Sequence
  Synthetic
ataaggcacgggtattcctcc

SEQ ID NO: 12222 - DNA, 21 bp, Artificial Sequence
  Synthetic
gtacgccatggctactcatca

SEQ ID NO: 12223 - DNA, 21 bp, Artificial Sequence
  Synthetic
acccgcgccggctactcaacc

SEQ ID NO: 12224 - DNA, 21 bp, Artificial Sequence
  Synthetic
gtaaagtacggctactcaacc

SEQ ID NO: 12225 - DNA, 21 bp, Artificial Sequence
  Synthetic
gagaggatagggtattccacg

SEQ ID NO: 12226 - DNA, 21 bp, Artificial Sequence
  Synthetic
atgaaatatgggtattcccag

SEQ ID NO: 12227 - DNA, 21 bp, Artificial Sequence
  Synthetic
atcaagtcaggctactcacaa

SEQ ID NO: 12228 - DNA, 21 bp, Artificial Sequence
  Synthetic
tccaaaatggggtattcccag

SEQ ID NO: 12229 - DNA, 21 bp, Artificial Sequence
  Synthetic
cataaggccggctactcacaa

SEQ ID NO: 12230 - DNA, 21 bp, Artificial Sequence
  Synthetic
ataaggatagggtattccacg

SEQ ID NO: 12231 - DNA, 21 bp, Artificial Sequence
  Synthetic
ctgaaggaaggctactcacaa

SEQ ID NO: 12232 - DNA, 21 bp, Artificial Sequence
  Synthetic
atcaagctgggctactcaacc

SEQ ID NO: 12233 - DNA, 21 bp, Artificial Sequence
  Synthetic
atgagggcggggtattccacg

SEQ ID NO: 12234 - DNA, 21 bp, Artificial Sequence
  Synthetic
tggaaggtaggctactcacaa

SEQ ID NO: 12235 - DNA, 21 bp, Artificial Sequence
  Synthetic
aaccgcatgggctactcatca

SEQ ID NO: 12236 - DNA, 21 bp, Artificial Sequence
  Synthetic
gataggttggggtattcccag

SEQ ID NO: 12237 - DNA, 21 bp, Artificial Sequence
  Synthetic
ataaaagcggggtattccacg

SEQ ID NO: 12238 - DNA, 21 bp, Artificial Sequence
  Synthetic
gaccgcgtaggctactcatca

SEQ ID NO: 12239 - DNA, 21 bp, Artificial Sequence
  Synthetic
gagagggtggggtattcctcc

SEQ ID NO: 12240 - DNA, 21 bp, Artificial Sequence
  Synthetic
caacgccaaggctactcacaa

SEQ ID NO: 12241 - DNA, 21 bp, Artificial Sequence
  Synthetic
ctgaagaccggctactcaacc

SEQ ID NO: 12242 - DNA, 21 bp, Artificial Sequence
  Synthetic
cagaaatatgggtattccacg

SEQ ID NO: 12243 - DNA, 21 bp, Artificial Sequence
  Synthetic
gagaaacaggggtattcctcc

SEQ ID NO: 12244 - DNA, 21 bp, Artificial Sequence
  Synthetic
atccgcgtaggctactcaacc

SEQ ID NO: 12245 - DNA, 21 bp, Artificial Sequence
  Synthetic
gacaagcatggctactcacaa

SEQ ID NO: 12246 - DNA, 21 bp, Artificial Sequence
  Synthetic
aataggttggggtattcccag

SEQ ID NO: 12247 - DNA, 21 bp, Artificial Sequence
  Synthetic
acgcagcaggggtattccacg

SEQ ID NO: 12248 - DNA, 21 bp, Artificial Sequence
  Synthetic
gataaagtggggtattccacg

SEQ ID NO: 12249 - DNA, 21 bp, Artificial Sequence
  Synthetic
tccaaatccgggtattccgcg

SEQ ID NO: 12250 - DNA, 21 bp, Artificial Sequence
  Synthetic
ttcaggacggggatgtcccag

SEQ ID NO: 12251 - DNA, 21 bp, Artificial Sequence
  Synthetic
tccaaattcgggtattcccag

SEQ ID NO: 12252 - DNA, 21 bp, Artificial Sequence
  Synthetic
atgaaatatgggtattcctcc

SEQ ID NO: 12253 - DNA, 21 bp, Artificial Sequence
  Synthetic
aataggtccgggtattcccag

SEQ ID NO: 12254 - DNA, 21 bp, Artificial Sequence
  Synthetic
gacaagtttggctactcaacc

SEQ ID NO: 12255 - DNA, 21 bp, Artificial Sequence
  Synthetic
atccgcgacggctactcacaa

SEQ ID NO: 12256 - DNA, 21 bp, Artificial Sequence
  Synthetic
ctgaaggtaggctactcaacc

SEQ ID NO: 12257 - DNA, 21 bp, Artificial Sequence
  Synthetic
tacaaggccggctactcacaa

SEQ ID NO: 12258 - DNA, 21 bp, Artificial Sequence
  Synthetic
ccccgccaaggctactcatca

SEQ ID NO: 12259 - DNA, 21 bp, Artificial Sequence
  Synthetic
ggccgcatgggctactcaacc

SEQ ID NO: 12260 - DNA, 21 bp, Artificial Sequence
  Synthetic
gaccgcgccggctactcatca

SEQ ID NO: 12261 - DNA, 21 bp, Artificial Sequence
  Synthetic
tggacgacgaaagatgggtat

SEQ ID NO: 12262 - DNA, 21 bp, Artificial Sequence
  Synthetic
atgaaacacgggtattcccag

SEQ ID NO: 12263 - DNA, 21 bp, Artificial Sequence
  Synthetic
gagaaaatagggtattccacg

SEQ ID NO: 12264 - DNA, 21 bp, Artificial Sequence
  Synthetic
gaacgctcaggctactcacaa

SEQ ID NO: 12265 - DNA, 21 bp, Artificial Sequence
  Synthetic
tcctatcacgggcaggcgtcc

SEQ ID NO: 12266 - DNA, 21 bp, Artificial Sequence
  Synthetic
atagcgtccgggtattcccag

SEQ ID NO: 12267 - DNA, 21 bp, Artificial Sequence
  Synthetic
caatacgtacgcgccctgtca

SEQ ID NO: 12268 - DNA, 21 bp, Artificial Sequence
  Synthetic
ttcaaagcggggtattcctcc

SEQ ID NO: 12269 - DNA, 21 bp, Artificial Sequence
  Synthetic
atgaaattggggtattcccag

SEQ ID NO: 12270 - DNA, 21 bp, Artificial Sequence
  Synthetic
gataggcaggggtattcccag

SEQ ID NO: 12271 - DNA, 21 bp, Artificial Sequence
  Synthetic
ttgaggcacgggatgtcccag

SEQ ID NO: 12272 - DNA, 21 bp, Artificial Sequence
  Synthetic
cataagcaaggctactcaacc

SEQ ID NO: 12273 - DNA, 21 bp, Artificial Sequence
  Synthetic
gagaaaccggggtattcccag

SEQ ID NO: 12274 - DNA, 21 bp, Artificial Sequence
  Synthetic
gggagggtggggtattcctcc

SEQ ID NO: 12275 - DNA, 21 bp, Artificial Sequence
  Synthetic
gaccgcaccggctactcatca

SEQ ID NO: 12276 - DNA, 21 bp, Artificial Sequence
  Synthetic
ataaaacacgggtattcccag

SEQ ID NO: 12277 - DNA, 21 bp, Artificial Sequence
  Synthetic
atcaagcaaggctactcaacc

SEQ ID NO: 12278 - DNA, 21 bp, Artificial Sequence
  Synthetic
gaaaagctgggctactcatca

SEQ ID NO: 12279 - DNA, 21 bp, Artificial Sequence
  Synthetic
aagtcagccggctcaatctac

SEQ ID NO: 12280 - DNA, 21 bp, Artificial Sequence
  Synthetic
gaaaagcatggctactcaacc

SEQ ID NO: 12281 - DNA, 21 bp, Artificial Sequence
  Synthetic
atcgtatacggccaagcccaa

SEQ ID NO: 12282 - DNA, 21 bp, Artificial Sequence
  Synthetic
ccgaggtccgggtattcccag

SEQ ID NO: 12283 - DNA, 21 bp, Artificial Sequence
  Synthetic
cagaaagtggggtattcctcc

SEQ ID NO: 12284 - DNA, 21 bp, Artificial Sequence
  Synthetic
gtacgccatggctactcacaa

SEQ ID NO: 12285 - DNA, 21 bp, Artificial Sequence
  Synthetic
acgaaattcgggtattcctcc

SEQ ID NO: 12286 - DNA, 21 bp, Artificial Sequence
  Synthetic
gaactgtacaagctgcccacc

SEQ ID NO: 12287 - DNA, 21 bp, Artificial Sequence
  Synthetic
aataggatggggtattcctcc

SEQ ID NO: 12288 - DNA, 21 bp, Artificial Sequence
  Synthetic
accaagcatggctactcaacc

SEQ ID NO: 12289 - DNA, 21 bp, Artificial Sequence
  Synthetic
gaaaagatcggctactcacaa

SEQ ID NO: 12290 - DNA, 21 bp, Artificial Sequence
  Synthetic
acgcagcaggggtattcctcc

SEQ ID NO: 12291 - DNA, 21 bp, Artificial Sequence
  Synthetic
aataaaatggggtattcccag

SEQ ID NO: 12292 - DNA, 21 bp, Artificial Sequence
  Synthetic
atgcgccaaggctactcacaa

SEQ ID NO: 12293 - DNA, 21 bp, Artificial Sequence
  Synthetic
tcaaagtttggctactcacaa

SEQ ID NO: 12294 - DNA, 21 bp, Artificial Sequence
  Synthetic
cacaaaatggggtattccacg

SEQ ID NO: 12295 - DNA, 21 bp, Artificial Sequence
  Synthetic
gagaaagcggggtattcccag

SEQ ID NO: 12296 - DNA, 21 bp, Artificial Sequence
  Synthetic
gtaaagcaaggctactcaacc

SEQ ID NO: 12297 - DNA, 21 bp, Artificial Sequence
  Synthetic
gaacgcatgggccgcgcccaa

SEQ ID NO: 12298 - DNA, 21 bp, Artificial Sequence
  Synthetic
tttcgcaccggcatgtcacaa

SEQ ID NO: 12299 - DNA, 21 bp, Artificial Sequence
  Synthetic
tggaggcaggggtattcctcc

SEQ ID NO: 12300 - DNA, 21 bp, Artificial Sequence
  Synthetic
atgaagatgggctactcatca

SEQ ID NO: 12301 - DNA, 21 bp, Artificial Sequence
  Synthetic
ctgaagtacggctactcacaa

SEQ ID NO: 12302 - DNA, 21 bp, Artificial Sequence
  Synthetic
aataggatagggtattcctcc

SEQ ID NO: 12303 - DNA, 21 bp, Artificial Sequence
  Synthetic
gatagggtggggtattccacg

SEQ ID NO: 12304 - DNA, 21 bp, Artificial Sequence
  Synthetic
cataagatgggctactcatca

SEQ ID NO: 12305 - DNA, 21 bp, Artificial Sequence
  Synthetic
tataaaacggggtattcccag

SEQ ID NO: 12306 - DNA, 21 bp, Artificial Sequence
  Synthetic
tttcgcaacggctactcacaa

SEQ ID NO: 12307 - DNA, 21 bp, Artificial Sequence
  Synthetic
cacaaacaggggtattccacg

SEQ ID NO: 12308 - DNA, 21 bp, Artificial Sequence
  Synthetic
ataaaatccgggtattccacg

SEQ ID NO: 12309 - DNA, 21 bp, Artificial Sequence
  Synthetic
tccaaatattatgattcctcc

SEQ ID NO: 12310 - DNA, 21 bp, Artificial Sequence
  Synthetic
ataaattattcccagacgttg

SEQ ID NO: 12311 - DNA, 21 bp, Artificial Sequence
  Synthetic
tggaaaatggggtattcctcc

SEQ ID NO: 12312 - DNA, 21 bp, Artificial Sequence
  Synthetic
gagaggaatgggtattcccag

SEQ ID NO: 12313 - DNA, 21 bp, Artificial Sequence
  Synthetic
gacaagtttggctactcatca

SEQ ID NO: 12314 - DNA, 21 bp, Artificial Sequence
  Synthetic
tcacgcgccggctactcacaa

SEQ ID NO: 12315 - DNA, 21 bp, Artificial Sequence
  Synthetic
ttgttgaaagggtatgcgcag

SEQ ID NO: 12316 - DNA, 21 bp, Artificial Sequence
  Synthetic
tggaagcatggctactcacaa

SEQ ID NO: 12317 - DNA, 21 bp, Artificial Sequence
  Synthetic
acccaaatcggctactcatca

SEQ ID NO: 12318 - DNA, 21 bp, Artificial Sequence
  Synthetic
ctgcgcaccggctggtcagcc

SEQ ID NO: 12319 - DNA, 21 bp, Artificial Sequence
  Synthetic
tggaaggccggctactcaacc

SEQ ID NO: 12320 - DNA, 21 bp, Artificial Sequence
  Synthetic
accaaccaaggctactcatca

SEQ ID NO: 12321 - DNA, 21 bp, Artificial Sequence
  Synthetic
atgaaacacgggtattcctcc

SEQ ID NO: 12322 - DNA, 21 bp, Artificial Sequence
  Synthetic
tccaaatatgggtattcctcc

SEQ ID NO: 12323 - DNA, 21 bp, Artificial Sequence
  Synthetic
atccgctacggctactcatca

SEQ ID NO: 12324 - DNA, 21 bp, Artificial Sequence
  Synthetic
gaccgcaccctgcgccatgac

SEQ ID NO: 12325 - DNA, 21 bp, Artificial Sequence
  Synthetic
tggaaaacggggtattccacg

SEQ ID NO: 12326 - DNA, 21 bp, Artificial Sequence
  Synthetic
taccgccaaggctactcacaa

SEQ ID NO: 12327 - DNA, 21 bp, Artificial Sequence
  Synthetic
gaaaagaccggctactcatca

SEQ ID NO: 12328 - DNA, 21 bp, Artificial Sequence
  Synthetic
accaagaccggctactcacaa

SEQ ID NO: 12329 - DNA, 21 bp, Artificial Sequence
  Synthetic
gccaagcatggctactcatca

SEQ ID NO: 12330 - DNA, 21 bp, Artificial Sequence
  Synthetic
acgcagatagggtattcctcc

SEQ ID NO: 12331 - DNA, 21 bp, Artificial Sequence
  Synthetic
acgaggttggggtattcccag

SEQ ID NO: 12332 - DNA, 21 bp, Artificial Sequence
  Synthetic
tttcgccccgccggctcacaa

SEQ ID NO: 12333 - DNA, 21 bp, Artificial Sequence
  Synthetic
gagaggacggggtattccacg

SEQ ID NO: 12334 - DNA, 21 bp, Artificial Sequence
  Synthetic
ggccgccaaggctactcacaa

SEQ ID NO: 12335 - DNA, 21 bp, Artificial Sequence
  Synthetic
tggggcacccccccccgcggc

SEQ ID NO: 12336 - DNA, 21 bp, Artificial Sequence
  Synthetic
tggaaagcggggtattccacg

SEQ ID NO: 12337 - DNA, 21 bp, Artificial Sequence
  Synthetic
atgaagcatggctactcacaa

SEQ ID NO: 12338 - DNA, 21 bp, Artificial Sequence
  Synthetic
gagagggtggggtattcccag

SEQ ID NO: 12339 - DNA, 21 bp, Artificial Sequence
  Synthetic
ttgaggcacgggttgtccacg

SEQ ID NO: 12340 - DNA, 21 bp, Artificial Sequence
  Synthetic
gatagggtggggtattcctcc

SEQ ID NO: 12341 - DNA, 21 bp, Artificial Sequence
  Synthetic
cacaaatatgggtattcccag

SEQ ID NO: 12342 - DNA, 21 bp, Artificial Sequence
  Synthetic
gaaaagctgggctactcacaa

SEQ ID NO: 12343 - DNA, 21 bp, Artificial Sequence
  Synthetic
gaaaagcccggctactcacaa

SEQ ID NO: 12344 - DNA, 21 bp, Artificial Sequence
  Synthetic
atgcgcatgggctactcacaa

SEQ ID NO: 12345 - DNA, 21 bp, Artificial Sequence
  Synthetic
caaaagtacggctactcaacc

SEQ ID NO: 12346 - DNA, 21 bp, Artificial Sequence
  Synthetic
atgaaaatggggtattcccag

SEQ ID NO: 12347 - DNA, 21 bp, Artificial Sequence
  Synthetic
cacaaattggggtattcctcc

SEQ ID NO: 12348 - DNA, 21 bp, Artificial Sequence
  Synthetic
atcaagtacggctactcatca

SEQ ID NO: 12349 - DNA, 21 bp, Artificial Sequence
  Synthetic
gataaagtggggtattcccag

SEQ ID NO: 12350 - DNA, 21 bp, Artificial Sequence
  Synthetic
gaccgcctgggctactcatca

SEQ ID NO: 12351 - DNA, 21 bp, Artificial Sequence
  Synthetic
gagttgtataaattgccgacg

SEQ ID NO: 12352 - DNA, 21 bp, Artificial Sequence
  Synthetic
caacgccatggctactcaacc

SEQ ID NO: 12353 - DNA, 21 bp, Artificial Sequence
  Synthetic
ttgaggggggggtattcccag

SEQ ID NO: 12354 - DNA, 21 bp, Artificial Sequence
  Synthetic
gaaaaggtaggctactcatca

SEQ ID NO: 12355 - DNA, 21 bp, Artificial Sequence
  Synthetic
ataaaatatgcggggtcccag

SEQ ID NO: 12356 - DNA, 21 bp, Artificial Sequence
  Synthetic
gaaaagtttggctactcaacc

SEQ ID NO: 12357 - DNA, 21 bp, Artificial Sequence
  Synthetic
atcaagtcaggctactcaacc

SEQ ID NO: 12358 - DNA, 21 bp, Artificial Sequence
  Synthetic
ataaaatatgggtattcctcc

SEQ ID NO: 12359 - DNA, 21 bp, Artificial Sequence
  Synthetic
acccaacaaggctactcatca

SEQ ID NO: 12360 - DNA, 21 bp, Artificial Sequence
  Synthetic
acccaacaaggctactcatca

SEQ ID NO: 12361 - DNA, 21 bp, Artificial Sequence
  Synthetic
gtaaagctgggctactcaacc

SEQ ID NO: 12362 - DNA, 21 bp, Artificial Sequence
  Synthetic
gaccgcgtaggctactcacaa

SEQ ID NO: 12363 - DNA, 21 bp, Artificial Sequence
  Synthetic
gacaagcatggctactcaacc

SEQ ID NO: 12364 - DNA, 21 bp, Artificial Sequence
  Synthetic
atgaggcaggggtattccacg

SEQ ID NO: 12365 - DNA, 21 bp, Artificial Sequence
  Synthetic
ccccgcatcggctactcacaa

SEQ ID NO: 12366 - DNA, 21 bp, Artificial Sequence
  Synthetic
gaaaagatcggctactcaacc

SEQ ID NO: 12367 - DNA, 21 bp, Artificial Sequence
  Synthetic
gtaaagaccggctactcaacc

SEQ ID NO: 12368 - DNA, 21 bp, Artificial Sequence
  Synthetic
aggtatacggcggatgcgtcc

SEQ ID NO: 12369 - DNA, 21 bp, Artificial Sequence
  Synthetic
tatgggtccttgtccgcgttg

SEQ ID NO: 12370 - DNA, 21 bp, Artificial Sequence
  Synthetic
ttcagggaggggtattcccag

SEQ ID NO: 12371 - DNA, 21 bp, Artificial Sequence
  Synthetic
gataaaatagggtattcccag

SEQ ID NO: 12372 - DNA, 21 bp, Artificial Sequence
  Synthetic
atccgcgccggctggtcacaa

SEQ ID NO: 12373 - DNA, 21 bp, Artificial Sequence
  Synthetic
aataaacacgggtattcctcc

SEQ ID NO: 12374 - DNA, 21 bp, Artificial Sequence
  Synthetic
ggctcagaagtaggccgctgg

SEQ ID NO: 12375 - DNA, 21 bp, Artificial Sequence
  Synthetic
ataaaaacggggtattccacg

SEQ ID NO: 12376 - DNA, 21 bp, Artificial Sequence
  Synthetic
ttgatgaaagggtgggcgtcc

SEQ ID NO: 12377 - DNA, 21 bp, Artificial Sequence
  Synthetic
atcaaggaaggctactcacaa

SEQ ID NO: 12378 - DNA, 21 bp, Artificial Sequence
  Synthetic
gataaagtggggtattcctcc

SEQ ID NO: 12379 - DNA, 21 bp, Artificial Sequence
  Synthetic
gtgaaagcggggtattccacg

SEQ ID NO: 12380 - DNA, 21 bp, Artificial Sequence
  Synthetic
aaaaaagaggggtattcccag

SEQ ID NO: 12381 - DNA, 21 bp, Artificial Sequence
  Synthetic
aagaaggtaggctactcacaa

SEQ ID NO: 12382 - DNA, 21 bp, Artificial Sequence
  Synthetic
gacaaggccggctactcacaa

SEQ ID NO: 12383 - DNA, 21 bp, Artificial Sequence
  Synthetic
tggaagcaaatgggcgccgcc

SEQ ID NO: 12384 - DNA, 21 bp, Artificial Sequence
  Synthetic
ataaaagtggggtattcctcc

SEQ ID NO: 12385 - DNA, 21 bp, Artificial Sequence
  Synthetic
caacgcggcggctactcacaa

SEQ ID NO: 12386 - DNA, 21 bp, Artificial Sequence
  Synthetic
atccgccatggctactcacaa

SEQ ID NO: 12387 - DNA, 21 bp, Artificial Sequence
  Synthetic
atcaaggccggctactcaacc

SEQ ID NO: 12388 - DNA, 21 bp, Artificial Sequence
  Synthetic
gtgaaaacggggtattccacg

SEQ ID NO: 12389 - DNA, 21 bp, Artificial Sequence
  Synthetic
acgagggtgggggattatttg

SEQ ID NO: 12390 - DNA, 21 bp, Artificial Sequence
  Synthetic
acccaactgggctactcatca

SEQ ID NO: 12391 - DNA, 21 bp, Artificial Sequence
  Synthetic
gaaaaggccggctactcatca

SEQ ID NO: 12392 - DNA, 21 bp, Artificial Sequence
  Synthetic
aataggatggggtattcccag

SEQ ID NO: 12393 - DNA, 21 bp, Artificial Sequence
  Synthetic
accaagtttggctactcacaa

SEQ ID NO: 12394 - DNA, 21 bp, Artificial Sequence
  Synthetic
ttcaggcaggggtattcccag

SEQ ID NO: 12395 - DNA, 21 bp, Artificial Sequence
  Synthetic
acccgccaaggctactcacaa

SEQ ID NO: 12396 - DNA, 21 bp, Artificial Sequence
  Synthetic
gtaaagcatggctactcacaa

SEQ ID NO: 12397 - DNA, 21 bp, Artificial Sequence
  Synthetic
gacaaggccggctactcaacc

SEQ ID NO: 12398 - DNA, 21 bp, Artificial Sequence
  Synthetic
gaacgctacggctactcaacc

SEQ ID NO: 12399 - DNA, 21 bp, Artificial Sequence
  Synthetic
ggcaaggccggctactcaacc

SEQ ID NO: 12400 - DNA, 21 bp, Artificial Sequence
  Synthetic
tataaacacgggtattcctcc

SEQ ID NO: 12401 - DNA, 21 bp, Artificial Sequence
  Synthetic
gtgagggaggggtattcctcc

SEQ ID NO: 12402 - DNA, 21 bp, Artificial Sequence
  Synthetic
tttaagcaaggctactcaacc

SEQ ID NO: 12403 - DNA, 21 bp, Artificial Sequence
  Synthetic
ttcagggtggggtattccacg

SEQ ID NO: 12404 - DNA, 21 bp, Artificial Sequence
  Synthetic
gataaagcggggtattcctcc

SEQ ID NO: 12405 - DNA, 21 bp, Artificial Sequence
  Synthetic
gaacgctacggcggctcaatc

SEQ ID NO: 12406 - DNA, 21 bp, Artificial Sequence
  Synthetic
ccgaggatagggtattcccag

SEQ ID NO: 12407 - DNA, 21 bp, Artificial Sequence
  Synthetic
tggaggtccttgggggcggcg

SEQ ID NO: 12408 - DNA, 21 bp, Artificial Sequence
  Synthetic
gtgaaatatgggtattcctcc

SEQ ID NO: 12409 - DNA, 21 bp, Artificial Sequence
  Synthetic
atgaggttggggtattccacg

SEQ ID NO: 12410 - DNA, 21 bp, Artificial Sequence
  Synthetic
atgaaaatggggtattccacg

SEQ ID NO: 12411 - DNA, 21 bp, Artificial Sequence
  Synthetic
gacaaggccggctactcatca

SEQ ID NO: 12412 - DNA, 21 bp, Artificial Sequence
  Synthetic
aatgagaattccgggaggtgg

SEQ ID NO: 12413 - DNA, 21 bp, Artificial Sequence
  Synthetic
acgaaatgggggtattcccag

SEQ ID NO: 12414 - DNA, 21 bp, Artificial Sequence
  Synthetic
gaaaagcaaggctactcaacc

SEQ ID NO: 12415 - DNA, 21 bp, Artificial Sequence
  Synthetic
tacaagtttggctactcacaa

SEQ ID NO: 12416 - protein, 7 aa, Artificial Sequence
  Synthetic
VRTGYSQ

SEQ ID NO: 12417 - protein, 7 aa, Artificial Sequence
  Synthetic
IKAGYSQ

SEQ ID NO: 12418 - protein, 7 aa, Artificial Sequence
  Synthetic
TKYGYSQ

SEQ ID NO: 12419 - protein, 7 aa, Artificial Sequence
  Synthetic
TRLGYST

SEQ ID NO: 12420 - protein, 7 aa, Artificial Sequence
  Synthetic
ERAGYSQ

SEQ ID NO: 12421 - protein, 7 aa, Artificial Sequence
  Synthetic
LRAGYSQ

SEQ ID NO: 12422 - protein, 7 aa, Artificial Sequence
  Synthetic
IRTGYSQ

SEQ ID NO: 12423 - protein, 7 aa, Artificial Sequence
  Synthetic
IRVGYSQ

SEQ ID NO: 12424 - protein, 7 aa, Artificial Sequence
  Synthetic
TQRGYSS

SEQ ID NO: 12425 - protein, 7 aa, Artificial Sequence
  Synthetic
IRTGYSQ

SEQ ID NO: 12426 - protein, 7 aa, Artificial Sequence
  Synthetic
QRAGYSQ

SEQ ID NO: 12427 - protein, 7 aa, Artificial Sequence
  Synthetic
LKTGYSQ

SEQ ID NO: 12428 - protein, 7 aa, Artificial Sequence
  Synthetic
LRHGYSQ

SEQ ID NO: 12429 - protein, 7 aa, Artificial Sequence
  Synthetic
VRVGYSQ

SEQ ID NO: 12430 - protein, 7 aa, Artificial Sequence
  Synthetic
IRHGYSQ

SEQ ID NO: 12431 - protein, 7 aa, Artificial Sequence
  Synthetic
QKTGYSQ

SEQ ID NO: 12432 - protein, 7 aa, Artificial Sequence
  Synthetic
IKHGYSQ

SEQ ID NO: 12433 - protein, 7 aa, Artificial Sequence
  Synthetic
KSVGSVY

SEQ ID NO: 12434 - protein, 7 aa, Artificial Sequence
  Synthetic
LKSGYSQ

SEQ ID NO: 12435 - protein, 7 aa, Artificial Sequence
  Synthetic
VRAGYSQ

SEQ ID NO: 12436 - protein, 7 aa, Artificial Sequence
  Synthetic
IKAGYSQ

SEQ ID NO: 12437 - protein, 7 aa, Artificial Sequence
  Synthetic
IMRGYSS

SEQ ID NO: 12438 - protein, 7 aa, Artificial Sequence
  Synthetic
IKTGYSQ

SEQ ID NO: 12439 - protein, 7 aa, Artificial Sequence
  Synthetic
IRAGWSQ

SEQ ID NO: 12440 - protein, 7 aa, Artificial Sequence
  Synthetic
VKTGYSQ

SEQ ID NO: 12441 - protein, 7 aa, Artificial Sequence
  Synthetic
LRQGYSQ

SEQ ID NO: 12442 - protein, 7 aa, Artificial Sequence
  Synthetic
VKMGYSQ

SEQ ID NO: 12443 - protein, 7 aa, Artificial Sequence
  Synthetic
TRAGYST

SEQ ID NO: 12444 - protein, 7 aa, Artificial Sequence
  Synthetic
IMRGYSS

SEQ ID NO: 12445 - protein, 7 aa, Artificial Sequence
  Synthetic
IKHGYSS

SEQ ID NO: 12446 - protein, 7 aa, Artificial Sequence
  Synthetic
IRTGYSS

SEQ ID NO: 12447 - protein, 7 aa, Artificial Sequence
  Synthetic
DRIGYSQ

SEQ ID NO: 12448 - protein, 7 aa, Artificial Sequence
  Synthetic
VRQGYSS

SEQ ID NO: 12449 - protein, 7 aa, Artificial Sequence
  Synthetic
LKSGYSQ

SEQ ID NO: 12450 - protein, 7 aa, Artificial Sequence
  Synthetic
MKTGYSQ

SEQ ID NO: 12451 - protein, 7 aa, Artificial Sequence
  Synthetic
KSVGSVY

SEQ ID NO: 12452 - protein, 7 aa, Artificial Sequence
  Synthetic
VRLGYSQ

SEQ ID NO: 12453 - protein, 7 aa, Artificial Sequence
  Synthetic
QKYGYST

SEQ ID NO: 12454 - protein, 7 aa, Artificial Sequence
  Synthetic
VKHGYSQ

SEQ ID NO: 12455 - protein, 7 aa, Artificial Sequence
  Synthetic
TKQGYSQ

SEQ ID NO: 12456 - protein, 7 aa, Artificial Sequence
  Synthetic
VRTGYSQ

SEQ ID NO: 12457 - protein, 7 aa, Artificial Sequence
  Synthetic
LRPGYSQ

SEQ ID NO: 12458 - protein, 7 aa, Artificial Sequence
  Synthetic
MRIGYSQ

SEQ ID NO: 12459 - protein, 7 aa, Artificial Sequence
  Synthetic
LKAGYSQ

SEQ ID NO: 12460 - protein, 7 aa, Artificial Sequence
  Synthetic
MKHGYSQ

SEQ ID NO: 12461 - protein, 7 aa, Artificial Sequence
  Synthetic
MRPGYSQ

SEQ ID NO: 12462 - protein, 7 aa, Artificial Sequence
  Synthetic
QRTGYSQ

SEQ ID NO: 12463 - protein, 7 aa, Artificial Sequence
  Synthetic
ERVGYSQ

SEQ ID NO: 12464 - protein, 7 aa, Artificial Sequence
  Synthetic
VKIGYSQ

SEQ ID NO: 12465 - protein, 7 aa, Artificial Sequence
  Synthetic
MKAGYSQ

SEQ ID NO: 12466 - protein, 7 aa, Artificial Sequence
  Synthetic
IKQGYSQ

SEQ ID NO: 12467 - protein, 7 aa, Artificial Sequence
  Synthetic
TKVGYSQ

SEQ ID NO: 12468 - protein, 7 aa, Artificial Sequence
  Synthetic
IKTGYSQ

SEQ ID NO: 12469 - protein, 7 aa, Artificial Sequence
  Synthetic
EKHGYSQ

SEQ ID NO: 12470 - protein, 7 aa, Artificial Sequence
  Synthetic
LKAGYSQ

SEQ ID NO: 12471 - protein, 7 aa, Artificial Sequence
  Synthetic
QRVGYSQ

SEQ ID NO: 12472 - protein, 7 aa, Artificial Sequence
  Synthetic
MRAGYSQ

SEQ ID NO: 12473 - protein, 7 aa, Artificial Sequence
  Synthetic
TKAGYSQ

SEQ ID NO: 12474 - protein, 7 aa, Artificial Sequence
  Synthetic
VKAGYSQ

SEQ ID NO: 12475 - protein, 7 aa, Artificial Sequence
  Synthetic
LRFGYST

SEQ ID NO: 12476 - protein, 7 aa, Artificial Sequence
  Synthetic
TRAGYSQ

SEQ ID NO: 12477 - protein, 7 aa, Artificial Sequence
  Synthetic
TRQGYSQ

SEQ ID NO: 12478 - protein, 7 aa, Artificial Sequence
  Synthetic
TKSGYSQ

SEQ ID NO: 12479 - protein, 7 aa, Artificial Sequence
  Synthetic
TKVGYSQ

SEQ ID NO: 12480 - protein, 7 aa, Artificial Sequence
  Synthetic
QRHGYSQ

SEQ ID NO: 12481 - protein, 7 aa, Artificial Sequence
  Synthetic
PRIGYSQ

SEQ ID NO: 12482 - protein, 7 aa, Artificial Sequence
  Synthetic
IRAGYSQ

SEQ ID NO: 12483 - protein, 7 aa, Artificial Sequence
  Synthetic
EKHGYSS

SEQ ID NO: 12484 - protein, 7 aa, Artificial Sequence
  Synthetic
LRHGMSQ

SEQ ID NO: 12485 - protein, 7 aa, Artificial Sequence
  Synthetic
QKYGYSQ

SEQ ID NO: 12486 - protein, 7 aa, Artificial Sequence
  Synthetic
VKIGYSQ

SEQ ID NO: 12487 - protein, 7 aa, Artificial Sequence
  Synthetic
ERLGYST

SEQ ID NO: 12488 - protein, 7 aa, Artificial Sequence
  Synthetic
MRVGYSQ

SEQ ID NO: 12489 - protein, 7 aa, Artificial Sequence
  Synthetic
QKHGYSQ

SEQ ID NO: 12490 - protein, 7 aa, Artificial Sequence
  Synthetic
ERAGYSQ

SEQ ID NO: 12491 - protein, 7 aa, Artificial Sequence
  Synthetic
ARIGYSQ

SEQ ID NO: 12492 - protein, 7 aa, Artificial Sequence
  Synthetic
TKIGYSQ

SEQ ID NO: 12493 - protein, 7 aa, Artificial Sequence
  Synthetic
EKYGYST

SEQ ID NO: 12494 - protein, 7 aa, Artificial Sequence
  Synthetic
VKYGYSQ

SEQ ID NO: 12495 - protein, 7 aa, Artificial Sequence
  Synthetic
IKSGYSQ

SEQ ID NO: 12496 - protein, 7 aa, Artificial Sequence
  Synthetic
EKLGYSQ

SEQ ID NO: 12497 - protein, 7 aa, Artificial Sequence
  Synthetic
VKSGYSQ

SEQ ID NO: 12498 - protein, 7 aa, Artificial Sequence
  Synthetic
LKPGYSQ

SEQ ID NO: 12499 - protein, 7 aa, Artificial Sequence
  Synthetic
SKPGYSQ

SEQ ID NO: 12500 - protein, 7 aa, Artificial Sequence
  Synthetic
LRVGYSQ

SEQ ID NO: 12501 - protein, 7 aa, Artificial Sequence
  Synthetic
IRAGYSQ

SEQ ID NO: 12502 - protein, 7 aa, Artificial Sequence
  Synthetic
TRMGYST

SEQ ID NO: 12503 - protein, 7 aa, Artificial Sequence
  Synthetic
ERIGYSQ

SEQ ID NO: 12504 - protein, 7 aa, Artificial Sequence
  Synthetic
TKFGYSQ

SEQ ID NO: 12505 - protein, 7 aa, Artificial Sequence
  Synthetic
DRPGYSQ

SEQ ID NO: 12506 - protein, 7 aa, Artificial Sequence
  Synthetic
MRTGYSQ

SEQ ID NO: 12507 - protein, 7 aa, Artificial Sequence
  Synthetic
IRAGWSQ

SEQ ID NO: 12508 - protein, 7 aa, Artificial Sequence
  Synthetic
NRIGYSQ

SEQ ID NO: 12509 - protein, 7 aa, Artificial Sequence
  Synthetic
LKQGYSQ

SEQ ID NO: 12510 - protein, 7 aa, Artificial Sequence
  Synthetic
IRGGYSQ

SEQ ID NO: 12511 - protein, 7 aa, Artificial Sequence
  Synthetic
IKSGYSQ

SEQ ID NO: 12512 - protein, 7 aa, Artificial Sequence
  Synthetic
LRMGYST

SEQ ID NO: 12513 - protein, 7 aa, Artificial Sequence
  Synthetic
NKVGYAQ

SEQ ID NO: 12514 - protein, 7 aa, Artificial Sequence
  Synthetic
IKQGYSQ

SEQ ID NO: 12515 - protein, 7 aa, Artificial Sequence
  Synthetic
MRVGYSQ

SEQ ID NO: 12516 - protein, 7 aa, Artificial Sequence
  Synthetic
TRQGYST

SEQ ID NO: 12517 - protein, 7 aa, Artificial Sequence
  Synthetic
TKPGYSQ

SEQ ID NO: 12518 - protein, 7 aa, Artificial Sequence
  Synthetic
QRIGYSQ

SEQ ID NO: 12519 - protein, 7 aa, Artificial Sequence
  Synthetic
TKAGYST

SEQ ID NO: 12520 - protein, 7 aa, Artificial Sequence
  Synthetic
SKIGYSQ

SEQ ID NO: 12521 - protein, 7 aa, Artificial Sequence
  Synthetic
MKHGYSQ

SEQ ID NO: 12522 - protein, 7 aa, Artificial Sequence
  Synthetic
DRHGYSS

SEQ ID NO: 12523 - protein, 7 aa, Artificial Sequence
  Synthetic
FKHGYSQ

SEQ ID NO: 12524 - protein, 7 aa, Artificial Sequence
  Synthetic
LRIGYSQ

SEQ ID NO: 12525 - protein, 7 aa, Artificial Sequence
  Synthetic
MRPGYSQ

SEQ ID NO: 12526 - protein, 7 aa, Artificial Sequence
  Synthetic
VKTGYSQ

SEQ ID NO: 12527 - protein, 7 aa, Artificial Sequence
  Synthetic
MKIGYSQ

SEQ ID NO: 12528 - protein, 7 aa, Artificial Sequence
  Synthetic
VKPGYSQ

SEQ ID NO: 12529 - protein, 7 aa, Artificial Sequence
  Synthetic
LRTGYSQ

SEQ ID NO: 12530 - protein, 7 aa, Artificial Sequence
  Synthetic
TKYGYST

SEQ ID NO: 12531 - protein, 7 aa, Artificial Sequence
  Synthetic
TKAGYSS

SEQ ID NO: 12532 - protein, 7 aa, Artificial Sequence
  Synthetic
TRAGYSQ

SEQ ID NO: 12533 - protein, 7 aa, Artificial Sequence
  Synthetic
TKIGYSS

SEQ ID NO: 12534 - protein, 7 aa, Artificial Sequence
  Synthetic
LRAGYST

SEQ ID NO: 12535 - protein, 7 aa, Artificial Sequence
  Synthetic
TKPGYSQ

SEQ ID NO: 12536 - protein, 7 aa, Artificial Sequence
  Synthetic
TKIGYSQ

SEQ ID NO: 12537 - protein, 7 aa, Artificial Sequence
  Synthetic
IRQGYSQ

SEQ ID NO: 12538 - protein, 7 aa, Artificial Sequence
  Synthetic
MRTGYSS

SEQ ID NO: 12539 - protein, 7 aa, Artificial Sequence
  Synthetic
LKGGYSQ

SEQ ID NO: 12540 - protein, 7 aa, Artificial Sequence
  Synthetic
IKVGYSQ

SEQ ID NO: 12541 - protein, 7 aa, Artificial Sequence
  Synthetic
VRAGYSS

SEQ ID NO: 12542 - protein, 7 aa, Artificial Sequence
  Synthetic
LKTGYSQ

SEQ ID NO: 12543 - protein, 7 aa, Artificial Sequence
  Synthetic
TRIGYSQ

SEQ ID NO: 12544 - protein, 7 aa, Artificial Sequence
  Synthetic
LRHGYST

SEQ ID NO: 12545 - protein, 7 aa, Artificial Sequence
  Synthetic
SKYGYSQ

SEQ ID NO: 12546 - protein, 7 aa, Artificial Sequence
  Synthetic
TKTGYSQ

SEQ ID NO: 12547 - protein, 7 aa, Artificial Sequence
  Synthetic
MRQGYSQ

SEQ ID NO: 12548 - protein, 7 aa, Artificial Sequence
  Synthetic
MKMGYSQ

SEQ ID NO: 12549 - protein, 7 aa, Artificial Sequence
  Synthetic
LKQGYSQ

SEQ ID NO: 12550 - protein, 7 aa, Artificial Sequence
  Synthetic
MKTGYSQ

SEQ ID NO: 12551 - protein, 7 aa, Artificial Sequence
  Synthetic
MKVGYSQ

SEQ ID NO: 12552 - protein, 7 aa, Artificial Sequence
  Synthetic
LKMGYSQ

SEQ ID NO: 12553 - protein, 7 aa, Artificial Sequence
  Synthetic
FRAGYSQ

SEQ ID NO: 12554 - protein, 7 aa, Artificial Sequence
  Synthetic
LKSGWSA

SEQ ID NO: 12555 - protein, 7 aa, Artificial Sequence
  Synthetic
ILKGYAM

SEQ ID NO: 12556 - protein, 7 aa, Artificial Sequence
  Synthetic
VRQGYSQ

SEQ ID NO: 12557 - protein, 7 aa, Artificial Sequence
  Synthetic
DKHGYSQ

SEQ ID NO: 12558 - protein, 7 aa, Artificial Sequence
  Synthetic
LRMGYSQ

SEQ ID NO: 12559 - protein, 7 aa, Artificial Sequence
  Synthetic
LARGYST

SEQ ID NO: 12560 - protein, 7 aa, Artificial Sequence
  Synthetic
FKHGYSQ

SEQ ID NO: 12561 - protein, 7 aa, Artificial Sequence
  Synthetic
VKVGYSQ

SEQ ID NO: 12562 - protein, 7 aa, Artificial Sequence
  Synthetic
ERPGYSQ

SEQ ID NO: 12563 - protein, 7 aa, Artificial Sequence
  Synthetic
MKPGYSQ

SEQ ID NO: 12564 - protein, 7 aa, Artificial Sequence
  Synthetic
VKQGYSQ

SEQ ID NO: 12565 - protein, 7 aa, Artificial Sequence
  Synthetic
VKMGYSQ

SEQ ID NO: 12566 - protein, 7 aa, Artificial Sequence
  Synthetic
IRVGYSQ

SEQ ID NO: 12567 - protein, 7 aa, Artificial Sequence
  Synthetic
VKHGYSQ

SEQ ID NO: 12568 - protein, 7 aa, Artificial Sequence
  Synthetic
MKAGYSQ

SEQ ID NO: 12569 - protein, 7 aa, Artificial Sequence
  Synthetic
SRIGYSQ

SEQ ID NO: 12570 - protein, 7 aa, Artificial Sequence
  Synthetic
ILKGYAM

SEQ ID NO: 12571 - protein, 7 aa, Artificial Sequence
  Synthetic
TKHGYSQ

SEQ ID NO: 12572 - protein, 7 aa, Artificial Sequence
  Synthetic
QKPGYSQ

SEQ ID NO: 12573 - protein, 7 aa, Artificial Sequence
  Synthetic
IRAGYSS

SEQ ID NO: 12574 - protein, 7 aa, Artificial Sequence
  Synthetic
TKMGYSQ

SEQ ID NO: 12575 - protein, 7 aa, Artificial Sequence
  Synthetic
TKQGYST

SEQ ID NO: 12576 - protein, 7 aa, Artificial Sequence
  Synthetic
TRVGYST

SEQ ID NO: 12577 - protein, 7 aa, Artificial Sequence
  Synthetic
TKLGYSS

SEQ ID NO: 12578 - protein, 7 aa, Artificial Sequence
  Synthetic
TRTGYSS

SEQ ID NO: 12579 - protein, 7 aa, Artificial Sequence
  Synthetic
QKPGYSQ

SEQ ID NO: 12580 - protein, 7 aa, Artificial Sequence
  Synthetic
TRVGYSQ

SEQ ID NO: 12581 - protein, 7 aa, Artificial Sequence
  Synthetic
LKMGYSQ

SEQ ID NO: 12582 - protein, 7 aa, Artificial Sequence
  Synthetic
TKQGYSQ

SEQ ID NO: 12583 - protein, 7 aa, Artificial Sequence
  Synthetic
VNRGYSS

SEQ ID NO: 12584 - protein, 7 aa, Artificial Sequence
  Synthetic
NKYGYST

SEQ ID NO: 12585 - protein, 7 aa, Artificial Sequence
  Synthetic
QKIGYSQ

SEQ ID NO: 12586 - protein, 7 aa, Artificial Sequence
  Synthetic
IKPGYSQ

SEQ ID NO: 12587 - protein, 7 aa, Artificial Sequence
  Synthetic
ISRGMAQ

SEQ ID NO: 12588 - protein, 7 aa, Artificial Sequence
  Synthetic
MKQGYSQ

SEQ ID NO: 12589 - protein, 7 aa, Artificial Sequence
  Synthetic
IRQGYSQ

SEQ ID NO: 12590 - protein, 7 aa, Artificial Sequence
  Synthetic
LRLGYST

SEQ ID NO: 12591 - protein, 7 aa, Artificial Sequence
  Synthetic
TKFGYSS

SEQ ID NO: 12592 - protein, 7 aa, Artificial Sequence
  Synthetic
TKHGYST

SEQ ID NO: 12593 - protein, 7 aa, Artificial Sequence
  Synthetic
MKSGYSQ

SEQ ID NO: 12594 - protein, 7 aa, Artificial Sequence
  Synthetic
IRSGYSQ

SEQ ID NO: 12595 - protein, 7 aa, Artificial Sequence
  Synthetic
LRQGYSS

SEQ ID NO: 12596 - protein, 7 aa, Artificial Sequence
  Synthetic
LRAGYSQ

SEQ ID NO: 12597 - protein, 7 aa, Artificial Sequence
  Synthetic
TRSGYST

SEQ ID NO: 12598 - protein, 7 aa, Artificial Sequence
  Synthetic
TKHGYST

SEQ ID NO: 12599 - protein, 7 aa, Artificial Sequence
  Synthetic
TKAGYSS

SEQ ID NO: 12600 - protein, 7 aa, Artificial Sequence
  Synthetic
LRSGYSQ

SEQ ID NO: 12601 - protein, 7 aa, Artificial Sequence
  Synthetic
LRNGYSQ

SEQ ID NO: 12602 - protein, 7 aa, Artificial Sequence
  Synthetic
DKIGYSQ

SEQ ID NO: 12603 - protein, 7 aa, Artificial Sequence
  Synthetic
QRAGYSS

SEQ ID NO: 12604 - protein, 7 aa, Artificial Sequence
  Synthetic
IRHGYSS

SEQ ID NO: 12605 - protein, 7 aa, Artificial Sequence
  Synthetic
ERVGYSS

SEQ ID NO: 12606 - protein, 7 aa, Artificial Sequence
  Synthetic
FKHGYST

SEQ ID NO: 12607 - protein, 7 aa, Artificial Sequence
  Synthetic
MKIGYSQ

SEQ ID NO: 12608 - protein, 7 aa, Artificial Sequence
  Synthetic
LKYGYST

SEQ ID NO: 12609 - protein, 7 aa, Artificial Sequence
  Synthetic
SKVGYSQ

SEQ ID NO: 12610 - protein, 7 aa, Artificial Sequence
  Synthetic
TKAGYST

SEQ ID NO: 12611 - protein, 7 aa, Artificial Sequence
  Synthetic
MRAGYST

SEQ ID NO: 12612 - protein, 7 aa, Artificial Sequence
  Synthetic
QKHGYSQ

SEQ ID NO: 12613 - protein, 7 aa, Artificial Sequence
  Synthetic
FKTGYSQ

SEQ ID NO: 12614 - protein, 7 aa, Artificial Sequence
  Synthetic
TRQGYSQ

SEQ ID NO: 12615 - protein, 7 aa, Artificial Sequence
  Synthetic
QRAGYSS

SEQ ID NO: 12616 - protein, 7 aa, Artificial Sequence
  Synthetic
VKAGYST

SEQ ID NO: 12617 - protein, 7 aa, Artificial Sequence
  Synthetic
LRQGYSQ

SEQ ID NO: 12618 - protein, 7 aa, Artificial Sequence
  Synthetic
LRVGYSQ

SEQ ID NO: 12619 - protein, 7 aa, Artificial Sequence
  Synthetic
ERHGYSS

SEQ ID NO: 12620 - protein, 7 aa, Artificial Sequence
  Synthetic
ERVGYSQ

SEQ ID NO: 12621 - protein, 7 aa, Artificial Sequence
  Synthetic
VRPGYSQ

SEQ ID NO: 12622 - protein, 7 aa, Artificial Sequence
  Synthetic
LKFGYSQ

SEQ ID NO: 12623 - protein, 7 aa, Artificial Sequence
  Synthetic
EKIGYSS

SEQ ID NO: 12624 - protein, 7 aa, Artificial Sequence
  Synthetic
QKVGYSQ

SEQ ID NO: 12625 - protein, 7 aa, Artificial Sequence
  Synthetic
VKYGYSS

SEQ ID NO: 12626 - protein, 7 aa, Artificial Sequence
  Synthetic
TKHGYSS

SEQ ID NO: 12627 - protein, 7 aa, Artificial Sequence
  Synthetic
QKVGYSQ

SEQ ID NO: 12628 - protein, 7 aa, Artificial Sequence
  Synthetic
MRAGYST

SEQ ID NO: 12629 - protein, 7 aa, Artificial Sequence
  Synthetic
IRMGYSS

SEQ ID NO: 12630 - protein, 7 aa, Artificial Sequence
  Synthetic
WRTGYST

SEQ ID NO: 12631 - protein, 7 aa, Artificial Sequence
  Synthetic
IKQGYSS

SEQ ID NO: 12632 - protein, 7 aa, Artificial Sequence
  Synthetic
NKTGYSQ

SEQ ID NO: 12633 - protein, 7 aa, Artificial Sequence
  Synthetic
TNKGYST

SEQ ID NO: 12634 - protein, 7 aa, Artificial Sequence
  Synthetic
FKAGYST

SEQ ID NO: 12635 - protein, 7 aa, Artificial Sequence
  Synthetic
IKTGYSS

SEQ ID NO: 12636 - protein, 7 aa, Artificial Sequence
  Synthetic
TRPGYSQ

SEQ ID NO: 12637 - protein, 7 aa, Artificial Sequence
  Synthetic
TRPGYSQ

SEQ ID NO: 12638 - protein, 7 aa, Artificial Sequence
  Synthetic
VRIGYSQ

SEQ ID NO: 12639 - protein, 7 aa, Artificial Sequence
  Synthetic
VRAGYSQ

SEQ ID NO: 12640 - protein, 7 aa, Artificial Sequence
  Synthetic
VRQGYSQ

SEQ ID NO: 12641 - protein, 7 aa, Artificial Sequence
  Synthetic
VRVGYSS

SEQ ID NO: 12642 - protein, 7 aa, Artificial Sequence
  Synthetic
EKIGYSQ

SEQ ID NO: 12643 - protein, 7 aa, Artificial Sequence
  Synthetic
LKYGYSQ

SEQ ID NO: 12644 - protein, 7 aa, Artificial Sequence
  Synthetic
THQGYSS

SEQ ID NO: 12645 - protein, 7 aa, Artificial Sequence
  Synthetic
LKAGYSS

SEQ ID NO: 12646 - protein, 7 aa, Artificial Sequence
  Synthetic
NKIGYSS

SEQ ID NO: 12647 - protein, 7 aa, Artificial Sequence
  Synthetic
IRMGYST

SEQ ID NO: 12648 - protein, 7 aa, Artificial Sequence
  Synthetic
NKPGYSQ

SEQ ID NO: 12649 - protein, 7 aa, Artificial Sequence
  Synthetic
TKMGYST

SEQ ID NO: 12650 - protein, 7 aa, Artificial Sequence
  Synthetic
VKVGYSQ

SEQ ID NO: 12651 - protein, 7 aa, Artificial Sequence
  Synthetic
FKTGYSQ

SEQ ID NO: 12652 - protein, 7 aa, Artificial Sequence
  Synthetic
TRIGYST

SEQ ID NO: 12653 - protein, 7 aa, Artificial Sequence
  Synthetic
TRVGYSS

SEQ ID NO: 12654 - protein, 7 aa, Artificial Sequence
  Synthetic
IRIGYST

SEQ ID NO: 12655 - protein, 7 aa, Artificial Sequence
  Synthetic
ERQGYSQ

SEQ ID NO: 12656 - protein, 7 aa, Artificial Sequence
  Synthetic
QKAGYSQ

SEQ ID NO: 12657 - protein, 7 aa, Artificial Sequence
  Synthetic
ERIGYST

SEQ ID NO: 12658 - protein, 7 aa, Artificial Sequence
  Synthetic
VRVGYSQ

SEQ ID NO: 12659 - protein, 7 aa, Artificial Sequence
  Synthetic
LKLGYSQ

SEQ ID NO: 12660 - protein, 7 aa, Artificial Sequence
  Synthetic
EKSGYSQ

SEQ ID NO: 12661 - protein, 7 aa, Artificial Sequence
  Synthetic
SRPGYSQ

SEQ ID NO: 12662 - protein, 7 aa, Artificial Sequence
  Synthetic
LLKGYSQ

SEQ ID NO: 12663 - protein, 7 aa, Artificial Sequence
  Synthetic
EKVGYSQ

SEQ ID NO: 12664 - protein, 7 aa, Artificial Sequence
  Synthetic
MKAGYSS

SEQ ID NO: 12665 - protein, 7 aa, Artificial Sequence
  Synthetic
TRMGYSS

SEQ ID NO: 12666 - protein, 7 aa, Artificial Sequence
  Synthetic
WKTGYSQ

SEQ ID NO: 12667 - protein, 7 aa, Artificial Sequence
  Synthetic
TRTGYST

SEQ ID NO: 12668 - protein, 7 aa, Artificial Sequence
  Synthetic
QRIGYSS

SEQ ID NO: 12669 - protein, 7 aa, Artificial Sequence
  Synthetic
LRTGYST

SEQ ID NO: 12670 - protein, 7 aa, Artificial Sequence
  Synthetic
MRTGYSQ

SEQ ID NO: 12671 - protein, 7 aa, Artificial Sequence
  Synthetic
LRAGYSS

SEQ ID NO: 12672 - protein, 7 aa, Artificial Sequence
  Synthetic
MRVGYSS

SEQ ID NO: 12673 - protein, 7 aa, Artificial Sequence
  Synthetic
TKTGYSQ

SEQ ID NO: 12674 - protein, 7 aa, Artificial Sequence
  Synthetic
TKIGYST

SEQ ID NO: 12675 - protein, 7 aa, Artificial Sequence
  Synthetic
IKVGYSQ

SEQ ID NO: 12676 - protein, 7 aa, Artificial Sequence
  Synthetic
LRNGYSQ

SEQ ID NO: 12677 - protein, 7 aa, Artificial Sequence
  Synthetic
IRIGYST

SEQ ID NO: 12678 - protein, 7 aa, Artificial Sequence
  Synthetic
LKHGYSQ

SEQ ID NO: 12679 - protein, 7 aa, Artificial Sequence
  Synthetic
VKYGYSS

SEQ ID NO: 12680 - protein, 7 aa, Artificial Sequence
  Synthetic
NKFGYST

SEQ ID NO: 12681 - protein, 7 aa, Artificial Sequence
  Synthetic
VKFGYST

SEQ ID NO: 12682 - protein, 7 aa, Artificial Sequence
  Synthetic
TSKGYSS

SEQ ID NO: 12683 - protein, 7 aa, Artificial Sequence
  Synthetic
SARGYST

SEQ ID NO: 12684 - DNA, 21 bp, Artificial Sequence
  Synthetic
ccccgcatcggctactcacaa

SEQ ID NO: 12685 - DNA, 21 bp, Artificial Sequence
  Synthetic
gtgaggacggggtattcccag

SEQ ID NO: 12686 - DNA, 21 bp, Artificial Sequence
  Synthetic
atcaaggccggctactcacaa

SEQ ID NO: 12687 - DNA, 21 bp, Artificial Sequence
  Synthetic
acgaaatatgggtattcccag

SEQ ID NO: 12688 - DNA, 21 bp, Artificial Sequence
  Synthetic
acgaggttggggtattccacg

SEQ ID NO: 12689 - DNA, 21 bp, Artificial Sequence
  Synthetic
gagagggcggggtattcccag

SEQ ID NO: 12690 - DNA, 21 bp, Artificial Sequence
  Synthetic
ttgagggcggggtattcccag

SEQ ID NO: 12691 - DNA, 21 bp, Artificial Sequence
  Synthetic
ataaggacggggtattcccag

SEQ ID NO: 12692 - DNA, 21 bp, Artificial Sequence
  Synthetic
atccgcgtaggctactcacaa

SEQ ID NO: 12693 - DNA, 21 bp, Artificial Sequence
  Synthetic
acgcagagggggtattcctcc

SEQ ID NO: 12694 - DNA, 21 bp, Artificial Sequence
  Synthetic
atccgcaccggctactcacaa

SEQ ID NO: 12695 - DNA, 21 bp, Artificial Sequence
  Synthetic
cagagggcggggtattcccag

SEQ ID NO: 12696 - DNA, 21 bp, Artificial Sequence
  Synthetic
ctgaagaccggctactcacaa

SEQ ID NO: 12697 - DNA, 21 bp, Artificial Sequence
  Synthetic
ctgcgccatggctactcacaa

SEQ ID NO: 12698 - DNA, 21 bp, Artificial Sequence
  Synthetic
gtacgcgtaggctactcacaa

SEQ ID NO: 12699 - DNA, 21 bp, Artificial Sequence
  Synthetic
atccgccatggctactcacaa

SEQ ID NO: 12700 - DNA, 21 bp, Artificial Sequence
  Synthetic
cagaaaacggggtattcccag

SEQ ID NO: 12701 - DNA, 21 bp, Artificial Sequence
  Synthetic
ataaaacacgggtattcccag

SEQ ID NO: 12702 - DNA, 21 bp, Artificial Sequence
  Synthetic
aaatccgtggggtccgtgtat

SEQ ID NO: 12703 - DNA, 21 bp, Artificial Sequence
  Synthetic
ttgaaatccgggtattcccag

SEQ ID NO: 12704 - DNA, 21 bp, Artificial Sequence
  Synthetic
gtacgcgccggctactcacaa

SEQ ID NO: 12705 - DNA, 21 bp, Artificial Sequence
  Synthetic
ataaaagcggggtattcccag

SEQ ID NO: 12706 - DNA, 21 bp, Artificial Sequence
  Synthetic
atcatgcgcggctactcatca

SEQ ID NO: 12707 - DNA, 21 bp, Artificial Sequence
  Synthetic
atcaagaccggctactcacaa

SEQ ID NO: 12708 - DNA, 21 bp, Artificial Sequence
  Synthetic
ataagggcggggtggtcccag

SEQ ID NO: 12709 - DNA, 21 bp, Artificial Sequence
  Synthetic
gtgaaaacggggtattcccag

SEQ ID NO: 12710 - DNA, 21 bp, Artificial Sequence
  Synthetic
ttgaggcaggggtattcccag

SEQ ID NO: 12711 - DNA, 21 bp, Artificial Sequence
  Synthetic
gtaaagatgggctactcacaa

SEQ ID NO: 12712 - DNA, 21 bp, Artificial Sequence
  Synthetic
acgagggcggggtattccacg

SEQ ID NO: 12713 - DNA, 21 bp, Artificial Sequence
  Synthetic
ataatgagggggtattcctcc

SEQ ID NO: 12714 - DNA, 21 bp, Artificial Sequence
  Synthetic
atcaagcatggctactcatca

SEQ ID NO: 12715 - DNA, 21 bp, Artificial Sequence
  Synthetic
ataaggacggggtattcctcc

SEQ ID NO: 12716 - DNA, 21 bp, Artificial Sequence
  Synthetic
gataggatagggtattcccag

SEQ ID NO: 12717 - DNA, 21 bp, Artificial Sequence
  Synthetic
gtacgccaaggctactcatca

SEQ ID NO: 12718 - DNA, 21 bp, Artificial Sequence
  Synthetic
ctgaagtcaggctactcacaa

SEQ ID NO: 12719 - DNA, 21 bp, Artificial Sequence
  Synthetic
atgaagaccggctactcacaa

SEQ ID NO: 12720 - DNA, 21 bp, Artificial Sequence
  Synthetic
aagtcagtaggctcagtatac

SEQ ID NO: 12721 - DNA, 21 bp, Artificial Sequence
  Synthetic
gtgaggttggggtattcccag

SEQ ID NO: 12722 - DNA, 21 bp, Artificial Sequence
  Synthetic
cagaaatatgggtattccacg

SEQ ID NO: 12723 - DNA, 21 bp, Artificial Sequence
  Synthetic
gtgaaacacgggtattcccag

SEQ ID NO: 12724 - DNA, 21 bp, Artificial Sequence
  Synthetic
acgaaacaggggtattcccag

SEQ ID NO: 12725 - DNA, 21 bp, Artificial Sequence
  Synthetic
gtacgcaccggctactcacaa

SEQ ID NO: 12726 - DNA, 21 bp, Artificial Sequence
  Synthetic
ttgaggccggggtattcccag

SEQ ID NO: 12727 - DNA, 21 bp, Artificial Sequence
  Synthetic
atgaggatagggtattcccag

SEQ ID NO: 12728 - DNA, 21 bp, Artificial Sequence
  Synthetic
ctgaaggccggctactcacaa

SEQ ID NO: 12729 - DNA, 21 bp, Artificial Sequence
  Synthetic
atgaagcatggctactcacaa

SEQ ID NO: 12730 - DNA, 21 bp, Artificial Sequence
  Synthetic
atgcgccccggctactcacaa

SEQ ID NO: 12731 - DNA, 21 bp, Artificial Sequence
  Synthetic
caacgcaccggctactcacaa

SEQ ID NO: 12732 - DNA, 21 bp, Artificial Sequence
  Synthetic
gaacgcgtaggctactcacaa

SEQ ID NO: 12733 - DNA, 21 bp, Artificial Sequence
  Synthetic
gtaaagatcggctactcacaa

SEQ ID NO: 12734 - DNA, 21 bp, Artificial Sequence
  Synthetic
atgaaggccggctactcacaa

SEQ ID NO: 12735 - DNA, 21 bp, Artificial Sequence
  Synthetic
ataaaacaggggtattcccag

SEQ ID NO: 12736 - DNA, 21 bp, Artificial Sequence
  Synthetic
accaaggtaggctactcacaa

SEQ ID NO: 12737 - DNA, 21 bp, Artificial Sequence
  Synthetic
ataaaaacggggtattcccag

SEQ ID NO: 12738 - DNA, 21 bp, Artificial Sequence
  Synthetic
gagaaacacgggtattcccag

SEQ ID NO: 12739 - DNA, 21 bp, Artificial Sequence
  Synthetic
ttgaaagcggggtattcccag

SEQ ID NO: 12740 - DNA, 21 bp, Artificial Sequence
  Synthetic
caacgcgtaggctactcacaa

SEQ ID NO: 12741 - DNA, 21 bp, Artificial Sequence
  Synthetic
atgagggcggggtattcccag

SEQ ID NO: 12742 - DNA, 21 bp, Artificial Sequence
  Synthetic
acgaaagcggggtattcccag

SEQ ID NO: 12743 - DNA, 21 bp, Artificial Sequence
  Synthetic
gtgaaagcggggtattcccag

SEQ ID NO: 12744 - DNA, 21 bp, Artificial Sequence
  Synthetic
ttgaggttcgggtattccacg

SEQ ID NO: 12745 - DNA, 21 bp, Artificial Sequence
  Synthetic
acgagggcggggtattcccag

SEQ ID NO: 12746 - DNA, 21 bp, Artificial Sequence
  Synthetic
acccgccaaggctactcacaa

SEQ ID NO: 12747 - DNA, 21 bp, Artificial Sequence
  Synthetic
accaagtcaggctactcacaa

SEQ ID NO: 12748 - DNA, 21 bp, Artificial Sequence
  Synthetic
acgaaagtggggtattcccag

SEQ ID NO: 12749 - DNA, 21 bp, Artificial Sequence
  Synthetic
caacgccatggctactcacaa

SEQ ID NO: 12750 - DNA, 21 bp, Artificial Sequence
  Synthetic
ccgaggatagggtattcccag

SEQ ID NO: 12751 - DNA, 21 bp, Artificial Sequence
  Synthetic
atccgcgccggctactcacaa

SEQ ID NO: 12752 - DNA, 21 bp, Artificial Sequence
  Synthetic
gaaaagcatggctactcatca

SEQ ID NO: 12753 - DNA, 21 bp, Artificial Sequence
  Synthetic
ttgaggcacgggatgtcccag

SEQ ID NO: 12754 - DNA, 21 bp, Artificial Sequence
  Synthetic
caaaagtacggctactcacaa

SEQ ID NO: 12755 - DNA, 21 bp, Artificial Sequence
  Synthetic
gtgaaaatagggtattcccag

SEQ ID NO: 12756 - DNA, 21 bp, Artificial Sequence
  Synthetic
gagaggttggggtattccacg

SEQ ID NO: 12757 - DNA, 21 bp, Artificial Sequence
  Synthetic
atgcgcgtaggctactcacaa

SEQ ID NO: 12758 - DNA, 21 bp, Artificial Sequence
  Synthetic
caaaagcatggctactcacaa

SEQ ID NO: 12759 - DNA, 21 bp, Artificial Sequence
  Synthetic
gaacgcgccggctactcacaa

SEQ ID NO: 12760 - DNA, 21 bp, Artificial Sequence
  Synthetic
gcgaggatagggtattcccag

SEQ ID NO: 12761 - DNA, 21 bp, Artificial Sequence
  Synthetic
acgaaaatagggtattcccag

SEQ ID NO: 12762 - DNA, 21 bp, Artificial Sequence
  Synthetic
gaaaagtacggctactcaacc

SEQ ID NO: 12763 - DNA, 21 bp, Artificial Sequence
  Synthetic
gtaaagtacggctactcacaa

SEQ ID NO: 12764 - DNA, 21 bp, Artificial Sequence
  Synthetic
ataaaatccgggtattcccag

SEQ ID NO: 12765 - DNA, 21 bp, Artificial Sequence
  Synthetic
gagaaattggggtattcccag

SEQ ID NO: 12766 - DNA, 21 bp, Artificial Sequence
  Synthetic
gtgaaatccgggtattcccag

SEQ ID NO: 12767 - DNA, 21 bp, Artificial Sequence
  Synthetic
ttgaaaccggggtattcccag

SEQ ID NO: 12768 - DNA, 21 bp, Artificial Sequence
  Synthetic
tcaaagcccggctactcacaa

SEQ ID NO: 12769 - DNA, 21 bp, Artificial Sequence
  Synthetic
ctgcgcgtaggctactcacaa

SEQ ID NO: 12770 - DNA, 21 bp, Artificial Sequence
  Synthetic
ataagggcggggtattcccag

SEQ ID NO: 12771 - DNA, 21 bp, Artificial Sequence
  Synthetic
acgaggatggggtattccacg

SEQ ID NO: 12772 - DNA, 21 bp, Artificial Sequence
  Synthetic
gagaggatagggtattcccag

SEQ ID NO: 12773 - DNA, 21 bp, Artificial Sequence
  Synthetic
accaagtttggctactcacaa

SEQ ID NO: 12774 - DNA, 21 bp, Artificial Sequence
  Synthetic
gataggccggggtattcccag

SEQ ID NO: 12775 - DNA, 21 bp, Artificial Sequence
  Synthetic
atgaggacggggtattcccag

SEQ ID NO: 12776 - DNA, 21 bp, Artificial Sequence
  Synthetic
atccgcgccggctggtcacaa

SEQ ID NO: 12777 - DNA, 21 bp, Artificial Sequence
  Synthetic
aataggatagggtattcccag

SEQ ID NO: 12778 - DNA, 21 bp, Artificial Sequence
  Synthetic
ctgaagcaaggctactcacaa

SEQ ID NO: 12779 - DNA, 21 bp, Artificial Sequence
  Synthetic
atccgcggcggctactcacaa

SEQ ID NO: 12780 - DNA, 21 bp, Artificial Sequence
  Synthetic
atcaagtcaggctactcacaa

SEQ ID NO: 12781 - DNA, 21 bp, Artificial Sequence
  Synthetic
ttgaggatggggtattccacg

SEQ ID NO: 12782 - DNA, 21 bp, Artificial Sequence
  Synthetic
aacaaggtaggctacgcccaa

SEQ ID NO: 12783 - DNA, 21 bp, Artificial Sequence
  Synthetic
atcaagcaaggctactcacaa

SEQ ID NO: 12784 - DNA, 21 bp, Artificial Sequence
  Synthetic
atgagggtggggtattcccag

SEQ ID NO: 12785 - DNA, 21 bp, Artificial Sequence
  Synthetic
acgaggcaggggtattccacg

SEQ ID NO: 12786 - DNA, 21 bp, Artificial Sequence
  Synthetic
acgaaaccggggtattcccag

SEQ ID NO: 12787 - DNA, 21 bp, Artificial Sequence
  Synthetic
caacgcatcggctactcacaa

SEQ ID NO: 12788 - DNA, 21 bp, Artificial Sequence
  Synthetic
acgaaagcggggtattccacg

SEQ ID NO: 12789 - DNA, 21 bp, Artificial Sequence
  Synthetic
tcaaagatcggctactcacaa

SEQ ID NO: 12790 - DNA, 21 bp, Artificial Sequence
  Synthetic
atgaaacacgggtattcccag

SEQ ID NO: 12791 - DNA, 21 bp, Artificial Sequence
  Synthetic
gataggcacgggtattcctcc

SEQ ID NO: 12792 - DNA, 21 bp, Artificial Sequence
  Synthetic
tttaagcatggctactcacaa

SEQ ID NO: 12793 - DNA, 21 bp, Artificial Sequence
  Synthetic
ctgcgcatcggctactcacaa

SEQ ID NO: 12794 - DNA, 21 bp, Artificial Sequence
  Synthetic
atgaggccggggtattcccag

SEQ ID NO: 12795 - DNA, 21 bp, Artificial Sequence
  Synthetic
gtaaagaccggctactcacaa

SEQ ID NO: 12796 - DNA, 21 bp, Artificial Sequence
  Synthetic
atgaagatcggctactcacaa

SEQ ID NO: 12797 - DNA, 21 bp, Artificial Sequence
  Synthetic
gtgaaaccggggtattcccag

SEQ ID NO: 12798 - DNA, 21 bp, Artificial Sequence
  Synthetic
ttgaggacggggtattcccag

SEQ ID NO: 12799 - DNA, 21 bp, Artificial Sequence
  Synthetic
accaagtacggctactcaacc

SEQ ID NO: 12800 - DNA, 21 bp, Artificial Sequence
  Synthetic
accaaggccggctactcatca

SEQ ID NO: 12801 - DNA, 21 bp, Artificial Sequence
  Synthetic
acccgcgccggctactcacaa

SEQ ID NO: 12802 - DNA, 21 bp, Artificial Sequence
  Synthetic
accaagatcggctactcatca

SEQ ID NO: 12803 - DNA, 21 bp, Artificial Sequence
  Synthetic
ctgcgcgccggctactcaacc

SEQ ID NO: 12804 - DNA, 21 bp, Artificial Sequence
  Synthetic
accaagcccggctactcacaa

SEQ ID NO: 12805 - DNA, 21 bp, Artificial Sequence
  Synthetic
accaagatcggctactcacaa

SEQ ID NO: 12806 - DNA, 21 bp, Artificial Sequence
  Synthetic
atccgccaaggctactcacaa

SEQ ID NO: 12807 - DNA, 21 bp, Artificial Sequence
  Synthetic
atgcgcaccggctactcatca

SEQ ID NO: 12808 - DNA, 21 bp, Artificial Sequence
  Synthetic
ttgaaaggggggtattcccag

SEQ ID NO: 12809 - DNA, 21 bp, Artificial Sequence
  Synthetic
atcaaggtaggctactcacaa

SEQ ID NO: 12810 - DNA, 21 bp, Artificial Sequence
  Synthetic
gtgagggcggggtattcctcc

SEQ ID NO: 12811 - DNA, 21 bp, Artificial Sequence
  Synthetic
ttgaaaacggggtattcccag

SEQ ID NO: 12812 - DNA, 21 bp, Artificial Sequence
  Synthetic
acgaggatagggtattcccag

SEQ ID NO: 12813 - DNA, 21 bp, Artificial Sequence
  Synthetic
ctgcgccatggctactcaacc

SEQ ID NO: 12814 - DNA, 21 bp, Artificial Sequence
  Synthetic
tcaaagtacggctactcacaa

SEQ ID NO: 12815 - DNA, 21 bp, Artificial Sequence
  Synthetic
acgaaaacggggtattcccag

SEQ ID NO: 12816 - DNA, 21 bp, Artificial Sequence
  Synthetic
atgcgccaaggctactcacaa

SEQ ID NO: 12817 - DNA, 21 bp, Artificial Sequence
  Synthetic
atgaaaatggggtattcccag

SEQ ID NO: 12818 - DNA, 21 bp, Artificial Sequence
  Synthetic
ttgaaacaggggtattcccag

SEQ ID NO: 12819 - DNA, 21 bp, Artificial Sequence
  Synthetic
atgaaaacggggtattcccag

SEQ ID NO: 12820 - DNA, 21 bp, Artificial Sequence
  Synthetic
atgaaggtaggctactcacaa

SEQ ID NO: 12821 - DNA, 21 bp, Artificial Sequence
  Synthetic
ctgaagatgggctactcacaa

SEQ ID NO: 12822 - DNA, 21 bp, Artificial Sequence
  Synthetic
tttcgcgccggctactcacaa

SEQ ID NO: 12823 - DNA, 21 bp, Artificial Sequence
  Synthetic
ttgaaatccgggtggtccgcg

SEQ ID NO: 12824 - DNA, 21 bp, Artificial Sequence
  Synthetic
atcctgaagggctacgccatg

SEQ ID NO: 12825 - DNA, 21 bp, Artificial Sequence
  Synthetic
gtgaggcaggggtattcccag

SEQ ID NO: 12826 - DNA, 21 bp, Artificial Sequence
  Synthetic
gacaagcatggctactcacaa

SEQ ID NO: 12827 - DNA, 21 bp, Artificial Sequence
  Synthetic
ctgcgcatgggctactcacaa

SEQ ID NO: 12828 - DNA, 21 bp, Artificial Sequence
  Synthetic
ttggcgagggggtattccacg

SEQ ID NO: 12829 - DNA, 21 bp, Artificial Sequence
  Synthetic
ttcaaacacgggtattcccag

SEQ ID NO: 12830 - DNA, 21 bp, Artificial Sequence
  Synthetic
gtaaaggtaggctactcacaa

SEQ ID NO: 12831 - DNA, 21 bp, Artificial Sequence
  Synthetic
gagaggccggggtattcccag

SEQ ID NO: 12832 - DNA, 21 bp, Artificial Sequence
  Synthetic
atgaaaccggggtattcccag

SEQ ID NO: 12833 - DNA, 21 bp, Artificial Sequence
  Synthetic
gtgaaacaggggtattcccag

SEQ ID NO: 12834 - DNA, 21 bp, Artificial Sequence
  Synthetic
gtgaaaatggggtattcccag

SEQ ID NO: 12835 - DNA, 21 bp, Artificial Sequence
  Synthetic
ataagggtggggtattcccag

SEQ ID NO: 12836 - DNA, 21 bp, Artificial Sequence
  Synthetic
gtaaagcatggctactcacaa

SEQ ID NO: 12837 - DNA, 21 bp, Artificial Sequence
  Synthetic
atgaaagcggggtattcccag

SEQ ID NO: 12838 - DNA, 21 bp, Artificial Sequence
  Synthetic
tccaggatagggtattcccag

SEQ ID NO: 12839 - DNA, 21 bp, Artificial Sequence
  Synthetic
atattgaaagggtatgcgatg

SEQ ID NO: 12840 - DNA, 21 bp, Artificial Sequence
  Synthetic
acgaaacacgggtattcccag

SEQ ID NO: 12841 - DNA, 21 bp, Artificial Sequence
  Synthetic
caaaagcccggctactcacaa

SEQ ID NO: 12842 - DNA, 21 bp, Artificial Sequence
  Synthetic
ataagggcggggtattcctcc

SEQ ID NO: 12843 - DNA, 21 bp, Artificial Sequence
  Synthetic
accaagatgggctactcacaa

SEQ ID NO: 12844 - DNA, 21 bp, Artificial Sequence
  Synthetic
accaagcaaggctactcaacc

SEQ ID NO: 12845 - DNA, 21 bp, Artificial Sequence
  Synthetic
acgagggtggggtattccacg

SEQ ID NO: 12846 - DNA, 21 bp, Artificial Sequence
  Synthetic
acgaaattggggtattcctcc

SEQ ID NO: 12847 - DNA, 21 bp, Artificial Sequence
  Synthetic
acgaggacggggtattcctcc

SEQ ID NO: 12848 - DNA, 21 bp, Artificial Sequence
  Synthetic
cagaaaccggggtattcccag

SEQ ID NO: 12849 - DNA, 21 bp, Artificial Sequence
  Synthetic
acccgcgtaggctactcacaa

SEQ ID NO: 12850 - DNA, 21 bp, Artificial Sequence
  Synthetic
ttgaaaatggggtattcccag

SEQ ID NO: 12851 - DNA, 21 bp, Artificial Sequence
  Synthetic
accaagcaaggctactcacaa

SEQ ID NO: 12852 - DNA, 21 bp, Artificial Sequence
  Synthetic
gtgaatagggggtattcctcc

SEQ ID NO: 12853 - DNA, 21 bp, Artificial Sequence
  Synthetic
aataaatatgggtattccacg

SEQ ID NO: 12854 - DNA, 21 bp, Artificial Sequence
  Synthetic
cagaaaatagggtattcccag

SEQ ID NO: 12855 - DNA, 21 bp, Artificial Sequence
  Synthetic
atcaagcccggctactcacaa

SEQ ID NO: 12856 - DNA, 21 bp, Artificial Sequence
  Synthetic
atatccagggggatggcgcag

SEQ ID NO: 12857 - DNA, 21 bp, Artificial Sequence
  Synthetic
atgaagcaaggctactcacaa

SEQ ID NO: 12858 - DNA, 21 bp, Artificial Sequence
  Synthetic
ataaggcaggggtattcccag

SEQ ID NO: 12859 - DNA, 21 bp, Artificial Sequence
  Synthetic
ttgaggttggggtattccacg

SEQ ID NO: 12860 - DNA, 21 bp, Artificial Sequence
  Synthetic
acgaaattcgggtattcctcc

SEQ ID NO: 12861 - DNA, 21 bp, Artificial Sequence
  Synthetic
accaagcatggctactcaacc

SEQ ID NO: 12862 - DNA, 21 bp, Artificial Sequence
  Synthetic
atgaagtcaggctactcacaa

SEQ ID NO: 12863 - DNA, 21 bp, Artificial Sequence
  Synthetic
ataaggtccgggtattcccag

SEQ ID NO: 12864 - DNA, 21 bp, Artificial Sequence
  Synthetic
ctgcgccaaggctactcatca

SEQ ID NO: 12865 - DNA, 21 bp, Artificial Sequence
  Synthetic
ctgcgcgccggctactcacaa

SEQ ID NO: 12866 - DNA, 21 bp, Artificial Sequence
  Synthetic
acgaggtccgggtattccacg

SEQ ID NO: 12867 - DNA, 21 bp, Artificial Sequence
  Synthetic
acgaaacacgggtattccacg

SEQ ID NO: 12868 - DNA, 21 bp, Artificial Sequence
  Synthetic
acgaaagcggggtattcctcc

SEQ ID NO: 12869 - DNA, 21 bp, Artificial Sequence
  Synthetic
ttgaggtccgggtattcccag

SEQ ID NO: 12870 - DNA, 21 bp, Artificial Sequence
  Synthetic
ctgcgcaacggctactcacaa

SEQ ID NO: 12871 - DNA, 21 bp, Artificial Sequence
  Synthetic
gataaaatagggtattcccag

SEQ ID NO: 12872 - DNA, 21 bp, Artificial Sequence
  Synthetic
caacgcgccggctactcatca

SEQ ID NO: 12873 - DNA, 21 bp, Artificial Sequence
  Synthetic
atccgccatggctactcatca

SEQ ID NO: 12874 - DNA, 21 bp, Artificial Sequence
  Synthetic
gagagggtggggtattcctcc

SEQ ID NO: 12875 - DNA, 21 bp, Artificial Sequence
  Synthetic
tttaagcatggctactcaacc

SEQ ID NO: 12876 - DNA, 21 bp, Artificial Sequence
  Synthetic
atgaaaatagggtattcccag

SEQ ID NO: 12877 - DNA, 21 bp, Artificial Sequence
  Synthetic
ctgaagtacggctactcaacc

SEQ ID NO: 12878 - DNA, 21 bp, Artificial Sequence
  Synthetic
tcaaaggtaggctactcacaa

SEQ ID NO: 12879 - DNA, 21 bp, Artificial Sequence
  Synthetic
accaaggccggctactcaacc

SEQ ID NO: 12880 - DNA, 21 bp, Artificial Sequence
  Synthetic
atgagggcggggtattccacg

SEQ ID NO: 12881 - DNA, 21 bp, Artificial Sequence
  Synthetic
cagaaacacgggtattcccag

SEQ ID NO: 12882 - DNA, 21 bp, Artificial Sequence
  Synthetic
tttaagaccggctactcacaa

SEQ ID NO: 12883 - DNA, 21 bp, Artificial Sequence
  Synthetic
acgaggcaggggtattcccag

SEQ ID NO: 12884 - DNA, 21 bp, Artificial Sequence
  Synthetic
cagagggcggggtattcctcc

SEQ ID NO: 12885 - DNA, 21 bp, Artificial Sequence
  Synthetic
gtgaaagcggggtattccacg

SEQ ID NO: 12886 - DNA, 21 bp, Artificial Sequence
  Synthetic
ctgcgccaaggctactcacaa

SEQ ID NO: 12887 - DNA, 21 bp, Artificial Sequence
  Synthetic
ttgagggtggggtattcccag

SEQ ID NO: 12888 - DNA, 21 bp, Artificial Sequence
  Synthetic
gaacgccatggctactcatca

SEQ ID NO: 12889 - DNA, 21 bp, Artificial Sequence
  Synthetic
gagagggtggggtattcccag

SEQ ID NO: 12890 - DNA, 21 bp, Artificial Sequence
  Synthetic
gtacgccccggctactcacaa

SEQ ID NO: 12891 - DNA, 21 bp, Artificial Sequence
  Synthetic
ttgaaattcgggtattcccag

SEQ ID NO: 12892 - DNA, 21 bp, Artificial Sequence
  Synthetic
gagaaaatagggtattcctcc

SEQ ID NO: 12893 - DNA, 21 bp, Artificial Sequence
  Synthetic
cagaaagtggggtattcccag

SEQ ID NO: 12894 - DNA, 21 bp, Artificial Sequence
  Synthetic
gtgaaatatgggtattcctcc

SEQ ID NO: 12895 - DNA, 21 bp, Artificial Sequence
  Synthetic
accaagcatggctactcatca

SEQ ID NO: 12896 - DNA, 21 bp, Artificial Sequence
  Synthetic
caaaaggtaggctactcacaa

SEQ ID NO: 12897 - DNA, 21 bp, Artificial Sequence
  Synthetic
atgcgcgccggctactcaacc

SEQ ID NO: 12898 - DNA, 21 bp, Artificial Sequence
  Synthetic
atccgcatgggctactcatca

SEQ ID NO: 12899 - DNA, 21 bp, Artificial Sequence
  Synthetic
tggaggacggggtattccacg

SEQ ID NO: 12900 - DNA, 21 bp, Artificial Sequence
  Synthetic
ataaaacaggggtattcctcc

SEQ ID NO: 12901 - DNA, 21 bp, Artificial Sequence
  Synthetic
aataaaacggggtattcccag

SEQ ID NO: 12902 - DNA, 21 bp, Artificial Sequence
  Synthetic
acgaataaagggtattccacg

SEQ ID NO: 12903 - DNA, 21 bp, Artificial Sequence
  Synthetic
tttaaggccggctactcaacc

SEQ ID NO: 12904 - DNA, 21 bp, Artificial Sequence
  Synthetic
ataaaaacggggtattcctcc

SEQ ID NO: 12905 - DNA, 21 bp, Artificial Sequence
  Synthetic
acccgccccggctactcacaa

SEQ ID NO: 12906 - DNA, 21 bp, Artificial Sequence
  Synthetic
acgaggccggggtattcccag

SEQ ID NO: 12907 - DNA, 21 bp, Artificial Sequence
  Synthetic
gtacgcatcggctactcacaa

SEQ ID NO: 12908 - DNA, 21 bp, Artificial Sequence
  Synthetic
gtgagggcggggtattcccag

SEQ ID NO: 12909 - DNA, 21 bp, Artificial Sequence
  Synthetic
gtacgccaaggctactcacaa

SEQ ID NO: 12910 - DNA, 21 bp, Artificial Sequence
  Synthetic
gtgagggtggggtattcctcc

SEQ ID NO: 12911 - DNA, 21 bp, Artificial Sequence
  Synthetic
gagaaaatagggtattcccag

SEQ ID NO: 12912 - DNA, 21 bp, Artificial Sequence
  Synthetic
ctgaagtacggctactcacaa

SEQ ID NO: 12913 - DNA, 21 bp, Artificial Sequence
  Synthetic
acccatcaaggctactcatca

SEQ ID NO: 12914 - DNA, 21 bp, Artificial Sequence
  Synthetic
ttgaaagcggggtattcctcc

SEQ ID NO: 12915 - DNA, 21 bp, Artificial Sequence
  Synthetic
aataaaatagggtattcctcc

SEQ ID NO: 12916 - DNA, 21 bp, Artificial Sequence
  Synthetic
ataaggatggggtattccacg

SEQ ID NO: 12917 - DNA, 21 bp, Artificial Sequence
  Synthetic
aataaaccggggtattcccag

SEQ ID NO: 12918 - DNA, 21 bp, Artificial Sequence
  Synthetic
acgaaaatggggtattccacg

SEQ ID NO: 12919 - DNA, 21 bp, Artificial Sequence
  Synthetic
gtgaaagtggggtattcccag

SEQ ID NO: 12920 - DNA, 21 bp, Artificial Sequence
  Synthetic
ttcaaaacggggtattcccag

SEQ ID NO: 12921 - DNA, 21 bp, Artificial Sequence
  Synthetic
acgaggatagggtattccacg

SEQ ID NO: 12922 - DNA, 21 bp, Artificial Sequence
  Synthetic
acccgcgtaggctactcatca

SEQ ID NO: 12923 - DNA, 21 bp, Artificial Sequence
  Synthetic
atccgcatcggctactcaacc

SEQ ID NO: 12924 - DNA, 21 bp, Artificial Sequence
  Synthetic
gaacgccaaggctactcacaa

SEQ ID NO: 12925 - DNA, 21 bp, Artificial Sequence
  Synthetic
cagaaagcggggtattcccag

SEQ ID NO: 12926 - DNA, 21 bp, Artificial Sequence
  Synthetic
gagaggatagggtattccacg

SEQ ID NO: 12927 - DNA, 21 bp, Artificial Sequence
  Synthetic
gtgagggtggggtattcccag

SEQ ID NO: 12928 - DNA, 21 bp, Artificial Sequence
  Synthetic
ctgaagctgggctactcacaa

SEQ ID NO: 12929 - DNA, 21 bp, Artificial Sequence
  Synthetic
gaaaagtcaggctactcacaa

SEQ ID NO: 12930 - DNA, 21 bp, Artificial Sequence
  Synthetic
tcacgccccggctactcacaa

SEQ ID NO: 12931 - DNA, 21 bp, Artificial Sequence
  Synthetic
ttgttgaaagggtattcccag

SEQ ID NO: 12932 - DNA, 21 bp, Artificial Sequence
  Synthetic
gagaaagtggggtattcccag

SEQ ID NO: 12933 - DNA, 21 bp, Artificial Sequence
  Synthetic
atgaaggccggctactcatca

SEQ ID NO: 12934 - DNA, 21 bp, Artificial Sequence
  Synthetic
acgaggatggggtattcctcc

SEQ ID NO: 12935 - DNA, 21 bp, Artificial Sequence
  Synthetic
tggaagaccggctactcacaa

SEQ ID NO: 12936 - DNA, 21 bp, Artificial Sequence
  Synthetic
acgaggacggggtattccacg

SEQ ID NO: 12937 - DNA, 21 bp, Artificial Sequence
  Synthetic
cagaggatagggtattcctcc

SEQ ID NO: 12938 - DNA, 21 bp, Artificial Sequence
  Synthetic
ctgcgcaccggctactcaacc

SEQ ID NO: 12939 - DNA, 21 bp, Artificial Sequence
  Synthetic
atgcgcaccggctactcacaa

SEQ ID NO: 12940 - DNA, 21 bp, Artificial Sequence
  Synthetic
ctgcgcgccggctactcatca

SEQ ID NO: 12941 - DNA, 21 bp, Artificial Sequence
  Synthetic
atgcgcgtaggctactcatca

SEQ ID NO: 12942 - DNA, 21 bp, Artificial Sequence
  Synthetic
accaagaccggctactcacaa

SEQ ID NO: 12943 - DNA, 21 bp, Artificial Sequence
  Synthetic
acgaaaatagggtattccacg

SEQ ID NO: 12944 - DNA, 21 bp, Artificial Sequence
  Synthetic
ataaaagtggggtattcccag

SEQ ID NO: 12945 - DNA, 21 bp, Artificial Sequence
  Synthetic
ttgaggaatgggtattcccag

SEQ ID NO: 12946 - DNA, 21 bp, Artificial Sequence
  Synthetic
ataaggatagggtattccacg

SEQ ID NO: 12947 - DNA, 21 bp, Artificial Sequence
  Synthetic
ctgaagcatggctactcacaa

SEQ ID NO: 12948 - DNA, 21 bp, Artificial Sequence
  Synthetic
gtaaagtacggctactcatca

SEQ ID NO: 12949 - DNA, 21 bp, Artificial Sequence
  Synthetic
aacaagtttggctactcaacc

SEQ ID NO: 12950 - DNA, 21 bp, Artificial Sequence
  Synthetic
gtgaaattcgggtattccacg

SEQ ID NO: 12951 - DNA, 21 bp, Artificial Sequence
  Synthetic
acgtccaaagggtattcctcc

SEQ ID NO: 12952 - DNA, 21 bp, Artificial Sequence
  Synthetic
tcagcccgcggctactcaacc

SEQ ID NO: 12953 - protein, 7 aa, Artificial Sequence
  Synthetic
TVPLGSA

SEQ ID NO: 12954 - protein, 7 aa, Artificial Sequence
  Synthetic
GLLVGYG

SEQ ID NO: 12955 - protein, 7 aa, Artificial Sequence
  Synthetic
GSEIGRW

SEQ ID NO: 12956 - protein, 7 aa, Artificial Sequence
  Synthetic
GEHAGVW

SEQ ID NO: 12957 - protein, 7 aa, Artificial Sequence
  Synthetic
GGSFWKE

SEQ ID NO: 12958 - protein, 7 aa, Artificial Sequence
  Synthetic
VLIGRVG

SEQ ID NO: 12959 - protein, 7 aa, Artificial Sequence
  Synthetic
MYGGGST

SEQ ID NO: 12960 - protein, 7 aa, Artificial Sequence
  Synthetic
GVGEGRW

SEQ ID NO: 12961 - protein, 7 aa, Artificial Sequence
  Synthetic
PRIGYSA

SEQ ID NO: 12962 - protein, 7 aa, Artificial Sequence
  Synthetic
PWPGSSV

SEQ ID NO: 12963 - protein, 7 aa, Artificial Sequence
  Synthetic
RWERDAA

SEQ ID NO: 12964 - protein, 7 aa, Artificial Sequence
  Synthetic
SVPYMAS

SEQ ID NO: 12965 - protein, 7 aa, Artificial Sequence
  Synthetic
LKYGLSS

SEQ ID NO: 12966 - protein, 7 aa, Artificial Sequence
  Synthetic
GPHPGQW

SEQ ID NO: 12967 - protein, 7 aa, Artificial Sequence
  Synthetic
KPNSGVW

SEQ ID NO: 12968 - protein, 7 aa, Artificial Sequence
  Synthetic
LKLGYST

SEQ ID NO: 12969 - protein, 7 aa, Artificial Sequence
  Synthetic
LRLGGAQ

SEQ ID NO: 12970 - protein, 7 aa, Artificial Sequence
  Synthetic
DEWRGSS

SEQ ID NO: 12971 - protein, 7 aa, Artificial Sequence
  Synthetic
RAPGYSM

SEQ ID NO: 12972 - protein, 7 aa, Artificial Sequence
  Synthetic
WPLLMKD

SEQ ID NO: 12973 - protein, 7 aa, Artificial Sequence
  Synthetic
GNDTGRW

SEQ ID NO: 12974 - protein, 7 aa, Artificial Sequence
  Synthetic
PWQGAAS

SEQ ID NO: 12975 - protein, 7 aa, Artificial Sequence
  Synthetic
ERSHFSS

SEQ ID NO: 12976 - protein, 7 aa, Artificial Sequence
  Synthetic
GPVEGRW

SEQ ID NO: 12977 - protein, 7 aa, Artificial Sequence
  Synthetic
SEWKGSA

SEQ ID NO: 12978 - protein, 7 aa, Artificial Sequence
  Synthetic
WALGGST

SEQ ID NO: 12979 - protein, 7 aa, Artificial Sequence
  Synthetic
LNYGHSQ

SEQ ID NO: 12980 - protein, 7 aa, Artificial Sequence
  Synthetic
RFAGDSV

SEQ ID NO: 12981 - protein, 7 aa, Artificial Sequence
  Synthetic
IRIAESS

SEQ ID NO: 12982 - protein, 7 aa, Artificial Sequence
  Synthetic
VLGFRLG

SEQ ID NO: 12983 - protein, 7 aa, Artificial Sequence
  Synthetic
PHPHMSA

SEQ ID NO: 12984 - protein, 7 aa, Artificial Sequence
  Synthetic
AGMPGPW

SEQ ID NO: 12985 - protein, 7 aa, Artificial Sequence
  Synthetic
PRIGAAQ

SEQ ID NO: 12986 - protein, 7 aa, Artificial Sequence
  Synthetic
VKYHVDV

SEQ ID NO: 12987 - protein, 7 aa, Artificial Sequence
  Synthetic
VLVGRQG

SEQ ID NO: 12988 - protein, 7 aa, Artificial Sequence
  Synthetic
GTSLGPW

SEQ ID NO: 12989 - protein, 7 aa, Artificial Sequence
  Synthetic
GDVIGRW

SEQ ID NO: 12990 - protein, 7 aa, Artificial Sequence
  Synthetic
DYRLGST

SEQ ID NO: 12991 - protein, 7 aa, Artificial Sequence
  Synthetic
LAVGQIW

SEQ ID NO: 12992 - protein, 7 aa, Artificial Sequence
  Synthetic
IMRGYAV

SEQ ID NO: 12993 - protein, 7 aa, Artificial Sequence
  Synthetic
LLIHGSS

SEQ ID NO: 12994 - protein, 7 aa, Artificial Sequence
  Synthetic
LRAGYSV

SEQ ID NO: 12995 - protein, 7 aa, Artificial Sequence
  Synthetic
MVGFGSS

SEQ ID NO: 12996 - protein, 7 aa, Artificial Sequence
  Synthetic
AGYNSSY

SEQ ID NO: 12997 - protein, 7 aa, Artificial Sequence
  Synthetic
AAFKLPT

SEQ ID NO: 12998 - protein, 7 aa, Artificial Sequence
  Synthetic
EKQYFSA

SEQ ID NO: 12999 - protein, 7 aa, Artificial Sequence
  Synthetic
DGWAGSS

SEQ ID NO: 13000 - protein, 7 aa, Artificial Sequence
  Synthetic
LSMGFSQ

SEQ ID NO: 13001 - protein, 7 aa, Artificial Sequence
  Synthetic
LILKAFP

SEQ ID NO: 13002 - protein, 7 aa, Artificial Sequence
  Synthetic
WSIGREG

SEQ ID NO: 13003 - protein, 7 aa, Artificial Sequence
  Synthetic
VRFEGAS

SEQ ID NO: 13004 - protein, 7 aa, Artificial Sequence
  Synthetic
VIPGMSQ

SEQ ID NO: 13005 - protein, 7 aa, Artificial Sequence
  Synthetic
AREYGST

SEQ ID NO: 13006 - protein, 7 aa, Artificial Sequence
  Synthetic
WLLSEGY

SEQ ID NO: 13007 - protein, 7 aa, Artificial Sequence
  Synthetic
LRAGTVY

SEQ ID NO: 13008 - protein, 7 aa, Artificial Sequence
  Synthetic
GVHPGVW

SEQ ID NO: 13009 - protein, 7 aa, Artificial Sequence
  Synthetic
PFPGFSA

SEQ ID NO: 13010 - protein, 7 aa, Artificial Sequence
  Synthetic
DGSSRWN

SEQ ID NO: 13011 - protein, 7 aa, Artificial Sequence
  Synthetic
EARGWST

SEQ ID NO: 13012 - protein, 7 aa, Artificial Sequence
  Synthetic
PRVNYSA

SEQ ID NO: 13013 - protein, 7 aa, Artificial Sequence
  Synthetic
FSHGYST

SEQ ID NO: 13014 - protein, 7 aa, Artificial Sequence
  Synthetic
EGFGRSQ

SEQ ID NO: 13015 - protein, 7 aa, Artificial Sequence
  Synthetic
IDRGYSV

SEQ ID NO: 13016 - protein, 7 aa, Artificial Sequence
  Synthetic
PYTHMAS

SEQ ID NO: 13017 - protein, 7 aa, Artificial Sequence
  Synthetic
MITLGSA

SEQ ID NO: 13018 - protein, 7 aa, Artificial Sequence
  Synthetic
YRVLGSA

SEQ ID NO: 13019 - protein, 7 aa, Artificial Sequence
  Synthetic
DARWSAA

SEQ ID NO: 13020 - protein, 7 aa, Artificial Sequence
  Synthetic
ETWRGSV

SEQ ID NO: 13021 - protein, 7 aa, Artificial Sequence
  Synthetic
LKPGWAQ

SEQ ID NO: 13022 - protein, 7 aa, Artificial Sequence
  Synthetic
YVSLPKV

SEQ ID NO: 13023 - protein, 7 aa, Artificial Sequence
  Synthetic
LYPGLSS

SEQ ID NO: 13024 - protein, 7 aa, Artificial Sequence
  Synthetic
EVHRMPF

SEQ ID NO: 13025 - protein, 7 aa, Artificial Sequence
  Synthetic
GTSPGAW

SEQ ID NO: 13026 - protein, 7 aa, Artificial Sequence
  Synthetic
INYSQAL

SEQ ID NO: 13027 - protein, 7 aa, Artificial Sequence
  Synthetic
WDVSTGY

SEQ ID NO: 13028 - protein, 7 aa, Artificial Sequence
  Synthetic
GEWRGSV

SEQ ID NO: 13029 - protein, 7 aa, Artificial Sequence
  Synthetic
MYSLGAG

SEQ ID NO: 13030 - protein, 7 aa, Artificial Sequence
  Synthetic
DPGTVRW

SEQ ID NO: 13031 - protein, 7 aa, Artificial Sequence
  Synthetic
WKLSGSQ

SEQ ID NO: 13032 - protein, 7 aa, Artificial Sequence
  Synthetic
LLHGYTV

SEQ ID NO: 13033 - protein, 7 aa, Artificial Sequence
  Synthetic
DRIYGSA

SEQ ID NO: 13034 - protein, 7 aa, Artificial Sequence
  Synthetic
LRPGWAQ

SEQ ID NO: 13035 - protein, 7 aa, Artificial Sequence
  Synthetic
LSFHGST

SEQ ID NO: 13036 - protein, 7 aa, Artificial Sequence
  Synthetic
TKLGFSQ

SEQ ID NO: 13037 - protein, 7 aa, Artificial Sequence
  Synthetic
PMRGFSS

SEQ ID NO: 13038 - protein, 7 aa, Artificial Sequence
  Synthetic
SVTNRFN

SEQ ID NO: 13039 - protein, 7 aa, Artificial Sequence
  Synthetic
WKIETGY

SEQ ID NO: 13040 - protein, 7 aa, Artificial Sequence
  Synthetic
PSANWAS

SEQ ID NO: 13041 - protein, 7 aa, Artificial Sequence
  Synthetic
WGSPPHS

SEQ ID NO: 13042 - protein, 7 aa, Artificial Sequence
  Synthetic
QAAGWSS

SEQ ID NO: 13043 - protein, 7 aa, Artificial Sequence
  Synthetic
LIRGMSS

SEQ ID NO: 13044 - protein, 7 aa, Artificial Sequence
  Synthetic
EMRYGST

SEQ ID NO: 13045 - protein, 7 aa, Artificial Sequence
  Synthetic
DKYMGSV

SEQ ID NO: 13046 - protein, 7 aa, Artificial Sequence
  Synthetic
RFLGEPS

SEQ ID NO: 13047 - protein, 7 aa, Artificial Sequence
  Synthetic
KAVGSSW

SEQ ID NO: 13048 - protein, 7 aa, Artificial Sequence
  Synthetic
MFAGQSS

SEQ ID NO: 13049 - protein, 7 aa, Artificial Sequence
  Synthetic
SREGWST

SEQ ID NO: 13050 - protein, 7 aa, Artificial Sequence
  Synthetic
WQVHGSA

SEQ ID NO: 13051 - protein, 7 aa, Artificial Sequence
  Synthetic
ILLGRVG

SEQ ID NO: 13052 - protein, 7 aa, Artificial Sequence
  Synthetic
DYRGYST

SEQ ID NO: 13053 - protein, 7 aa, Artificial Sequence
  Synthetic
WMNGGAQ

SEQ ID NO: 13054 - protein, 7 aa, Artificial Sequence
  Synthetic
PRAGYSM

SEQ ID NO: 13055 - protein, 7 aa, Artificial Sequence
  Synthetic
VWGSLGP

SEQ ID NO: 13056 - protein, 7 aa, Artificial Sequence
  Synthetic
TFALGSA

SEQ ID NO: 13057 - protein, 7 aa, Artificial Sequence
  Synthetic
VRTGSIY

SEQ ID NO: 13058 - protein, 7 aa, Artificial Sequence
  Synthetic
KLSTEYW

SEQ ID NO: 13059 - protein, 7 aa, Artificial Sequence
  Synthetic
VIFHGSA

SEQ ID NO: 13060 - protein, 7 aa, Artificial Sequence
  Synthetic
WFQHGAA

SEQ ID NO: 13061 - protein, 7 aa, Artificial Sequence
  Synthetic
SRIVLTN

SEQ ID NO: 13062 - protein, 7 aa, Artificial Sequence
  Synthetic
LKFMLRD

SEQ ID NO: 13063 - protein, 7 aa, Artificial Sequence
  Synthetic
HVGWGSA

SEQ ID NO: 13064 - protein, 7 aa, Artificial Sequence
  Synthetic
GWPGGSS

SEQ ID NO: 13065 - protein, 7 aa, Artificial Sequence
  Synthetic
IYAGFNE

SEQ ID NO: 13066 - protein, 7 aa, Artificial Sequence
  Synthetic
GTNVGIW

SEQ ID NO: 13067 - protein, 7 aa, Artificial Sequence
  Synthetic
MIYQGSS

SEQ ID NO: 13068 - protein, 7 aa, Artificial Sequence
  Synthetic
LVVAQSS

SEQ ID NO: 13069 - protein, 7 aa, Artificial Sequence
  Synthetic
LARGSVY

SEQ ID NO: 13070 - protein, 7 aa, Artificial Sequence
  Synthetic
LWQGGSS

SEQ ID NO: 13071 - protein, 7 aa, Artificial Sequence
  Synthetic
ESGGARW

SEQ ID NO: 13072 - protein, 7 aa, Artificial Sequence
  Synthetic
LPLRLNI

SEQ ID NO: 13073 - protein, 7 aa, Artificial Sequence
  Synthetic
SHWGGSS

SEQ ID NO: 13074 - protein, 7 aa, Artificial Sequence
  Synthetic
EGPFQSS

SEQ ID NO: 13075 - protein, 7 aa, Artificial Sequence
  Synthetic
PAPGWSS

SEQ ID NO: 13076 - protein, 7 aa, Artificial Sequence
  Synthetic
WRLEGST

SEQ ID NO: 13077 - protein, 7 aa, Artificial Sequence
  Synthetic
FGSLSQF

SEQ ID NO: 13078 - protein, 7 aa, Artificial Sequence
  Synthetic
LKYHLGD

SEQ ID NO: 13079 - protein, 7 aa, Artificial Sequence
  Synthetic
GSEAGRW

SEQ ID NO: 13080 - protein, 7 aa, Artificial Sequence
  Synthetic
TSVGTIY

SEQ ID NO: 13081 - protein, 7 aa, Artificial Sequence
  Synthetic
PRIVLNN

SEQ ID NO: 13082 - protein, 7 aa, Artificial Sequence
  Synthetic
SVRLGSS

SEQ ID NO: 13083 - protein, 7 aa, Artificial Sequence
  Synthetic
WSLNSGH

SEQ ID NO: 13084 - protein, 7 aa, Artificial Sequence
  Synthetic
TYLGQAS

SEQ ID NO: 13085 - protein, 7 aa, Artificial Sequence
  Synthetic
GRENTWT

SEQ ID NO: 13086 - protein, 7 aa, Artificial Sequence
  Synthetic
VEFKLPH

SEQ ID NO: 13087 - protein, 7 aa, Artificial Sequence
  Synthetic
WMVGGSA

SEQ ID NO: 13088 - protein, 7 aa, Artificial Sequence
  Synthetic
GHNSGMW

SEQ ID NO: 13089 - protein, 7 aa, Artificial Sequence
  Synthetic
FRTLGSA

SEQ ID NO: 13090 - protein, 7 aa, Artificial Sequence
  Synthetic
WGSLESL

SEQ ID NO: 13091 - protein, 7 aa, Artificial Sequence
  Synthetic
WAYQGSA

SEQ ID NO: 13092 - protein, 7 aa, Artificial Sequence
  Synthetic
LGSMFSM

SEQ ID NO: 13093 - protein, 7 aa, Artificial Sequence
  Synthetic
ILGGYTI

SEQ ID NO: 13094 - protein, 7 aa, Artificial Sequence
  Synthetic
VTTSRWD

SEQ ID NO: 13095 - protein, 7 aa, Artificial Sequence
  Synthetic
ETPVGRW

SEQ ID NO: 13096 - protein, 7 aa, Artificial Sequence
  Synthetic
EFYGGSV

SEQ ID NO: 13097 - protein, 7 aa, Artificial Sequence
  Synthetic
FDHPGVW

SEQ ID NO: 13098 - protein, 7 aa, Artificial Sequence
  Synthetic
GVDRGVW

SEQ ID NO: 13099 - protein, 7 aa, Artificial Sequence
  Synthetic
CFPRHEC

SEQ ID NO: 13100 - protein, 7 aa, Artificial Sequence
  Synthetic
HVPYGST

SEQ ID NO: 13101 - protein, 7 aa, Artificial Sequence
  Synthetic
TWQGGAQ

SEQ ID NO: 13102 - protein, 7 aa, Artificial Sequence
  Synthetic
GSDAARW

SEQ ID NO: 13103 - protein, 7 aa, Artificial Sequence
  Synthetic
IAKGYSQ

SEQ ID NO: 13104 - protein, 7 aa, Artificial Sequence
  Synthetic
MMYQGSA

SEQ ID NO: 13105 - protein, 7 aa, Artificial Sequence
  Synthetic
FGSLSIV

SEQ ID NO: 13106 - protein, 7 aa, Artificial Sequence
  Synthetic
AWSHGAS

SEQ ID NO: 13107 - protein, 7 aa, Artificial Sequence
  Synthetic
KVSYGSA

SEQ ID NO: 13108 - protein, 7 aa, Artificial Sequence
  Synthetic
MRVGAAQ

SEQ ID NO: 13109 - protein, 7 aa, Artificial Sequence
  Synthetic
LSVGRVY

SEQ ID NO: 13110 - protein, 7 aa, Artificial Sequence
  Synthetic
DWARGST

SEQ ID NO: 13111 - protein, 7 aa, Artificial Sequence
  Synthetic
RSIGSVY

SEQ ID NO: 13112 - protein, 7 aa, Artificial Sequence
  Synthetic
MRTLGST

SEQ ID NO: 13113 - protein, 7 aa, Artificial Sequence
  Synthetic
TITNYHV

SEQ ID NO: 13114 - protein, 7 aa, Artificial Sequence
  Synthetic
LGIMNVV

SEQ ID NO: 13115 - protein, 7 aa, Artificial Sequence
  Synthetic
AFFSGSA

SEQ ID NO: 13116 - protein, 7 aa, Artificial Sequence
  Synthetic
RDKGSVY

SEQ ID NO: 13117 - protein, 7 aa, Artificial Sequence
  Synthetic
QRVGFSS

SEQ ID NO: 13118 - protein, 7 aa, Artificial Sequence
  Synthetic
FGSLHLV

SEQ ID NO: 13119 - protein, 7 aa, Artificial Sequence
  Synthetic
ASWQGSS

SEQ ID NO: 13120 - protein, 7 aa, Artificial Sequence
  Synthetic
ISFGGAQ

SEQ ID NO: 13121 - protein, 7 aa, Artificial Sequence
  Synthetic
WSVGREG

SEQ ID NO: 13122 - protein, 7 aa, Artificial Sequence
  Synthetic
GETRHVW

SEQ ID NO: 13123 - protein, 7 aa, Artificial Sequence
  Synthetic
LKSGFSM

SEQ ID NO: 13124 - protein, 7 aa, Artificial Sequence
  Synthetic
RPYTVDV

SEQ ID NO: 13125 - protein, 7 aa, Artificial Sequence
  Synthetic
WRDMGST

SEQ ID NO: 13126 - protein, 7 aa, Artificial Sequence
  Synthetic
GDRLGVW

SEQ ID NO: 13127 - protein, 7 aa, Artificial Sequence
  Synthetic
VALGYSS

SEQ ID NO: 13128 - protein, 7 aa, Artificial Sequence
  Synthetic
GDPAGRW

SEQ ID NO: 13129 - protein, 7 aa, Artificial Sequence
  Synthetic
KLGSGVW

SEQ ID NO: 13130 - protein, 7 aa, Artificial Sequence
  Synthetic
GHSVGPW

SEQ ID NO: 13131 - protein, 7 aa, Artificial Sequence
  Synthetic
LWPGQSS

SEQ ID NO: 13132 - protein, 7 aa, Artificial Sequence
  Synthetic
IRYAVDV

SEQ ID NO: 13133 - protein, 7 aa, Artificial Sequence
  Synthetic
QMDSGRW

SEQ ID NO: 13134 - protein, 7 aa, Artificial Sequence
  Synthetic
WAHMGSA

SEQ ID NO: 13135 - protein, 7 aa, Artificial Sequence
  Synthetic
YRTMGSS

SEQ ID NO: 13136 - protein, 7 aa, Artificial Sequence
  Synthetic
FQRLGSS

SEQ ID NO: 13137 - protein, 7 aa, Artificial Sequence
  Synthetic
SARLGST

SEQ ID NO: 13138 - protein, 7 aa, Artificial Sequence
  Synthetic
MATGWSS

SEQ ID NO: 13139 - protein, 7 aa, Artificial Sequence
  Synthetic
RYMGDSV

SEQ ID NO: 13140 - protein, 7 aa, Artificial Sequence
  Synthetic
LRAGLAQ

SEQ ID NO: 13141 - protein, 7 aa, Artificial Sequence
  Synthetic
MVEYGSA

SEQ ID NO: 13142 - protein, 7 aa, Artificial Sequence
  Synthetic
ERAGYSS

SEQ ID NO: 13143 - protein, 7 aa, Artificial Sequence
  Synthetic
SHFGMAQ

SEQ ID NO: 13144 - protein, 7 aa, Artificial Sequence
  Synthetic
VARGYSS

SEQ ID NO: 13145 - protein, 7 aa, Artificial Sequence
  Synthetic
GSNTGVW

SEQ ID NO: 13146 - protein, 7 aa, Artificial Sequence
  Synthetic
VSKYQDW

SEQ ID NO: 13147 - protein, 7 aa, Artificial Sequence
  Synthetic
MYMPASS

SEQ ID NO: 13148 - protein, 7 aa, Artificial Sequence
  Synthetic
VTPGSYW

SEQ ID NO: 13149 - protein, 7 aa, Artificial Sequence
  Synthetic
LSYGMSS

SEQ ID NO: 13150 - protein, 7 aa, Artificial Sequence
  Synthetic
EKLYGST

SEQ ID NO: 13151 - protein, 7 aa, Artificial Sequence
  Synthetic
QGDVGRW

SEQ ID NO: 13152 - protein, 7 aa, Artificial Sequence
  Synthetic
FALNLRP

SEQ ID NO: 13153 - protein, 7 aa, Artificial Sequence
  Synthetic
MVVHGSS

SEQ ID NO: 13154 - protein, 7 aa, Artificial Sequence
  Synthetic
HHTMGSA

SEQ ID NO: 13155 - protein, 7 aa, Artificial Sequence
  Synthetic
PRVGFSS

SEQ ID NO: 13156 - protein, 7 aa, Artificial Sequence
  Synthetic
GWHGGSS

SEQ ID NO: 13157 - protein, 7 aa, Artificial Sequence
  Synthetic
LRTGYAM

SEQ ID NO: 13158 - protein, 7 aa, Artificial Sequence
  Synthetic
EPAWSSS

SEQ ID NO: 13159 - protein, 7 aa, Artificial Sequence
  Synthetic
WRELYSS

SEQ ID NO: 13160 - protein, 7 aa, Artificial Sequence
  Synthetic
KMNSGIW

SEQ ID NO: 13161 - protein, 7 aa, Artificial Sequence
  Synthetic
LRALGSS

SEQ ID NO: 13162 - protein, 7 aa, Artificial Sequence
  Synthetic
DYNGGRW

SEQ ID NO: 13163 - protein, 7 aa, Artificial Sequence
  Synthetic
PSNLARF

SEQ ID NO: 13164 - protein, 7 aa, Artificial Sequence
  Synthetic
WAHHGSQ

SEQ ID NO: 13165 - protein, 7 aa, Artificial Sequence
  Synthetic
IYVGSST

SEQ ID NO: 13166 - protein, 7 aa, Artificial Sequence
  Synthetic
PQWGAAT

SEQ ID NO: 13167 - protein, 7 aa, Artificial Sequence
  Synthetic
LRPGYSS

SEQ ID NO: 13168 - protein, 7 aa, Artificial Sequence
  Synthetic
YDFSGDR

SEQ ID NO: 13169 - protein, 7 aa, Artificial Sequence
  Synthetic
DERINRW

SEQ ID NO: 13170 - protein, 7 aa, Artificial Sequence
  Synthetic
GESSGRW

SEQ ID NO: 13171 - protein, 7 aa, Artificial Sequence
  Synthetic
SWSGLRE

SEQ ID NO: 13172 - protein, 7 aa, Artificial Sequence
  Synthetic
LWKGDAS

SEQ ID NO: 13173 - protein, 7 aa, Artificial Sequence
  Synthetic
DPSSARW

SEQ ID NO: 13174 - protein, 7 aa, Artificial Sequence
  Synthetic
WRPLGAA

SEQ ID NO: 13175 - protein, 7 aa, Artificial Sequence
  Synthetic
VYQGSVY

SEQ ID NO: 13176 - protein, 7 aa, Artificial Sequence
  Synthetic
PEHSYRY

SEQ ID NO: 13177 - protein, 7 aa, Artificial Sequence
  Synthetic
MGSMFSS

SEQ ID NO: 13178 - protein, 7 aa, Artificial Sequence
  Synthetic
GIEKGYW

SEQ ID NO: 13179 - protein, 7 aa, Artificial Sequence
  Synthetic
TWGSLGA

SEQ ID NO: 13180 - protein, 7 aa, Artificial Sequence
  Synthetic
GPTVGHW

SEQ ID NO: 13181 - protein, 7 aa, Artificial Sequence
  Synthetic
RYTGEST

SEQ ID NO: 13182 - protein, 7 aa, Artificial Sequence
  Synthetic
TWHGASS

SEQ ID NO: 13183 - protein, 7 aa, Artificial Sequence
  Synthetic
HGLGFSS

SEQ ID NO: 13184 - protein, 7 aa, Artificial Sequence
  Synthetic
RYYEGSS

SEQ ID NO: 13185 - protein, 7 aa, Artificial Sequence
  Synthetic
VYLGGSQ

SEQ ID NO: 13186 - protein, 7 aa, Artificial Sequence
  Synthetic
SPVPHGW

SEQ ID NO: 13187 - protein, 7 aa, Artificial Sequence
  Synthetic
SAWQGSA

SEQ ID NO: 13188 - protein, 7 aa, Artificial Sequence
  Synthetic
VRSGYSS

SEQ ID NO: 13189 - protein, 7 aa, Artificial Sequence
  Synthetic
WKQMGSA

SEQ ID NO: 13190 - protein, 7 aa, Artificial Sequence
  Synthetic
KLYNGSI

SEQ ID NO: 13191 - protein, 7 aa, Artificial Sequence
  Synthetic
YGTFITR

SEQ ID NO: 13192 - protein, 7 aa, Artificial Sequence
  Synthetic
SRPGFSM

SEQ ID NO: 13193 - protein, 7 aa, Artificial Sequence
  Synthetic
VKFGQAQ

SEQ ID NO: 13194 - protein, 7 aa, Artificial Sequence
  Synthetic
SPHDARW

SEQ ID NO: 13195 - protein, 7 aa, Artificial Sequence
  Synthetic
DRYIGSS

SEQ ID NO: 13196 - protein, 7 aa, Artificial Sequence
  Synthetic
SILEGYR

SEQ ID NO: 13197 - protein, 7 aa, Artificial Sequence
  Synthetic
PEYKLPT

SEQ ID NO: 13198 - protein, 7 aa, Artificial Sequence
  Synthetic
LYPGSSM

SEQ ID NO: 13199 - protein, 7 aa, Artificial Sequence
  Synthetic
WAKIGSA

SEQ ID NO: 13200 - protein, 7 aa, Artificial Sequence
  Synthetic
WSLPSHG

SEQ ID NO: 13201 - protein, 7 aa, Artificial Sequence
  Synthetic
TVYLGSV

SEQ ID NO: 13202 - protein, 7 aa, Artificial Sequence
  Synthetic
KSVYNDW

SEQ ID NO: 13203 - protein, 7 aa, Artificial Sequence
  Synthetic
GSDLGRW

SEQ ID NO: 13204 - protein, 7 aa, Artificial Sequence
  Synthetic
YASLAPY

SEQ ID NO: 13205 - protein, 7 aa, Artificial Sequence
  Synthetic
FGLLDRI

SEQ ID NO: 13206 - protein, 7 aa, Artificial Sequence
  Synthetic
RKWELPD

SEQ ID NO: 13207 - protein, 7 aa, Artificial Sequence
  Synthetic
PKISYSA

SEQ ID NO: 13208 - protein, 7 aa, Artificial Sequence
  Synthetic
QSDYSQW

SEQ ID NO: 13209 - protein, 7 aa, Artificial Sequence
  Synthetic
RGSLGPM

SEQ ID NO: 13210 - protein, 7 aa, Artificial Sequence
  Synthetic
LKTGFSS

SEQ ID NO: 13211 - protein, 7 aa, Artificial Sequence
  Synthetic
ELTGARW

SEQ ID NO: 13212 - protein, 7 aa, Artificial Sequence
  Synthetic
RVYEGYH

SEQ ID NO: 13213 - protein, 7 aa, Artificial Sequence
  Synthetic
WRSGGSQ

SEQ ID NO: 13214 - protein, 7 aa, Artificial Sequence
  Synthetic
LKQGWSA

SEQ ID NO: 13215 - protein, 7 aa, Artificial Sequence
  Synthetic
RIPGLSS

SEQ ID NO: 13216 - protein, 7 aa, Artificial Sequence
  Synthetic
IGYSVGL

SEQ ID NO: 13217 - protein, 7 aa, Artificial Sequence
  Synthetic
WKLESGF

SEQ ID NO: 13218 - protein, 7 aa, Artificial Sequence
  Synthetic
VRLMGST

SEQ ID NO: 13219 - protein, 7 aa, Artificial Sequence
  Synthetic
GLSTSMW

SEQ ID NO: 13220 - protein, 7 aa, Artificial Sequence
  Synthetic
PGTGGHW

SEQ ID NO: 13221 - protein, 7 aa, Artificial Sequence
  Synthetic
YLRGWSE

SEQ ID NO: 13222 - protein, 7 aa, Artificial Sequence
  Synthetic
ATVAHGW

SEQ ID NO: 13223 - protein, 7 aa, Artificial Sequence
  Synthetic
DRTPGLW

SEQ ID NO: 13224 - protein, 7 aa, Artificial Sequence
  Synthetic
SVSWGSA

SEQ ID NO: 13225 - protein, 7 aa, Artificial Sequence
  Synthetic
TKTGYSS

SEQ ID NO: 13226 - protein, 7 aa, Artificial Sequence
  Synthetic
DVPSGRW

SEQ ID NO: 13227 - protein, 7 aa, Artificial Sequence
  Synthetic
YGMLSAI

SEQ ID NO: 13228 - protein, 7 aa, Artificial Sequence
  Synthetic
RGSLGPL

SEQ ID NO: 13229 - protein, 7 aa, Artificial Sequence
  Synthetic
MSYHGSS

SEQ ID NO: 13230 - protein, 7 aa, Artificial Sequence
  Synthetic
MPGDGRW

SEQ ID NO: 13231 - protein, 7 aa, Artificial Sequence
  Synthetic
WFTSGSA

SEQ ID NO: 13232 - protein, 7 aa, Artificial Sequence
  Synthetic
APSLRYV

SEQ ID NO: 13233 - protein, 7 aa, Artificial Sequence
  Synthetic
IALGYSA

SEQ ID NO: 13234 - protein, 7 aa, Artificial Sequence
  Synthetic
PRPAYAA

SEQ ID NO: 13235 - protein, 7 aa, Artificial Sequence
  Synthetic
HKTLGSA

SEQ ID NO: 13236 - protein, 7 aa, Artificial Sequence
  Synthetic
AQIGWSS

SEQ ID NO: 13237 - protein, 7 aa, Artificial Sequence
  Synthetic
LRENWSS

SEQ ID NO: 13238 - protein, 7 aa, Artificial Sequence
  Synthetic
GFSRWAE

SEQ ID NO: 13239 - protein, 7 aa, Artificial Sequence
  Synthetic
WGVLSAI

SEQ ID NO: 13240 - protein, 7 aa, Artificial Sequence
  Synthetic
ITRGTVY

SEQ ID NO: 13241 - protein, 7 aa, Artificial Sequence
  Synthetic
LVYGAAQ

SEQ ID NO: 13242 - protein, 7 aa, Artificial Sequence
  Synthetic
MITYGSS

SEQ ID NO: 13243 - protein, 7 aa, Artificial Sequence
  Synthetic
RVEMGSW

SEQ ID NO: 13244 - protein, 7 aa, Artificial Sequence
  Synthetic
SVPGWSA

SEQ ID NO: 13245 - protein, 7 aa, Artificial Sequence
  Synthetic
IGSLERW

SEQ ID NO: 13246 - protein, 7 aa, Artificial Sequence
  Synthetic
KILLTPV

SEQ ID NO: 13247 - protein, 7 aa, Artificial Sequence
  Synthetic
ERVNWSV

SEQ ID NO: 13248 - protein, 7 aa, Artificial Sequence
  Synthetic
IVQFGSA

SEQ ID NO: 13249 - protein, 7 aa, Artificial Sequence
  Synthetic
RFAGDAS

SEQ ID NO: 13250 - protein, 7 aa, Artificial Sequence
  Synthetic
LMQYGSS

SEQ ID NO: 13251 - protein, 7 aa, Artificial Sequence
  Synthetic
LVPHGWS

SEQ ID NO: 13252 - protein, 7 aa, Artificial Sequence
  Synthetic
DRILGST

SEQ ID NO: 13253 - protein, 7 aa, Artificial Sequence
  Synthetic
WEVTTGY

SEQ ID NO: 13254 - protein, 7 aa, Artificial Sequence
  Synthetic
GADISRW

SEQ ID NO: 13255 - protein, 7 aa, Artificial Sequence
  Synthetic
FYRPAGA

SEQ ID NO: 13256 - protein, 7 aa, Artificial Sequence
  Synthetic
GGSPGQW

SEQ ID NO: 13257 - protein, 7 aa, Artificial Sequence
  Synthetic
WRIGGSA

SEQ ID NO: 13258 - protein, 7 aa, Artificial Sequence
  Synthetic
LHAGFSS

SEQ ID NO: 13259 - protein, 7 aa, Artificial Sequence
  Synthetic
LKANYSS

SEQ ID NO: 13260 - protein, 7 aa, Artificial Sequence
  Synthetic
RFFEGSS

SEQ ID NO: 13261 - protein, 7 aa, Artificial Sequence
  Synthetic
LVQYGSA

SEQ ID NO: 13262 - protein, 7 aa, Artificial Sequence
  Synthetic
PGSPGPW

SEQ ID NO: 13263 - protein, 7 aa, Artificial Sequence
  Synthetic
ERMLGSS

SEQ ID NO: 13264 - protein, 7 aa, Artificial Sequence
  Synthetic
VRTWESS

SEQ ID NO: 13265 - protein, 7 aa, Artificial Sequence
  Synthetic
LSIGWSS

SEQ ID NO: 13266 - protein, 7 aa, Artificial Sequence
  Synthetic
WPYGKEN

SEQ ID NO: 13267 - protein, 7 aa, Artificial Sequence
  Synthetic
WGSMFSS

SEQ ID NO: 13268 - protein, 7 aa, Artificial Sequence
  Synthetic
PRLGMSS

SEQ ID NO: 13269 - protein, 7 aa, Artificial Sequence
  Synthetic
PWPSAAS

SEQ ID NO: 13270 - protein, 7 aa, Artificial Sequence
  Synthetic
HVEWGSS

SEQ ID NO: 13271 - protein, 7 aa, Artificial Sequence
  Synthetic
DKLFGSA

SEQ ID NO: 13272 - protein, 7 aa, Artificial Sequence
  Synthetic
WSASTGY

SEQ ID NO: 13273 - protein, 7 aa, Artificial Sequence
  Synthetic
VRSGLAQ

SEQ ID NO: 13274 - protein, 7 aa, Artificial Sequence
  Synthetic
YREYPEV

SEQ ID NO: 13275 - protein, 7 aa, Artificial Sequence
  Synthetic
MQRLGSA

SEQ ID NO: 13276 - protein, 7 aa, Artificial Sequence
  Synthetic
RYLGDNI

SEQ ID NO: 13277 - protein, 7 aa, Artificial Sequence
  Synthetic
PRVPNAW

SEQ ID NO: 13278 - protein, 7 aa, Artificial Sequence
  Synthetic
WGYRITD

SEQ ID NO: 13279 - protein, 7 aa, Artificial Sequence
  Synthetic
VHLGFSS

SEQ ID NO: 13280 - protein, 7 aa, Artificial Sequence
  Synthetic
DGTVGRW

SEQ ID NO: 13281 - protein, 7 aa, Artificial Sequence
  Synthetic
LSVGRVY

SEQ ID NO: 13282 - protein, 7 aa, Artificial Sequence
  Synthetic
LRVNYAS

SEQ ID NO: 13283 - protein, 7 aa, Artificial Sequence
  Synthetic
LESRFST

SEQ ID NO: 13284 - protein, 7 aa, Artificial Sequence
  Synthetic
WSHLGSA

SEQ ID NO: 13285 - protein, 7 aa, Artificial Sequence
  Synthetic
STWGAAQ

SEQ ID NO: 13286 - protein, 7 aa, Artificial Sequence
  Synthetic
PPNSAAW

SEQ ID NO: 13287 - protein, 7 aa, Artificial Sequence
  Synthetic
LGHGWSQ

SEQ ID NO: 13288 - protein, 7 aa, Artificial Sequence
  Synthetic
MYLPQSS

SEQ ID NO: 13289 - protein, 7 aa, Artificial Sequence
  Synthetic
REMGSIY

SEQ ID NO: 13290 - protein, 7 aa, Artificial Sequence
  Synthetic
PFPGYGA

SEQ ID NO: 13291 - protein, 7 aa, Artificial Sequence
  Synthetic
NIRLGYS

SEQ ID NO: 13292 - protein, 7 aa, Artificial Sequence
  Synthetic
AVYMGSV

SEQ ID NO: 13293 - protein, 7 aa, Artificial Sequence
  Synthetic
LHYSEGL

SEQ ID NO: 13294 - protein, 7 aa, Artificial Sequence
  Synthetic
MYIRDAS

SEQ ID NO: 13295 - protein, 7 aa, Artificial Sequence
  Synthetic
WRDRGSA

SEQ ID NO: 13296 - protein, 7 aa, Artificial Sequence
  Synthetic
LLSFGSS

SEQ ID NO: 13297 - protein, 7 aa, Artificial Sequence
  Synthetic
ERNYGSA

SEQ ID NO: 13298 - protein, 7 aa, Artificial Sequence
  Synthetic
TARLGST

SEQ ID NO: 13299 - protein, 7 aa, Artificial Sequence
  Synthetic
VYAGWRE

SEQ ID NO: 13300 - protein, 7 aa, Artificial Sequence
  Synthetic
AQYMGSS

SEQ ID NO: 13301 - protein, 7 aa, Artificial Sequence
  Synthetic
SRAGYSM

SEQ ID NO: 13302 - protein, 7 aa, Artificial Sequence
  Synthetic
TMTRGSS

SEQ ID NO: 13303 - protein, 7 aa, Artificial Sequence
  Synthetic
WHSLQNP

SEQ ID NO: 13304 - protein, 7 aa, Artificial Sequence
  Synthetic
WRSLPEL

SEQ ID NO: 13305 - protein, 7 aa, Artificial Sequence
  Synthetic
WYVAGSA

SEQ ID NO: 13306 - protein, 7 aa, Artificial Sequence
  Synthetic
WSMHGST

SEQ ID NO: 13307 - protein, 7 aa, Artificial Sequence
  Synthetic
RYMGDAS

SEQ ID NO: 13308 - protein, 7 aa, Artificial Sequence
  Synthetic
WRVAGSA

SEQ ID NO: 13309 - protein, 7 aa, Artificial Sequence
  Synthetic
RVPGFSS

SEQ ID NO: 13310 - protein, 7 aa, Artificial Sequence
  Synthetic
VIPGWSS

SEQ ID NO: 13311 - protein, 7 aa, Artificial Sequence
  Synthetic
EYGGGKF

SEQ ID NO: 13312 - protein, 7 aa, Artificial Sequence
  Synthetic
SLTGRLY

SEQ ID NO: 13313 - protein, 7 aa, Artificial Sequence
  Synthetic
YALEGDR

SEQ ID NO: 13314 - protein, 7 aa, Artificial Sequence
  Synthetic
LMRGFST

SEQ ID NO: 13315 - protein, 7 aa, Artificial Sequence
  Synthetic
WILPSGG

SEQ ID NO: 13316 - protein, 7 aa, Artificial Sequence
  Synthetic
SMYHGSS

SEQ ID NO: 13317 - protein, 7 aa, Artificial Sequence
  Synthetic
LISYGST

SEQ ID NO: 13318 - protein, 7 aa, Artificial Sequence
  Synthetic
EAGVTRW

SEQ ID NO: 13319 - protein, 7 aa, Artificial Sequence
  Synthetic
WVGHGSS

SEQ ID NO: 13320 - protein, 7 aa, Artificial Sequence
  Synthetic
VHVGSVY

SEQ ID NO: 13321 - protein, 7 aa, Artificial Sequence
  Synthetic
LVVPMAS

SEQ ID NO: 13322 - protein, 7 aa, Artificial Sequence
  Synthetic
AAIGSIY

SEQ ID NO: 13323 - protein, 7 aa, Artificial Sequence
  Synthetic
LQPGWST

SEQ ID NO: 13324 - protein, 7 aa, Artificial Sequence
  Synthetic
LERYGSS

SEQ ID NO: 13325 - protein, 7 aa, Artificial Sequence
  Synthetic
TIVGFSS

SEQ ID NO: 13326 - protein, 7 aa, Artificial Sequence
  Synthetic
VRAGFSS

SEQ ID NO: 13327 - protein, 7 aa, Artificial Sequence
  Synthetic
WDVKSGF

SEQ ID NO: 13328 - protein, 7 aa, Artificial Sequence
  Synthetic
YLSGYTS

SEQ ID NO: 13329 - protein, 7 aa, Artificial Sequence
  Synthetic
KVASQSW

SEQ ID NO: 13330 - protein, 7 aa, Artificial Sequence
  Synthetic
WVIGGSK

SEQ ID NO: 13331 - protein, 7 aa, Artificial Sequence
  Synthetic
WSTHTGY

SEQ ID NO: 13332 - protein, 7 aa, Artificial Sequence
  Synthetic
WSQFSSG

SEQ ID NO: 13333 - protein, 7 aa, Artificial Sequence
  Synthetic
NYAGYST

SEQ ID NO: 13334 - protein, 7 aa, Artificial Sequence
  Synthetic
DVGSSRW

SEQ ID NO: 13335 - protein, 7 aa, Artificial Sequence
  Synthetic
VTRGYAT

SEQ ID NO: 13336 - protein, 7 aa, Artificial Sequence
  Synthetic
KMWGSLE

SEQ ID NO: 13337 - protein, 7 aa, Artificial Sequence
  Synthetic
KSPGFSS

SEQ ID NO: 13338 - protein, 7 aa, Artificial Sequence
  Synthetic
MAAGFSQ

SEQ ID NO: 13339 - protein, 7 aa, Artificial Sequence
  Synthetic
GWSGGAQ

SEQ ID NO: 13340 - protein, 7 aa, Artificial Sequence
  Synthetic
WKLAGSA

SEQ ID NO: 13341 - protein, 7 aa, Artificial Sequence
  Synthetic
HALYGSV

SEQ ID NO: 13342 - protein, 7 aa, Artificial Sequence
  Synthetic
TFHGGSM

SEQ ID NO: 13343 - protein, 7 aa, Artificial Sequence
  Synthetic
ERPGWAS

SEQ ID NO: 13344 - protein, 7 aa, Artificial Sequence
  Synthetic
MRTLGSA

SEQ ID NO: 13345 - protein, 7 aa, Artificial Sequence
  Synthetic
LRAGYSV

SEQ ID NO: 13346 - protein, 7 aa, Artificial Sequence
  Synthetic
PRSGFSS

SEQ ID NO: 13347 - protein, 7 aa, Artificial Sequence
  Synthetic
ERGDGRW

SEQ ID NO: 13348 - protein, 7 aa, Artificial Sequence
  Synthetic
MAVGFSS

SEQ ID NO: 13349 - protein, 7 aa, Artificial Sequence
  Synthetic
YMRMGSA

SEQ ID NO: 13350 - protein, 7 aa, Artificial Sequence
  Synthetic
NRPGFSS

SEQ ID NO: 13351 - protein, 7 aa, Artificial Sequence
  Synthetic
EVWGGAM

SEQ ID NO: 13352 - protein, 7 aa, Artificial Sequence
  Synthetic
WARQGSA

SEQ ID NO: 13353 - protein, 7 aa, Artificial Sequence
  Synthetic
RPEWRSD

SEQ ID NO: 13354 - protein, 7 aa, Artificial Sequence
  Synthetic
WLSGFKD

SEQ ID NO: 13355 - protein, 7 aa, Artificial Sequence
  Synthetic
SWPGSSS

SEQ ID NO: 13356 - protein, 7 aa, Artificial Sequence
  Synthetic
PAPMLAS

SEQ ID NO: 13357 - protein, 7 aa, Artificial Sequence
  Synthetic
RYQADAQ

SEQ ID NO: 13358 - protein, 7 aa, Artificial Sequence
  Synthetic
LYLGDRS

SEQ ID NO: 13359 - protein, 7 aa, Artificial Sequence
  Synthetic
RAPGLSS

SEQ ID NO: 13360 - protein, 7 aa, Artificial Sequence
  Synthetic
GADVSRW

SEQ ID NO: 13361 - protein, 7 aa, Artificial Sequence
  Synthetic
VRAMGSA

SEQ ID NO: 13362 - protein, 7 aa, Artificial Sequence
  Synthetic
PYVGMAS

SEQ ID NO: 13363 - protein, 7 aa, Artificial Sequence
  Synthetic
VRSGWAA

SEQ ID NO: 13364 - protein, 7 aa, Artificial Sequence
  Synthetic
EFRGYSS

SEQ ID NO: 13365 - protein, 7 aa, Artificial Sequence
  Synthetic
YASLSFH

SEQ ID NO: 13366 - protein, 7 aa, Artificial Sequence
  Synthetic
WSTYSGH

SEQ ID NO: 13367 - protein, 7 aa, Artificial Sequence
  Synthetic
VVQHSHW

SEQ ID NO: 13368 - protein, 7 aa, Artificial Sequence
  Synthetic
RYVGGSS

SEQ ID NO: 13369 - protein, 7 aa, Artificial Sequence
  Synthetic
RPYHVDS

SEQ ID NO: 13370 - protein, 7 aa, Artificial Sequence
  Synthetic
NAQLLPY

SEQ ID NO: 13371 - protein, 7 aa, Artificial Sequence
  Synthetic
GGLGWSS

SEQ ID NO: 13372 - protein, 7 aa, Artificial Sequence
  Synthetic
ARPYAHE

SEQ ID NO: 13373 - protein, 7 aa, Artificial Sequence
  Synthetic
YGSLESL

SEQ ID NO: 13374 - protein, 7 aa, Artificial Sequence
  Synthetic
WTSDKGW

SEQ ID NO: 13375 - protein, 7 aa, Artificial Sequence
  Synthetic
WSHGYST

SEQ ID NO: 13376 - protein, 7 aa, Artificial Sequence
  Synthetic
LQEYGSS

SEQ ID NO: 13377 - protein, 7 aa, Artificial Sequence
  Synthetic
EAPWQSS

SEQ ID NO: 13378 - protein, 7 aa, Artificial Sequence
  Synthetic
VRSGFSS

SEQ ID NO: 13379 - protein, 7 aa, Artificial Sequence
  Synthetic
VRSGFSM

SEQ ID NO: 13380 - protein, 7 aa, Artificial Sequence
  Synthetic
MSYLGSS

SEQ ID NO: 13381 - protein, 7 aa, Artificial Sequence
  Synthetic
VLYRESL

SEQ ID NO: 13382 - protein, 7 aa, Artificial Sequence
  Synthetic
RYSGDAA

SEQ ID NO: 13383 - protein, 7 aa, Artificial Sequence
  Synthetic
WSIAEGH

SEQ ID NO: 13384 - protein, 7 aa, Artificial Sequence
  Synthetic
LDSRFSH

SEQ ID NO: 13385 - protein, 7 aa, Artificial Sequence
  Synthetic
WSLPNGG

SEQ ID NO: 13386 - protein, 7 aa, Artificial Sequence
  Synthetic
DFFKGAA

SEQ ID NO: 13387 - protein, 7 aa, Artificial Sequence
  Synthetic
AWHTGSS

SEQ ID NO: 13388 - protein, 7 aa, Artificial Sequence
  Synthetic
VMHGFSS

SEQ ID NO: 13389 - protein, 7 aa, Artificial Sequence
  Synthetic
DERIGRW

SEQ ID NO: 13390 - protein, 7 aa, Artificial Sequence
  Synthetic
EWIGGAA

SEQ ID NO: 13391 - protein, 7 aa, Artificial Sequence
  Synthetic
LNSLWPD

SEQ ID NO: 13392 - protein, 7 aa, Artificial Sequence
  Synthetic
SKVGYSS

SEQ ID NO: 13393 - protein, 7 aa, Artificial Sequence
  Synthetic
TYPGYSV

SEQ ID NO: 13394 - protein, 7 aa, Artificial Sequence
  Synthetic
FRLQGAQ

SEQ ID NO: 13395 - protein, 7 aa, Artificial Sequence
  Synthetic
SMPYGSS

SEQ ID NO: 13396 - protein, 7 aa, Artificial Sequence
  Synthetic
GAPGQYW

SEQ ID NO: 13397 - protein, 7 aa, Artificial Sequence
  Synthetic
SVRLGSS

SEQ ID NO: 13398 - protein, 7 aa, Artificial Sequence
  Synthetic
PYPSYAS

SEQ ID NO: 13399 - protein, 7 aa, Artificial Sequence
  Synthetic
MPQDSRW

SEQ ID NO: 13400 - protein, 7 aa, Artificial Sequence
  Synthetic
LLYGGST

SEQ ID NO: 13401 - protein, 7 aa, Artificial Sequence
  Synthetic
SKAPGPW

SEQ ID NO: 13402 - protein, 7 aa, Artificial Sequence
  Synthetic
EWSGGSS

SEQ ID NO: 13403 - protein, 7 aa, Artificial Sequence
  Synthetic
WKQMGAS

SEQ ID NO: 13404 - protein, 7 aa, Artificial Sequence
  Synthetic
HRYEGSS

SEQ ID NO: 13405 - protein, 7 aa, Artificial Sequence
  Synthetic
NDPTLRY

SEQ ID NO: 13406 - protein, 7 aa, Artificial Sequence
  Synthetic
PRPGWAA

SEQ ID NO: 13407 - protein, 7 aa, Artificial Sequence
  Synthetic
FVRLPDV

SEQ ID NO: 13408 - protein, 7 aa, Artificial Sequence
  Synthetic
NYVPAAS

SEQ ID NO: 13409 - protein, 7 aa, Artificial Sequence
  Synthetic
VAGYEWK

SEQ ID NO: 13410 - protein, 7 aa, Artificial Sequence
  Synthetic
LREGFSQ

SEQ ID NO: 13411 - protein, 7 aa, Artificial Sequence
  Synthetic
DRIVLRN

SEQ ID NO: 13412 - protein, 7 aa, Artificial Sequence
  Synthetic
DWRGQAT

SEQ ID NO: 13413 - protein, 7 aa, Artificial Sequence
  Synthetic
WRHEGAM

SEQ ID NO: 13414 - protein, 7 aa, Artificial Sequence
  Synthetic
WDVNRGY

SEQ ID NO: 13415 - protein, 7 aa, Artificial Sequence
  Synthetic
LPLMYRD

SEQ ID NO: 13416 - protein, 7 aa, Artificial Sequence
  Synthetic
VWHAGST

SEQ ID NO: 13417 - protein, 7 aa, Artificial Sequence
  Synthetic
VMPGWSS

SEQ ID NO: 13418 - protein, 7 aa, Artificial Sequence
  Synthetic
DYPGYAS

SEQ ID NO: 13419 - protein, 7 aa, Artificial Sequence
  Synthetic
RWTSDAA

SEQ ID NO: 13420 - protein, 7 aa, Artificial Sequence
  Synthetic
AMRGYSS

SEQ ID NO: 13421 - protein, 7 aa, Artificial Sequence
  Synthetic
GQNPGTW

SEQ ID NO: 13422 - protein, 7 aa, Artificial Sequence
  Synthetic
GDSVGRW

SEQ ID NO: 13423 - protein, 7 aa, Artificial Sequence
  Synthetic
RTAGSVY

SEQ ID NO: 13424 - protein, 7 aa, Artificial Sequence
  Synthetic
HLMGYTT

SEQ ID NO: 13425 - protein, 7 aa, Artificial Sequence
  Synthetic
LQTGYSQ

SEQ ID NO: 13426 - protein, 7 aa, Artificial Sequence
  Synthetic
APGSAVW

SEQ ID NO: 13427 - protein, 7 aa, Artificial Sequence
  Synthetic
AVGEFRW

SEQ ID NO: 13428 - protein, 7 aa, Artificial Sequence
  Synthetic
VWHGGSQ

SEQ ID NO: 13429 - protein, 7 aa, Artificial Sequence
  Synthetic
IRFEGSM

SEQ ID NO: 13430 - protein, 7 aa, Artificial Sequence
  Synthetic
ASLGSIY

SEQ ID NO: 13431 - protein, 7 aa, Artificial Sequence
  Synthetic
ERVFQSS

SEQ ID NO: 13432 - protein, 7 aa, Artificial Sequence
  Synthetic
WHSLMVE

SEQ ID NO: 13433 - protein, 7 aa, Artificial Sequence
  Synthetic
YATWVSN

SEQ ID NO: 13434 - protein, 7 aa, Artificial Sequence
  Synthetic
DRGVWAA

SEQ ID NO: 13435 - protein, 7 aa, Artificial Sequence
  Synthetic
IIDSGRW

SEQ ID NO: 13436 - protein, 7 aa, Artificial Sequence
  Synthetic
IIPGFSS

SEQ ID NO: 13437 - protein, 7 aa, Artificial Sequence
  Synthetic
SRWEGSA

SEQ ID NO: 13438 - protein, 7 aa, Artificial Sequence
  Synthetic
GLDKARF

SEQ ID NO: 13439 - protein, 7 aa, Artificial Sequence
  Synthetic
WVERGST

SEQ ID NO: 13440 - protein, 7 aa, Artificial Sequence
  Synthetic
VSHNWSS

SEQ ID NO: 13441 - protein, 7 aa, Artificial Sequence
  Synthetic
WREKGSS

SEQ ID NO: 13442 - protein, 7 aa, Artificial Sequence
  Synthetic
PENPGRW

SEQ ID NO: 13443 - protein, 7 aa, Artificial Sequence
  Synthetic
MRSLGSS

SEQ ID NO: 13444 - protein, 7 aa, Artificial Sequence
  Synthetic
SWPGGSM

SEQ ID NO: 13445 - protein, 7 aa, Artificial Sequence
  Synthetic
LYSGLAQ

SEQ ID NO: 13446 - protein, 7 aa, Artificial Sequence
  Synthetic
RAMGLAQ

SEQ ID NO: 13447 - protein, 7 aa, Artificial Sequence
  Synthetic
FERFGSA

SEQ ID NO: 13448 - protein, 7 aa, Artificial Sequence
  Synthetic
AFLHGAA

SEQ ID NO: 13449 - protein, 7 aa, Artificial Sequence
  Synthetic
KHTGFSQ

SEQ ID NO: 13450 - protein, 7 aa, Artificial Sequence
  Synthetic
GFPGFST

SEQ ID NO: 13451 - protein, 7 aa, Artificial Sequence
  Synthetic
MKYGGST

SEQ ID NO: 13452 - protein, 7 aa, Artificial Sequence
  Synthetic
APLEVRW

SEQ ID NO: 13453 - protein, 7 aa, Artificial Sequence
  Synthetic
MHPGYSM

SEQ ID NO: 13454 - protein, 7 aa, Artificial Sequence
  Synthetic
GLDSRWN

SEQ ID NO: 13455 - protein, 7 aa, Artificial Sequence
  Synthetic
GNDPGRW

SEQ ID NO: 13456 - protein, 7 aa, Artificial Sequence
  Synthetic
GEAARWS

SEQ ID NO: 13457 - protein, 7 aa, Artificial Sequence
  Synthetic
WREGWST

SEQ ID NO: 13458 - protein, 7 aa, Artificial Sequence
  Synthetic
NVFHGSA

SEQ ID NO: 13459 - protein, 7 aa, Artificial Sequence
  Synthetic
HIYAGSS

SEQ ID NO: 13460 - protein, 7 aa, Artificial Sequence
  Synthetic
MKAGYSS

SEQ ID NO: 13461 - protein, 7 aa, Artificial Sequence
  Synthetic
GTRWNLE

SEQ ID NO: 13462 - protein, 7 aa, Artificial Sequence
  Synthetic
PFNYQAS

SEQ ID NO: 13463 - protein, 7 aa, Artificial Sequence
  Synthetic
FREHGSS

SEQ ID NO: 13464 - protein, 7 aa, Artificial Sequence
  Synthetic
RVEHGYA

SEQ ID NO: 13465 - protein, 7 aa, Artificial Sequence
  Synthetic
RYGGDSS

SEQ ID NO: 13466 - protein, 7 aa, Artificial Sequence
  Synthetic
LFAGYST

SEQ ID NO: 13467 - protein, 7 aa, Artificial Sequence
  Synthetic
YGWRLAE

SEQ ID NO: 13468 - protein, 7 aa, Artificial Sequence
  Synthetic
ERTGWAA

SEQ ID NO: 13469 - protein, 7 aa, Artificial Sequence
  Synthetic
YVEFPEF

SEQ ID NO: 13470 - protein, 7 aa, Artificial Sequence
  Synthetic
GRFDLRP

SEQ ID NO: 13471 - protein, 7 aa, Artificial Sequence
  Synthetic
GSNAGPW

SEQ ID NO: 13472 - protein, 7 aa, Artificial Sequence
  Synthetic
DTPVGRW

SEQ ID NO: 13473 - protein, 7 aa, Artificial Sequence
  Synthetic
GDMTGRW

SEQ ID NO: 13474 - protein, 7 aa, Artificial Sequence
  Synthetic
RIPGFSA

SEQ ID NO: 13475 - protein, 7 aa, Artificial Sequence
  Synthetic
RHPGEAS

SEQ ID NO: 13476 - protein, 7 aa, Artificial Sequence
  Synthetic
MWAGAAS

SEQ ID NO: 13477 - protein, 7 aa, Artificial Sequence
  Synthetic
WVTQGAA

SEQ ID NO: 13478 - protein, 7 aa, Artificial Sequence
  Synthetic
LLKGWSA

SEQ ID NO: 13479 - protein, 7 aa, Artificial Sequence
  Synthetic
VRYEGAS

SEQ ID NO: 13480 - protein, 7 aa, Artificial Sequence
  Synthetic
SVPGWSS

SEQ ID NO: 13481 - protein, 7 aa, Artificial Sequence
  Synthetic
LVPGLSS

SEQ ID NO: 13482 - protein, 7 aa, Artificial Sequence
  Synthetic
TNPLWSA

SEQ ID NO: 13483 - protein, 7 aa, Artificial Sequence
  Synthetic
WVFGNVA

SEQ ID NO: 13484 - protein, 7 aa, Artificial Sequence
  Synthetic
DLVGGRW

SEQ ID NO: 13485 - protein, 7 aa, Artificial Sequence
  Synthetic
PHPQWSA

SEQ ID NO: 13486 - protein, 7 aa, Artificial Sequence
  Synthetic
WRDMGSQ

SEQ ID NO: 13487 - protein, 7 aa, Artificial Sequence
  Synthetic
VVPGFSY

SEQ ID NO: 13488 - protein, 7 aa, Artificial Sequence
  Synthetic
GESAGRW

SEQ ID NO: 13489 - protein, 7 aa, Artificial Sequence
  Synthetic
AGNPGAW

SEQ ID NO: 13490 - protein, 7 aa, Artificial Sequence
  Synthetic
PLVQHSW

SEQ ID NO: 13491 - protein, 7 aa, Artificial Sequence
  Synthetic
QKAGPNW

SEQ ID NO: 13492 - protein, 7 aa, Artificial Sequence
  Synthetic
GQANWAS

SEQ ID NO: 13493 - protein, 7 aa, Artificial Sequence
  Synthetic
FGSLARL

SEQ ID NO: 13494 - protein, 7 aa, Artificial Sequence
  Synthetic
HVEFGSS

SEQ ID NO: 13495 - protein, 7 aa, Artificial Sequence
  Synthetic
RFIADQA

SEQ ID NO: 13496 - protein, 7 aa, Artificial Sequence
  Synthetic
GLDNGRW

SEQ ID NO: 13497 - protein, 7 aa, Artificial Sequence
  Synthetic
HAKLGSS

SEQ ID NO: 13498 - protein, 7 aa, Artificial Sequence
  Synthetic
MNHGYSM

SEQ ID NO: 13499 - protein, 7 aa, Artificial Sequence
  Synthetic
LQSTWSS

SEQ ID NO: 13500 - protein, 7 aa, Artificial Sequence
  Synthetic
LKIGYAT

SEQ ID NO: 13501 - protein, 7 aa, Artificial Sequence
  Synthetic
QYGFGSS

SEQ ID NO: 13502 - protein, 7 aa, Artificial Sequence
  Synthetic
GIMDGFR

SEQ ID NO: 13503 - protein, 7 aa, Artificial Sequence
  Synthetic
VLVGRTG

SEQ ID NO: 13504 - protein, 7 aa, Artificial Sequence
  Synthetic
RVWAESQ

SEQ ID NO: 13505 - protein, 7 aa, Artificial Sequence
  Synthetic
SAWGQAQ

SEQ ID NO: 13506 - protein, 7 aa, Artificial Sequence
  Synthetic
PILKYGA

SEQ ID NO: 13507 - protein, 7 aa, Artificial Sequence
  Synthetic
KVGFGSS

SEQ ID NO: 13508 - protein, 7 aa, Artificial Sequence
  Synthetic
VLSGFSQ

SEQ ID NO: 13509 - protein, 7 aa, Artificial Sequence
  Synthetic
WSVQGGF

SEQ ID NO: 13510 - protein, 7 aa, Artificial Sequence
  Synthetic
VQWEGSS

SEQ ID NO: 13511 - protein, 7 aa, Artificial Sequence
  Synthetic
EFYGGSR

SEQ ID NO: 13512 - protein, 7 aa, Artificial Sequence
  Synthetic
LISFGSA

SEQ ID NO: 13513 - protein, 7 aa, Artificial Sequence
  Synthetic
YGMLASY

SEQ ID NO: 13514 - protein, 7 aa, Artificial Sequence
  Synthetic
FAYGSAQ

SEQ ID NO: 13515 - protein, 7 aa, Artificial Sequence
  Synthetic
TNVGTIY

SEQ ID NO: 13516 - protein, 7 aa, Artificial Sequence
  Synthetic
PVNPGVW

SEQ ID NO: 13517 - protein, 7 aa, Artificial Sequence
  Synthetic
SKVLFSA

SEQ ID NO: 13518 - protein, 7 aa, Artificial Sequence
  Synthetic
TIPGLSS

SEQ ID NO: 13519 - protein, 7 aa, Artificial Sequence
  Synthetic
LWAGASQ

SEQ ID NO: 13520 - protein, 7 aa, Artificial Sequence
  Synthetic
INKTDYW

SEQ ID NO: 13521 - protein, 7 aa, Artificial Sequence
  Synthetic
KVQGFSS

SEQ ID NO: 13522 - protein, 7 aa, Artificial Sequence
  Synthetic
AGFGQAQ

SEQ ID NO: 13523 - protein, 7 aa, Artificial Sequence
  Synthetic
EKVNWSV

SEQ ID NO: 13524 - protein, 7 aa, Artificial Sequence
  Synthetic
YGSLQGW

SEQ ID NO: 13525 - protein, 7 aa, Artificial Sequence
  Synthetic
RFAGDSS

SEQ ID NO: 13526 - protein, 7 aa, Artificial Sequence
  Synthetic
SRVGSVY

SEQ ID NO: 13527 - protein, 7 aa, Artificial Sequence
  Synthetic
SHPGFSS

SEQ ID NO: 13528 - protein, 7 aa, Artificial Sequence
  Synthetic
GADTGRW

SEQ ID NO: 13529 - protein, 7 aa, Artificial Sequence
  Synthetic
SMRLGST

SEQ ID NO: 13530 - protein, 7 aa, Artificial Sequence
  Synthetic
MASKFSS

SEQ ID NO: 13531 - protein, 7 aa, Artificial Sequence
  Synthetic
IQVGSIY

SEQ ID NO: 13532 - protein, 7 aa, Artificial Sequence
  Synthetic
WGSPSHS

SEQ ID NO: 13533 - protein, 7 aa, Artificial Sequence
  Synthetic
SEAWNRA

SEQ ID NO: 13534 - protein, 7 aa, Artificial Sequence
  Synthetic
SARLGST

SEQ ID NO: 13535 - protein, 7 aa, Artificial Sequence
  Synthetic
FGSLALI

SEQ ID NO: 13536 - protein, 7 aa, Artificial Sequence
  Synthetic
WRSLPES

SEQ ID NO: 13537 - protein, 7 aa, Artificial Sequence
  Synthetic
WGRLEAI

SEQ ID NO: 13538 - protein, 7 aa, Artificial Sequence
  Synthetic
MASYGSS

SEQ ID NO: 13539 - protein, 7 aa, Artificial Sequence
  Synthetic
DTFRGST

SEQ ID NO: 13540 - protein, 7 aa, Artificial Sequence
  Synthetic
IVTFGSA

SEQ ID NO: 13541 - protein, 7 aa, Artificial Sequence
  Synthetic
ERAHGSS

SEQ ID NO: 13542 - protein, 7 aa, Artificial Sequence
  Synthetic
VFSGYSS

SEQ ID NO: 13543 - protein, 7 aa, Artificial Sequence
  Synthetic
KLFYPDG

SEQ ID NO: 13544 - protein, 7 aa, Artificial Sequence
  Synthetic
GSWQGSS

SEQ ID NO: 13545 - protein, 7 aa, Artificial Sequence
  Synthetic
LIPFQSQ

SEQ ID NO: 13546 - protein, 7 aa, Artificial Sequence
  Synthetic
KVWGELS

SEQ ID NO: 13547 - protein, 7 aa, Artificial Sequence
  Synthetic
RAPADRA

SEQ ID NO: 13548 - protein, 7 aa, Artificial Sequence
  Synthetic
TFHGGSI

SEQ ID NO: 13549 - protein, 7 aa, Artificial Sequence
  Synthetic
RFIADHA

SEQ ID NO: 13550 - protein, 7 aa, Artificial Sequence
  Synthetic
LLRGYSN

SEQ ID NO: 13551 - protein, 7 aa, Artificial Sequence
  Synthetic
YHVGTIY

SEQ ID NO: 13552 - protein, 7 aa, Artificial Sequence
  Synthetic
WGMTTGF

SEQ ID NO: 13553 - protein, 7 aa, Artificial Sequence
  Synthetic
TFYGGAS

SEQ ID NO: 13554 - protein, 7 aa, Artificial Sequence
  Synthetic
DYRPASS

SEQ ID NO: 13555 - protein, 7 aa, Artificial Sequence
  Synthetic
YATLGSS

SEQ ID NO: 13556 - protein, 7 aa, Artificial Sequence
  Synthetic
RLAGYNV

SEQ ID NO: 13557 - protein, 7 aa, Artificial Sequence
  Synthetic
HGVNWSH

SEQ ID NO: 13558 - protein, 7 aa, Artificial Sequence
  Synthetic
MLKYGST

SEQ ID NO: 13559 - protein, 7 aa, Artificial Sequence
  Synthetic
WSPYSPN

SEQ ID NO: 13560 - protein, 7 aa, Artificial Sequence
  Synthetic
PSNQGVW

SEQ ID NO: 13561 - protein, 7 aa, Artificial Sequence
  Synthetic
WKIGFSS

SEQ ID NO: 13562 - protein, 7 aa, Artificial Sequence
  Synthetic
WMKGGSQ

SEQ ID NO: 13563 - protein, 7 aa, Artificial Sequence
  Synthetic
DDRVTRW

SEQ ID NO: 13564 - protein, 7 aa, Artificial Sequence
  Synthetic
RYDSGVW

SEQ ID NO: 13565 - protein, 7 aa, Artificial Sequence
  Synthetic
YPYDLGR

SEQ ID NO: 13566 - protein, 7 aa, Artificial Sequence
  Synthetic
DGASGRW

SEQ ID NO: 13567 - protein, 7 aa, Artificial Sequence
  Synthetic
SRILGST

SEQ ID NO: 13568 - protein, 7 aa, Artificial Sequence
  Synthetic
DRPGFSY

SEQ ID NO: 13569 - protein, 7 aa, Artificial Sequence
  Synthetic
VRAMGST

SEQ ID NO: 13570 - protein, 7 aa, Artificial Sequence
  Synthetic
WRHEGSV

SEQ ID NO: 13571 - protein, 7 aa, Artificial Sequence
  Synthetic
EVFRGAA

SEQ ID NO: 13572 - protein, 7 aa, Artificial Sequence
  Synthetic
WSTHTGF

SEQ ID NO: 13573 - protein, 7 aa, Artificial Sequence
  Synthetic
HVAYGST

SEQ ID NO: 13574 - protein, 7 aa, Artificial Sequence
  Synthetic
HRTLMSS

SEQ ID NO: 13575 - protein, 7 aa, Artificial Sequence
  Synthetic
WGSLSAV

SEQ ID NO: 13576 - protein, 7 aa, Artificial Sequence
  Synthetic
RYIGDSA

SEQ ID NO: 13577 - protein, 7 aa, Artificial Sequence
  Synthetic
VHQGYSS

SEQ ID NO: 13578 - protein, 7 aa, Artificial Sequence
  Synthetic
PTWGHAA

SEQ ID NO: 13579 - protein, 7 aa, Artificial Sequence
  Synthetic
TYPLGSA

SEQ ID NO: 13580 - protein, 7 aa, Artificial Sequence
  Synthetic
KVPGYSA

SEQ ID NO: 13581 - protein, 7 aa, Artificial Sequence
  Synthetic
AKAGWSS

SEQ ID NO: 13582 - protein, 7 aa, Artificial Sequence
  Synthetic
ILIGRGG

SEQ ID NO: 13583 - protein, 7 aa, Artificial Sequence
  Synthetic
ARLLGSS

SEQ ID NO: 13584 - protein, 7 aa, Artificial Sequence
  Synthetic
WSLQGAY

SEQ ID NO: 13585 - protein, 7 aa, Artificial Sequence
  Synthetic
GSRPGPW

SEQ ID NO: 13586 - protein, 7 aa, Artificial Sequence
  Synthetic
EAYMGSV

SEQ ID NO: 13587 - protein, 7 aa, Artificial Sequence
  Synthetic
WGLGDGY

SEQ ID NO: 13588 - protein, 7 aa, Artificial Sequence
  Synthetic
TRAGYSS

SEQ ID NO: 13589 - protein, 7 aa, Artificial Sequence
  Synthetic
GYPGDRT

SEQ ID NO: 13590 - protein, 7 aa, Artificial Sequence
  Synthetic
PKATWSA

SEQ ID NO: 13591 - protein, 7 aa, Artificial Sequence
  Synthetic
TRALGST

SEQ ID NO: 13592 - protein, 7 aa, Artificial Sequence
  Synthetic
AFPGAAQ

SEQ ID NO: 13593 - protein, 7 aa, Artificial Sequence
  Synthetic
VNEFARY

SEQ ID NO: 13594 - protein, 7 aa, Artificial Sequence
  Synthetic
FMAGYSN

SEQ ID NO: 13595 - protein, 7 aa, Artificial Sequence
  Synthetic
DKAVWSS

SEQ ID NO: 13596 - protein, 7 aa, Artificial Sequence
  Synthetic
PRVGYAS

SEQ ID NO: 13597 - protein, 7 aa, Artificial Sequence
  Synthetic
WSLGGSS

SEQ ID NO: 13598 - protein, 7 aa, Artificial Sequence
  Synthetic
DPRWSSA

SEQ ID NO: 13599 - protein, 7 aa, Artificial Sequence
  Synthetic
DRHLGST

SEQ ID NO: 13600 - protein, 7 aa, Artificial Sequence
  Synthetic
QNYNGSI

SEQ ID NO: 13601 - protein, 7 aa, Artificial Sequence
  Synthetic
MYPAGSI

SEQ ID NO: 13602 - protein, 7 aa, Artificial Sequence
  Synthetic
WSTATGY

SEQ ID NO: 13603 - protein, 7 aa, Artificial Sequence
  Synthetic
SIYLGSS

SEQ ID NO: 13604 - protein, 7 aa, Artificial Sequence
  Synthetic
RFTGDPA

SEQ ID NO: 13605 - protein, 7 aa, Artificial Sequence
  Synthetic
RFVSDAT

SEQ ID NO: 13606 - protein, 7 aa, Artificial Sequence
  Synthetic
DGREGRW

SEQ ID NO: 13607 - protein, 7 aa, Artificial Sequence
  Synthetic
KLYQLDH

SEQ ID NO: 13608 - protein, 7 aa, Artificial Sequence
  Synthetic
EHPSRWS

SEQ ID NO: 13609 - protein, 7 aa, Artificial Sequence
  Synthetic
DPIWKSS

SEQ ID NO: 13610 - protein, 7 aa, Artificial Sequence
  Synthetic
SAPGWST

SEQ ID NO: 13611 - protein, 7 aa, Artificial Sequence
  Synthetic
EWPGYAM

SEQ ID NO: 13612 - protein, 7 aa, Artificial Sequence
  Synthetic
LIAGYSS

SEQ ID NO: 13613 - protein, 7 aa, Artificial Sequence
  Synthetic
SYQGYSS

SEQ ID NO: 13614 - protein, 7 aa, Artificial Sequence
  Synthetic
KRFAVDV

SEQ ID NO: 13615 - protein, 7 aa, Artificial Sequence
  Synthetic
VAHGFSM

SEQ ID NO: 13616 - protein, 7 aa, Artificial Sequence
  Synthetic
LYRGESS

SEQ ID NO: 13617 - protein, 7 aa, Artificial Sequence
  Synthetic
MRAGLAQ

SEQ ID NO: 13618 - protein, 7 aa, Artificial Sequence
  Synthetic
NSHPGVW

SEQ ID NO: 13619 - protein, 7 aa, Artificial Sequence
  Synthetic
SIGYGSS

SEQ ID NO: 13620 - protein, 7 aa, Artificial Sequence
  Synthetic
SVWAGSS

SEQ ID NO: 13621 - protein, 7 aa, Artificial Sequence
  Synthetic
QYIGQSS

SEQ ID NO: 13622 - protein, 7 aa, Artificial Sequence
  Synthetic
SLLHGYG

SEQ ID NO: 13623 - protein, 7 aa, Artificial Sequence
  Synthetic
WGSPPHS

SEQ ID NO: 13624 - protein, 7 aa, Artificial Sequence
  Synthetic
LDYRGST

SEQ ID NO: 13625 - protein, 7 aa, Artificial Sequence
  Synthetic
GADVSRW

SEQ ID NO: 13626 - protein, 7 aa, Artificial Sequence
  Synthetic
LGPSHWN

SEQ ID NO: 13627 - protein, 7 aa, Artificial Sequence
  Synthetic
KQWGSVE

SEQ ID NO: 13628 - protein, 7 aa, Artificial Sequence
  Synthetic
GWHGGSM

SEQ ID NO: 13629 - protein, 7 aa, Artificial Sequence
  Synthetic
HQRLGSS

SEQ ID NO: 13630 - protein, 7 aa, Artificial Sequence
  Synthetic
VVTTTWN

SEQ ID NO: 13631 - protein, 7 aa, Artificial Sequence
  Synthetic
GELTGRW

SEQ ID NO: 13632 - protein, 7 aa, Artificial Sequence
  Synthetic
GASWDRA

SEQ ID NO: 13633 - protein, 7 aa, Artificial Sequence
  Synthetic
QFTHGSA

SEQ ID NO: 13634 - protein, 7 aa, Artificial Sequence
  Synthetic
LVKHGFS

SEQ ID NO: 13635 - protein, 7 aa, Artificial Sequence
  Synthetic
IRTGYAQ

SEQ ID NO: 13636 - protein, 7 aa, Artificial Sequence
  Synthetic
LYHGHAS

SEQ ID NO: 13637 - protein, 7 aa, Artificial Sequence
  Synthetic
LPRDARW

SEQ ID NO: 13638 - protein, 7 aa, Artificial Sequence
  Synthetic
WATLGSA

SEQ ID NO: 13639 - protein, 7 aa, Artificial Sequence
  Synthetic
WLNGYND

SEQ ID NO: 13640 - protein, 7 aa, Artificial Sequence
  Synthetic
WKQLGSS

SEQ ID NO: 13641 - protein, 7 aa, Artificial Sequence
  Synthetic
LYAGFSS

SEQ ID NO: 13642 - protein, 7 aa, Artificial Sequence
  Synthetic
GWAGGSS

SEQ ID NO: 13643 - protein, 7 aa, Artificial Sequence
  Synthetic
GAWHGST

SEQ ID NO: 13644 - protein, 7 aa, Artificial Sequence
  Synthetic
PAVGSVY

SEQ ID NO: 13645 - protein, 7 aa, Artificial Sequence
  Synthetic
LAWQGSQ

SEQ ID NO: 13646 - protein, 7 aa, Artificial Sequence
  Synthetic
PIPRLAS

SEQ ID NO: 13647 - protein, 7 aa, Artificial Sequence
  Synthetic
LQSRYSA

SEQ ID NO: 13648 - protein, 7 aa, Artificial Sequence
  Synthetic
GMAGWSS

SEQ ID NO: 13649 - protein, 7 aa, Artificial Sequence
  Synthetic
LNLGYSQ

SEQ ID NO: 13650 - protein, 7 aa, Artificial Sequence
  Synthetic
ELTWTAA

SEQ ID NO: 13651 - protein, 7 aa, Artificial Sequence
  Synthetic
NDKYAGW

SEQ ID NO: 13652 - protein, 7 aa, Artificial Sequence
  Synthetic
VWIGGSS

SEQ ID NO: 13653 - protein, 7 aa, Artificial Sequence
  Synthetic
VLYRESL

SEQ ID NO: 13654 - protein, 7 aa, Artificial Sequence
  Synthetic
GYVDMRF

SEQ ID NO: 13655 - protein, 7 aa, Artificial Sequence
  Synthetic
TRPAAWE

SEQ ID NO: 13656 - protein, 7 aa, Artificial Sequence
  Synthetic
FNSQFSY

SEQ ID NO: 13657 - protein, 7 aa, Artificial Sequence
  Synthetic
EFPGWSS

SEQ ID NO: 13658 - protein, 7 aa, Artificial Sequence
  Synthetic
KINSGAW

SEQ ID NO: 13659 - protein, 7 aa, Artificial Sequence
  Synthetic
KEAWDRA

SEQ ID NO: 13660 - protein, 7 aa, Artificial Sequence
  Synthetic
EWPADRS

SEQ ID NO: 13661 - protein, 7 aa, Artificial Sequence
  Synthetic
AWPGGAA

SEQ ID NO: 13662 - protein, 7 aa, Artificial Sequence
  Synthetic
MRDYGST

SEQ ID NO: 13663 - protein, 7 aa, Artificial Sequence
  Synthetic
RTVGSAY

SEQ ID NO: 13664 - protein, 7 aa, Artificial Sequence
  Synthetic
TSINRLY

SEQ ID NO: 13665 - protein, 7 aa, Artificial Sequence
  Synthetic
DLNTSRW

SEQ ID NO: 13666 - protein, 7 aa, Artificial Sequence
  Synthetic
GGHVGAW

SEQ ID NO: 13667 - protein, 7 aa, Artificial Sequence
  Synthetic
LSIGFSV

SEQ ID NO: 13668 - protein, 7 aa, Artificial Sequence
  Synthetic
APVRLTN

SEQ ID NO: 13669 - protein, 7 aa, Artificial Sequence
  Synthetic
VSVASHW

SEQ ID NO: 13670 - protein, 7 aa, Artificial Sequence
  Synthetic
TMRLMSS

SEQ ID NO: 13671 - protein, 7 aa, Artificial Sequence
  Synthetic
RVYGGSQ

SEQ ID NO: 13672 - protein, 7 aa, Artificial Sequence
  Synthetic
LASWIGA

SEQ ID NO: 13673 - protein, 7 aa, Artificial Sequence
  Synthetic
LHYGSSS

SEQ ID NO: 13674 - protein, 7 aa, Artificial Sequence
  Synthetic
MVTLVQP

SEQ ID NO: 13675 - protein, 7 aa, Artificial Sequence
  Synthetic
FMPLGSS

SEQ ID NO: 13676 - protein, 7 aa, Artificial Sequence
  Synthetic
LFMAGSS

SEQ ID NO: 13677 - protein, 7 aa, Artificial Sequence
  Synthetic
HPTWSSA

SEQ ID NO: 13678 - protein, 7 aa, Artificial Sequence
  Synthetic
RYHSDAS

SEQ ID NO: 13679 - protein, 7 aa, Artificial Sequence
  Synthetic
WHMESGF

SEQ ID NO: 13680 - protein, 7 aa, Artificial Sequence
  Synthetic
EGALFRN

SEQ ID NO: 13681 - protein, 7 aa, Artificial Sequence
  Synthetic
DPNWDLG

SEQ ID NO: 13682 - protein, 7 aa, Artificial Sequence
  Synthetic
PEVRNSW

SEQ ID NO: 13683 - protein, 7 aa, Artificial Sequence
  Synthetic
LWVGSSS

SEQ ID NO: 13684 - protein, 7 aa, Artificial Sequence
  Synthetic
PRFGMAS

SEQ ID NO: 13685 - protein, 7 aa, Artificial Sequence
  Synthetic
VQVGYAQ

SEQ ID NO: 13686 - protein, 7 aa, Artificial Sequence
  Synthetic
MDTFPRG

SEQ ID NO: 13687 - protein, 7 aa, Artificial Sequence
  Synthetic
GRLLLVN

SEQ ID NO: 13688 - protein, 7 aa, Artificial Sequence
  Synthetic
MLSHGSS

SEQ ID NO: 13689 - protein, 7 aa, Artificial Sequence
  Synthetic
WNLSSGY

SEQ ID NO: 13690 - protein, 7 aa, Artificial Sequence
  Synthetic
EKYYSSA

SEQ ID NO: 13691 - protein, 7 aa, Artificial Sequence
  Synthetic
DRGGFAY

SEQ ID NO: 13692 - protein, 7 aa, Artificial Sequence
  Synthetic
DLNTNRW

SEQ ID NO: 13693 - protein, 7 aa, Artificial Sequence
  Synthetic
GYESGRW

SEQ ID NO: 13694 - protein, 7 aa, Artificial Sequence
  Synthetic
EKWGSST

SEQ ID NO: 13695 - protein, 7 aa, Artificial Sequence
  Synthetic
VVYNGST

SEQ ID NO: 13696 - protein, 7 aa, Artificial Sequence
  Synthetic
GSKWHLE

SEQ ID NO: 13697 - protein, 7 aa, Artificial Sequence
  Synthetic
DENPGRW

SEQ ID NO: 13698 - protein, 7 aa, Artificial Sequence
  Synthetic
GHPLSFS

SEQ ID NO: 13699 - protein, 7 aa, Artificial Sequence
  Synthetic
IDHSHWV

SEQ ID NO: 13700 - protein, 7 aa, Artificial Sequence
  Synthetic
DRYLGAT

SEQ ID NO: 13701 - protein, 7 aa, Artificial Sequence
  Synthetic
REFDLRN

SEQ ID NO: 13702 - protein, 7 aa, Artificial Sequence
  Synthetic
GNNPGLW

SEQ ID NO: 13703 - protein, 7 aa, Artificial Sequence
  Synthetic
YDRGYST

SEQ ID NO: 13704 - protein, 7 aa, Artificial Sequence
  Synthetic
MMPLGSS

SEQ ID NO: 13705 - protein, 7 aa, Artificial Sequence
  Synthetic
PQWGNLS

SEQ ID NO: 13706 - protein, 7 aa, Artificial Sequence
  Synthetic
SVSYGSA

SEQ ID NO: 13707 - protein, 7 aa, Artificial Sequence
  Synthetic
GVYMGSS

SEQ ID NO: 13708 - protein, 7 aa, Artificial Sequence
  Synthetic
QRFDNRP

SEQ ID NO: 13709 - protein, 7 aa, Artificial Sequence
  Synthetic
ERIGMSS

SEQ ID NO: 13710 - protein, 7 aa, Artificial Sequence
  Synthetic
LVSHFSS

SEQ ID NO: 13711 - protein, 7 aa, Artificial Sequence
  Synthetic
TAHGYSS

SEQ ID NO: 13712 - protein, 7 aa, Artificial Sequence
  Synthetic
FAHGYAM

SEQ ID NO: 13713 - protein, 7 aa, Artificial Sequence
  Synthetic
SWPGSSV

SEQ ID NO: 13714 - protein, 7 aa, Artificial Sequence
  Synthetic
SYGDGRW

SEQ ID NO: 13715 - protein, 7 aa, Artificial Sequence
  Synthetic
VLAGYRP

SEQ ID NO: 13716 - protein, 7 aa, Artificial Sequence
  Synthetic
GGNPGVW

SEQ ID NO: 13717 - protein, 7 aa, Artificial Sequence
  Synthetic
LVHSGAW

SEQ ID NO: 13718 - protein, 7 aa, Artificial Sequence
  Synthetic
MATRGST

SEQ ID NO: 13719 - protein, 7 aa, Artificial Sequence
  Synthetic
IKAPGPW

SEQ ID NO: 13720 - protein, 7 aa, Artificial Sequence
  Synthetic
WLHGYSS

SEQ ID NO: 13721 - protein, 7 aa, Artificial Sequence
  Synthetic
LESKFSS

SEQ ID NO: 13722 - protein, 7 aa, Artificial Sequence
  Synthetic
MQKGFST

SEQ ID NO: 13723 - protein, 7 aa, Artificial Sequence
  Synthetic
TMPGYSA

SEQ ID NO: 13724 - protein, 7 aa, Artificial Sequence
  Synthetic
AVRVNGW

SEQ ID NO: 13725 - protein, 7 aa, Artificial Sequence
  Synthetic
SFSGIPV

SEQ ID NO: 13726 - protein, 7 aa, Artificial Sequence
  Synthetic
YRELPRV

SEQ ID NO: 13727 - protein, 7 aa, Artificial Sequence
  Synthetic
SSPGWSS

SEQ ID NO: 13728 - protein, 7 aa, Artificial Sequence
  Synthetic
EPRWSLD

SEQ ID NO: 13729 - protein, 7 aa, Artificial Sequence
  Synthetic
RSEHSNW

SEQ ID NO: 13730 - protein, 7 aa, Artificial Sequence
  Synthetic
VAAGFAQ

SEQ ID NO: 13731 - protein, 7 aa, Artificial Sequence
  Synthetic
TYHGYAS

SEQ ID NO: 13732 - protein, 7 aa, Artificial Sequence
  Synthetic
WRSNGSS

SEQ ID NO: 13733 - protein, 7 aa, Artificial Sequence
  Synthetic
VMRGYAA

SEQ ID NO: 13734 - protein, 7 aa, Artificial Sequence
  Synthetic
WVSLGSA

SEQ ID NO: 13735 - protein, 7 aa, Artificial Sequence
  Synthetic
VYIGMSS

SEQ ID NO: 13736 - protein, 7 aa, Artificial Sequence
  Synthetic
RSGYADW

SEQ ID NO: 13737 - protein, 7 aa, Artificial Sequence
  Synthetic
LQASWSH

SEQ ID NO: 13738 - protein, 7 aa, Artificial Sequence
  Synthetic
RYEADAA

SEQ ID NO: 13739 - protein, 7 aa, Artificial Sequence
  Synthetic
WTLGTGH

SEQ ID NO: 13740 - protein, 7 aa, Artificial Sequence
  Synthetic
LNYGGSM

SEQ ID NO: 13741 - protein, 7 aa, Artificial Sequence
  Synthetic
KQMGFSS

SEQ ID NO: 13742 - protein, 7 aa, Artificial Sequence
  Synthetic
DTHAGRW

SEQ ID NO: 13743 - protein, 7 aa, Artificial Sequence
  Synthetic
WPGFTST

SEQ ID NO: 13744 - protein, 7 aa, Artificial Sequence
  Synthetic
RHPGGAQ

SEQ ID NO: 13745 - protein, 7 aa, Artificial Sequence
  Synthetic
YYLPNGD

SEQ ID NO: 13746 - protein, 7 aa, Artificial Sequence
  Synthetic
LARMGST

SEQ ID NO: 13747 - protein, 7 aa, Artificial Sequence
  Synthetic
LVQYGSA

SEQ ID NO: 13748 - protein, 7 aa, Artificial Sequence
  Synthetic
SIRPNGW

SEQ ID NO: 13749 - protein, 7 aa, Artificial Sequence
  Synthetic
LYHGSSS

SEQ ID NO: 13750 - protein, 7 aa, Artificial Sequence
  Synthetic
KAPGFSQ

SEQ ID NO: 13751 - protein, 7 aa, Artificial Sequence
  Synthetic
LATYLAS

SEQ ID NO: 13752 - protein, 7 aa, Artificial Sequence
  Synthetic
GILQGYG

SEQ ID NO: 13753 - protein, 7 aa, Artificial Sequence
  Synthetic
KHPGLSS

SEQ ID NO: 13754 - protein, 7 aa, Artificial Sequence
  Synthetic
LYTGLAQ

SEQ ID NO: 13755 - protein, 7 aa, Artificial Sequence
  Synthetic
DVKWSYS

SEQ ID NO: 13756 - protein, 7 aa, Artificial Sequence
  Synthetic
RYSLGEP

SEQ ID NO: 13757 - protein, 7 aa, Artificial Sequence
  Synthetic
PLPNWSH

SEQ ID NO: 13758 - protein, 7 aa, Artificial Sequence
  Synthetic
TLRLGST

SEQ ID NO: 13759 - protein, 7 aa, Artificial Sequence
  Synthetic
TYHGGAS

SEQ ID NO: 13760 - protein, 7 aa, Artificial Sequence
  Synthetic
HTQYEGW

SEQ ID NO: 13761 - protein, 7 aa, Artificial Sequence
  Synthetic
FGPFLSS

SEQ ID NO: 13762 - protein, 7 aa, Artificial Sequence
  Synthetic
IVWNGSS

SEQ ID NO: 13763 - protein, 7 aa, Artificial Sequence
  Synthetic
PVDSARW

SEQ ID NO: 13764 - protein, 7 aa, Artificial Sequence
  Synthetic
WSVHGSS

SEQ ID NO: 13765 - protein, 7 aa, Artificial Sequence
  Synthetic
QRAGWAA

SEQ ID NO: 13766 - protein, 7 aa, Artificial Sequence
  Synthetic
RFLGDIS

SEQ ID NO: 13767 - protein, 7 aa, Artificial Sequence
  Synthetic
RYPGGAQ

SEQ ID NO: 13768 - protein, 7 aa, Artificial Sequence
  Synthetic
VRAGFSS

SEQ ID NO: 13769 - protein, 7 aa, Artificial Sequence
  Synthetic
WVLPDHG

SEQ ID NO: 13770 - protein, 7 aa, Artificial Sequence
  Synthetic
QGNPGLW

SEQ ID NO: 13771 - protein, 7 aa, Artificial Sequence
  Synthetic
SVTGRLY

SEQ ID NO: 13772 - protein, 7 aa, Artificial Sequence
  Synthetic
PETSRHW

SEQ ID NO: 13773 - protein, 7 aa, Artificial Sequence
  Synthetic
PWPGMSS

SEQ ID NO: 13774 - protein, 7 aa, Artificial Sequence
  Synthetic
GDWSRIA

SEQ ID NO: 13775 - protein, 7 aa, Artificial Sequence
  Synthetic
DSRFGSS

SEQ ID NO: 13776 - protein, 7 aa, Artificial Sequence
  Synthetic
MRSGLSQ

SEQ ID NO: 13777 - protein, 7 aa, Artificial Sequence
  Synthetic
LNWSGSS

SEQ ID NO: 13778 - protein, 7 aa, Artificial Sequence
  Synthetic
SYRPAPA

SEQ ID NO: 13779 - protein, 7 aa, Artificial Sequence
  Synthetic
MFHSGST

SEQ ID NO: 13780 - protein, 7 aa, Artificial Sequence
  Synthetic
PRNTNGW

SEQ ID NO: 13781 - protein, 7 aa, Artificial Sequence
  Synthetic
EGPSRWD

SEQ ID NO: 13782 - protein, 7 aa, Artificial Sequence
  Synthetic
LAPPWSS

SEQ ID NO: 13783 - protein, 7 aa, Artificial Sequence
  Synthetic
YASWVPK

SEQ ID NO: 13784 - protein, 7 aa, Artificial Sequence
  Synthetic
HWSGGSS

SEQ ID NO: 13785 - protein, 7 aa, Artificial Sequence
  Synthetic
VYVGHSS

SEQ ID NO: 13786 - protein, 7 aa, Artificial Sequence
  Synthetic
PTWGSGS

SEQ ID NO: 13787 - protein, 7 aa, Artificial Sequence
  Synthetic
ESVAGYW

SEQ ID NO: 13788 - protein, 7 aa, Artificial Sequence
  Synthetic
TERYGST

SEQ ID NO: 13789 - protein, 7 aa, Artificial Sequence
  Synthetic
EAKWGST

SEQ ID NO: 13790 - protein, 7 aa, Artificial Sequence
  Synthetic
LEIGWSS

SEQ ID NO: 13791 - protein, 7 aa, Artificial Sequence
  Synthetic
MAFLLQP

SEQ ID NO: 13792 - protein, 7 aa, Artificial Sequence
  Synthetic
VRSGYSA

SEQ ID NO: 13793 - protein, 7 aa, Artificial Sequence
  Synthetic
MYPGSSS

SEQ ID NO: 13794 - protein, 7 aa, Artificial Sequence
  Synthetic
TVRGYAS

SEQ ID NO: 13795 - protein, 7 aa, Artificial Sequence
  Synthetic
LIPRGST

SEQ ID NO: 13796 - protein, 7 aa, Artificial Sequence
  Synthetic
THAGFST

SEQ ID NO: 13797 - protein, 7 aa, Artificial Sequence
  Synthetic
VSYGSAY

SEQ ID NO: 13798 - protein, 7 aa, Artificial Sequence
  Synthetic
LQFRLPD

SEQ ID NO: 13799 - protein, 7 aa, Artificial Sequence
  Synthetic
MHSGYSS

SEQ ID NO: 13800 - protein, 7 aa, Artificial Sequence
  Synthetic
HPAWGSA

SEQ ID NO: 13801 - protein, 7 aa, Artificial Sequence
  Synthetic
GRDPGRW

SEQ ID NO: 13802 - protein, 7 aa, Artificial Sequence
  Synthetic
RYIGDNV

SEQ ID NO: 13803 - protein, 7 aa, Artificial Sequence
  Synthetic
DLTTRWA

SEQ ID NO: 13804 - protein, 7 aa, Artificial Sequence
  Synthetic
LRDGWSQ

SEQ ID NO: 13805 - protein, 7 aa, Artificial Sequence
  Synthetic
DPHWSSA

SEQ ID NO: 13806 - protein, 7 aa, Artificial Sequence
  Synthetic
ERTGYSM

SEQ ID NO: 13807 - protein, 7 aa, Artificial Sequence
  Synthetic
TIRMGSS

SEQ ID NO: 13808 - protein, 7 aa, Artificial Sequence
  Synthetic
QRIMGST

SEQ ID NO: 13809 - protein, 7 aa, Artificial Sequence
  Synthetic
ETPSRWS

SEQ ID NO: 13810 - protein, 7 aa, Artificial Sequence
  Synthetic
VSYHGSS

SEQ ID NO: 13811 - protein, 7 aa, Artificial Sequence
  Synthetic
MVPLGSS

SEQ ID NO: 13812 - protein, 7 aa, Artificial Sequence
  Synthetic
WTHNAGY

SEQ ID NO: 13813 - protein, 7 aa, Artificial Sequence
  Synthetic
WGSPQHS

SEQ ID NO: 13814 - protein, 7 aa, Artificial Sequence
  Synthetic
FTLQGRP

SEQ ID NO: 13815 - protein, 7 aa, Artificial Sequence
  Synthetic
VRMMGSS

SEQ ID NO: 13816 - protein, 7 aa, Artificial Sequence
  Synthetic
YLSGYTC

SEQ ID NO: 13817 - protein, 7 aa, Artificial Sequence
  Synthetic
PFPHTSA

SEQ ID NO: 13818 - protein, 7 aa, Artificial Sequence
  Synthetic
ERYVIQT

SEQ ID NO: 13819 - protein, 7 aa, Artificial Sequence
  Synthetic
GVNQARF

SEQ ID NO: 13820 - protein, 7 aa, Artificial Sequence
  Synthetic
RYQGDSA

SEQ ID NO: 13821 - protein, 7 aa, Artificial Sequence
  Synthetic
VVPGFSS

SEQ ID NO: 13822 - protein, 7 aa, Artificial Sequence
  Synthetic
GAPGWST

SEQ ID NO: 13823 - protein, 7 aa, Artificial Sequence
  Synthetic
EKYGGST

SEQ ID NO: 13824 - protein, 7 aa, Artificial Sequence
  Synthetic
WSLGGST

SEQ ID NO: 13825 - protein, 7 aa, Artificial Sequence
  Synthetic
RKEFGSS

SEQ ID NO: 13826 - protein, 7 aa, Artificial Sequence
  Synthetic
EQTWGSS

SEQ ID NO: 13827 - protein, 7 aa, Artificial Sequence
  Synthetic
SSYMGST

SEQ ID NO: 13828 - protein, 7 aa, Artificial Sequence
  Synthetic
LRPGWSQ

SEQ ID NO: 13829 - protein, 7 aa, Artificial Sequence
  Synthetic
MAPWTST

SEQ ID NO: 13830 - protein, 7 aa, Artificial Sequence
  Synthetic
CPALIHC

SEQ ID NO: 13831 - protein, 7 aa, Artificial Sequence
  Synthetic
ERTLWAA

SEQ ID NO: 13832 - protein, 7 aa, Artificial Sequence
  Synthetic
PDMHRQW

SEQ ID NO: 13833 - protein, 7 aa, Artificial Sequence
  Synthetic
LSYMGSH

SEQ ID NO: 13834 - protein, 7 aa, Artificial Sequence
  Synthetic
AITHGSA

SEQ ID NO: 13835 - protein, 7 aa, Artificial Sequence
  Synthetic
QSDLQYW

SEQ ID NO: 13836 - protein, 7 aa, Artificial Sequence
  Synthetic
WRDYGSM

SEQ ID NO: 13837 - protein, 7 aa, Artificial Sequence
  Synthetic
VNLGYSS

SEQ ID NO: 13838 - protein, 7 aa, Artificial Sequence
  Synthetic
EHGGGRW

SEQ ID NO: 13839 - protein, 7 aa, Artificial Sequence
  Synthetic
GIFAGQY

SEQ ID NO: 13840 - protein, 7 aa, Artificial Sequence
  Synthetic
GTGYDLR

SEQ ID NO: 13841 - protein, 7 aa, Artificial Sequence
  Synthetic
KGTNDFW

SEQ ID NO: 13842 - protein, 7 aa, Artificial Sequence
  Synthetic
DLSSARW

SEQ ID NO: 13843 - protein, 7 aa, Artificial Sequence
  Synthetic
FVYGQIA

SEQ ID NO: 13844 - protein, 7 aa, Artificial Sequence
  Synthetic
PVPVYGA

SEQ ID NO: 13845 - protein, 7 aa, Artificial Sequence
  Synthetic
PHAGYSA

SEQ ID NO: 13846 - protein, 7 aa, Artificial Sequence
  Synthetic
VLQAMGM

SEQ ID NO: 13847 - protein, 7 aa, Artificial Sequence
  Synthetic
RYAGDST

SEQ ID NO: 13848 - protein, 7 aa, Artificial Sequence
  Synthetic
LRVVLTN

SEQ ID NO: 13849 - protein, 7 aa, Artificial Sequence
  Synthetic
EKFRVDV

SEQ ID NO: 13850 - protein, 7 aa, Artificial Sequence
  Synthetic
YADWQRS

SEQ ID NO: 13851 - protein, 7 aa, Artificial Sequence
  Synthetic
PPFRVDV

SEQ ID NO: 13852 - protein, 7 aa, Artificial Sequence
  Synthetic
DRPYGSA

SEQ ID NO: 13853 - protein, 7 aa, Artificial Sequence
  Synthetic
AAFSNGW

SEQ ID NO: 13854 - protein, 7 aa, Artificial Sequence
  Synthetic
PHNPGAW

SEQ ID NO: 13855 - protein, 7 aa, Artificial Sequence
  Synthetic
AAPFFSS

SEQ ID NO: 13856 - protein, 7 aa, Artificial Sequence
  Synthetic
EFLGGST

SEQ ID NO: 13857 - protein, 7 aa, Artificial Sequence
  Synthetic
EYGEGRW

SEQ ID NO: 13858 - protein, 7 aa, Artificial Sequence
  Synthetic
LLRGLSS

SEQ ID NO: 13859 - protein, 7 aa, Artificial Sequence
  Synthetic
GQWQGST

SEQ ID NO: 13860 - protein, 7 aa, Artificial Sequence
  Synthetic
GEVNWSY

SEQ ID NO: 13861 - protein, 7 aa, Artificial Sequence
  Synthetic
DPGMVRW

SEQ ID NO: 13862 - protein, 7 aa, Artificial Sequence
  Synthetic
LRLGLST

SEQ ID NO: 13863 - protein, 7 aa, Artificial Sequence
  Synthetic
WSASMGY

SEQ ID NO: 13864 - protein, 7 aa, Artificial Sequence
  Synthetic
HVVLGYS

SEQ ID NO: 13865 - protein, 7 aa, Artificial Sequence
  Synthetic
KAFDLRT

SEQ ID NO: 13866 - protein, 7 aa, Artificial Sequence
  Synthetic
WQVDRGF

SEQ ID NO: 13867 - protein, 7 aa, Artificial Sequence
  Synthetic
YREYPDH

SEQ ID NO: 13868 - protein, 7 aa, Artificial Sequence
  Synthetic
HYVGSAS

SEQ ID NO: 13869 - protein, 7 aa, Artificial Sequence
  Synthetic
LYSGSIY

SEQ ID NO: 13870 - protein, 7 aa, Artificial Sequence
  Synthetic
EHYLGAA

SEQ ID NO: 13871 - protein, 7 aa, Artificial Sequence
  Synthetic
DHKWESS

SEQ ID NO: 13872 - protein, 7 aa, Artificial Sequence
  Synthetic
GTSPGRW

SEQ ID NO: 13873 - protein, 7 aa, Artificial Sequence
  Synthetic
LNRGTVY

SEQ ID NO: 13874 - protein, 7 aa, Artificial Sequence
  Synthetic
DNLSARW

SEQ ID NO: 13875 - protein, 7 aa, Artificial Sequence
  Synthetic
KYYGESS

SEQ ID NO: 13876 - protein, 7 aa, Artificial Sequence
  Synthetic
GHQHDLR

SEQ ID NO: 13877 - protein, 7 aa, Artificial Sequence
  Synthetic
EWHGGAS

SEQ ID NO: 13878 - protein, 7 aa, Artificial Sequence
  Synthetic
WSLDVGF

SEQ ID NO: 13879 - protein, 7 aa, Artificial Sequence
  Synthetic
SWSHGAA

SEQ ID NO: 13880 - protein, 7 aa, Artificial Sequence
  Synthetic
LVFHGSA

SEQ ID NO: 13881 - protein, 7 aa, Artificial Sequence
  Synthetic
ANKYSIS

SEQ ID NO: 13882 - protein, 7 aa, Artificial Sequence
  Synthetic
IWVGHSS

SEQ ID NO: 13883 - protein, 7 aa, Artificial Sequence
  Synthetic
EARYGSS

SEQ ID NO: 13884 - protein, 7 aa, Artificial Sequence
  Synthetic
WRDLGSV

SEQ ID NO: 13885 - protein, 7 aa, Artificial Sequence
  Synthetic
FISHGSA

SEQ ID NO: 13886 - protein, 7 aa, Artificial Sequence
  Synthetic
EWPGGAR

SEQ ID NO: 13887 - protein, 7 aa, Artificial Sequence
  Synthetic
AWGSLGA

SEQ ID NO: 13888 - protein, 7 aa, Artificial Sequence
  Synthetic
LSHGYSS

SEQ ID NO: 13889 - protein, 7 aa, Artificial Sequence
  Synthetic
HENLGRW

SEQ ID NO: 13890 - protein, 7 aa, Artificial Sequence
  Synthetic
RGSLEYY

SEQ ID NO: 13891 - protein, 7 aa, Artificial Sequence
  Synthetic
GEDRARW

SEQ ID NO: 13892 - protein, 7 aa, Artificial Sequence
  Synthetic
WGLPNHS

SEQ ID NO: 13893 - protein, 7 aa, Artificial Sequence
  Synthetic
QAAGWSS

SEQ ID NO: 13894 - protein, 7 aa, Artificial Sequence
  Synthetic
GQNTGLW

SEQ ID NO: 13895 - protein, 7 aa, Artificial Sequence
  Synthetic
KYVGWSE

SEQ ID NO: 13896 - protein, 7 aa, Artificial Sequence
  Synthetic
SVWQGST

SEQ ID NO: 13897 - protein, 7 aa, Artificial Sequence
  Synthetic
KYPGSSA

SEQ ID NO: 13898 - protein, 7 aa, Artificial Sequence
  Synthetic
DWRGGSV

SEQ ID NO: 13899 - protein, 7 aa, Artificial Sequence
  Synthetic
DLTRNHW

SEQ ID NO: 13900 - protein, 7 aa, Artificial Sequence
  Synthetic
YLAGYER

SEQ ID NO: 13901 - protein, 7 aa, Artificial Sequence
  Synthetic
WVHGGST

SEQ ID NO: 13902 - protein, 7 aa, Artificial Sequence
  Synthetic
CWGCPGE

SEQ ID NO: 13903 - protein, 7 aa, Artificial Sequence
  Synthetic
CFPVGHC

SEQ ID NO: 13904 - protein, 7 aa, Artificial Sequence
  Synthetic
PEDPGPW

SEQ ID NO: 13905 - protein, 7 aa, Artificial Sequence
  Synthetic
SFLLGSA

SEQ ID NO: 13906 - protein, 7 aa, Artificial Sequence
  Synthetic
LKSTWSS

SEQ ID NO: 13907 - protein, 7 aa, Artificial Sequence
  Synthetic
VERWGSA

SEQ ID NO: 13908 - protein, 7 aa, Artificial Sequence
  Synthetic
VNKYAIN

SEQ ID NO: 13909 - protein, 7 aa, Artificial Sequence
  Synthetic
LNHGWAS

SEQ ID NO: 13910 - protein, 7 aa, Artificial Sequence
  Synthetic
FTADSRP

SEQ ID NO: 13911 - protein, 7 aa, Artificial Sequence
  Synthetic
DQRAWGA

SEQ ID NO: 13912 - protein, 7 aa, Artificial Sequence
  Synthetic
EVPSRWN

SEQ ID NO: 13913 - protein, 7 aa, Artificial Sequence
  Synthetic
MLLRETL

SEQ ID NO: 13914 - protein, 7 aa, Artificial Sequence
  Synthetic
REFDLRM

SEQ ID NO: 13915 - protein, 7 aa, Artificial Sequence
  Synthetic
WSVQSGH

SEQ ID NO: 13916 - protein, 7 aa, Artificial Sequence
  Synthetic
DVQVRWS

SEQ ID NO: 13917 - protein, 7 aa, Artificial Sequence
  Synthetic
GVWGSVA

SEQ ID NO: 13918 - protein, 7 aa, Artificial Sequence
  Synthetic
DAPGARY

SEQ ID NO: 13919 - protein, 7 aa, Artificial Sequence
  Synthetic
AIRPAGW

SEQ ID NO: 13920 - protein, 7 aa, Artificial Sequence
  Synthetic
TVTWHAD

SEQ ID NO: 13921 - protein, 7 aa, Artificial Sequence
  Synthetic
MEFLRVP

SEQ ID NO: 13922 - protein, 7 aa, Artificial Sequence
  Synthetic
DMWLGSA

SEQ ID NO: 13923 - protein, 7 aa, Artificial Sequence
  Synthetic
VQHPGQW

SEQ ID NO: 13924 - protein, 7 aa, Artificial Sequence
  Synthetic
LLTFGSS

SEQ ID NO: 13925 - protein, 7 aa, Artificial Sequence
  Synthetic
LLTYGST

SEQ ID NO: 13926 - protein, 7 aa, Artificial Sequence
  Synthetic
SMIYGSA

SEQ ID NO: 13927 - protein, 7 aa, Artificial Sequence
  Synthetic
YLVGFKP

SEQ ID NO: 13928 - protein, 7 aa, Artificial Sequence
  Synthetic
VWAGSSS

SEQ ID NO: 13929 - protein, 7 aa, Artificial Sequence
  Synthetic
FYRGDSS

SEQ ID NO: 13930 - protein, 7 aa, Artificial Sequence
  Synthetic
RSEHSTW

SEQ ID NO: 13931 - protein, 7 aa, Artificial Sequence
  Synthetic
VGYSLGL

SEQ ID NO: 13932 - protein, 7 aa, Artificial Sequence
  Synthetic
ATDSARW

SEQ ID NO: 13933 - protein, 7 aa, Artificial Sequence
  Synthetic
LVLRMSS

SEQ ID NO: 13934 - protein, 7 aa, Artificial Sequence
  Synthetic
PYFGQAS

SEQ ID NO: 13935 - protein, 7 aa, Artificial Sequence
  Synthetic
ITVGRVY

SEQ ID NO: 13936 - protein, 7 aa, Artificial Sequence
  Synthetic
GGHPGSW

SEQ ID NO: 13937 - protein, 7 aa, Artificial Sequence
  Synthetic
WHSLTVS

SEQ ID NO: 13938 - protein, 7 aa, Artificial Sequence
  Synthetic
IDASYWA

SEQ ID NO: 13939 - protein, 7 aa, Artificial Sequence
  Synthetic
TERYGSS

SEQ ID NO: 13940 - protein, 7 aa, Artificial Sequence
  Synthetic
GAPGWST

SEQ ID NO: 13941 - protein, 7 aa, Artificial Sequence
  Synthetic
RFVGDFG

SEQ ID NO: 13942 - protein, 7 aa, Artificial Sequence
  Synthetic
LSKGFST

SEQ ID NO: 13943 - protein, 7 aa, Artificial Sequence
  Synthetic
RMSYGSA

SEQ ID NO: 13944 - protein, 7 aa, Artificial Sequence
  Synthetic
RALGLSS

SEQ ID NO: 13945 - protein, 7 aa, Artificial Sequence
  Synthetic
VSNTGRW

SEQ ID NO: 13946 - protein, 7 aa, Artificial Sequence
  Synthetic
TVRYGFD

SEQ ID NO: 13947 - protein, 7 aa, Artificial Sequence
  Synthetic
LREGYST

SEQ ID NO: 13948 - protein, 7 aa, Artificial Sequence
  Synthetic
FFKLGSA

SEQ ID NO: 13949 - protein, 7 aa, Artificial Sequence
  Synthetic
WVLDADR

SEQ ID NO: 13950 - protein, 7 aa, Artificial Sequence
  Synthetic
RHVAEAS

SEQ ID NO: 13951 - protein, 7 aa, Artificial Sequence
  Synthetic
SAWQGSS

SEQ ID NO: 13952 - protein, 7 aa, Artificial Sequence
  Synthetic
EKLFGAA

SEQ ID NO: 13953 - protein, 7 aa, Artificial Sequence
  Synthetic
GGWGGST

SEQ ID NO: 13954 - protein, 7 aa, Artificial Sequence
  Synthetic
TGVTRWD

SEQ ID NO: 13955 - protein, 7 aa, Artificial Sequence
  Synthetic
NEWRGSS

SEQ ID NO: 13956 - protein, 7 aa, Artificial Sequence
  Synthetic
WMYGGTG

SEQ ID NO: 13957 - protein, 7 aa, Artificial Sequence
  Synthetic
FTRDAVP

SEQ ID NO: 13958 - protein, 7 aa, Artificial Sequence
  Synthetic
PIAHAYS

SEQ ID NO: 13959 - protein, 7 aa, Artificial Sequence
  Synthetic
LVGRLMG

SEQ ID NO: 13960 - protein, 7 aa, Artificial Sequence
  Synthetic
HLHGYSD

SEQ ID NO: 13961 - protein, 7 aa, Artificial Sequence
  Synthetic
TDYANRW

SEQ ID NO: 13962 - protein, 7 aa, Artificial Sequence
  Synthetic
AFYNGSA

SEQ ID NO: 13963 - protein, 7 aa, Artificial Sequence
  Synthetic
AVSYGSA

SEQ ID NO: 13964 - protein, 7 aa, Artificial Sequence
  Synthetic
DAHVTRW

SEQ ID NO: 13965 - protein, 7 aa, Artificial Sequence
  Synthetic
SWHGGAV

SEQ ID NO: 13966 - protein, 7 aa, Artificial Sequence
  Synthetic
WAVGGSQ

SEQ ID NO: 13967 - protein, 7 aa, Artificial Sequence
  Synthetic
LWSGSSS

SEQ ID NO: 13968 - protein, 7 aa, Artificial Sequence
  Synthetic
NLQWRAD

SEQ ID NO: 13969 - protein, 7 aa, Artificial Sequence
  Synthetic
NDHSGRW

SEQ ID NO: 13970 - protein, 7 aa, Artificial Sequence
  Synthetic
SGPGQWV

SEQ ID NO: 13971 - protein, 7 aa, Artificial Sequence
  Synthetic
VRYSLDM

SEQ ID NO: 13972 - protein, 7 aa, Artificial Sequence
  Synthetic
FSIGFSS

SEQ ID NO: 13973 - protein, 7 aa, Artificial Sequence
  Synthetic
SPWKLPD

SEQ ID NO: 13974 - protein, 7 aa, Artificial Sequence
  Synthetic
WLLPSDR

SEQ ID NO: 13975 - protein, 7 aa, Artificial Sequence
  Synthetic
ARAGYGF

SEQ ID NO: 13976 - protein, 7 aa, Artificial Sequence
  Synthetic
WVLPNGS

SEQ ID NO: 13977 - protein, 7 aa, Artificial Sequence
  Synthetic
EWTHGAS

SEQ ID NO: 13978 - protein, 7 aa, Artificial Sequence
  Synthetic
LFQGHSS

SEQ ID NO: 13979 - protein, 7 aa, Artificial Sequence
  Synthetic
SFMHGSS

SEQ ID NO: 13980 - protein, 7 aa, Artificial Sequence
  Synthetic
EDGSGRW

SEQ ID NO: 13981 - protein, 7 aa, Artificial Sequence
  Synthetic
DSWRGSV

SEQ ID NO: 13982 - protein, 7 aa, Artificial Sequence
  Synthetic
GVERRWD

SEQ ID NO: 13983 - protein, 7 aa, Artificial Sequence
  Synthetic
LLKGWST

SEQ ID NO: 13984 - protein, 7 aa, Artificial Sequence
  Synthetic
GEMVGRW

SEQ ID NO: 13985 - protein, 7 aa, Artificial Sequence
  Synthetic
TTKNTWT

SEQ ID NO: 13986 - protein, 7 aa, Artificial Sequence
  Synthetic
IIKGYSS

SEQ ID NO: 13987 - protein, 7 aa, Artificial Sequence
  Synthetic
CKLMGSA

SEQ ID NO: 13988 - protein, 7 aa, Artificial Sequence
  Synthetic
LYPGTST

SEQ ID NO: 13989 - protein, 7 aa, Artificial Sequence
  Synthetic
APMDSRW

SEQ ID NO: 13990 - protein, 7 aa, Artificial Sequence
  Synthetic
FSSWNLA

SEQ ID NO: 13991 - protein, 7 aa, Artificial Sequence
  Synthetic
RGSPGVW

SEQ ID NO: 13992 - protein, 7 aa, Artificial Sequence
  Synthetic
LWEFGSQ

SEQ ID NO: 13993 - protein, 7 aa, Artificial Sequence
  Synthetic
SREWGSA

SEQ ID NO: 13994 - protein, 7 aa, Artificial Sequence
  Synthetic
ESGSVRW

SEQ ID NO: 13995 - protein, 7 aa, Artificial Sequence
  Synthetic
WGLFVSE

SEQ ID NO: 13996 - protein, 7 aa, Artificial Sequence
  Synthetic
GSDTSRW

SEQ ID NO: 13997 - protein, 7 aa, Artificial Sequence
  Synthetic
GDARFGL

SEQ ID NO: 13998 - protein, 7 aa, Artificial Sequence
  Synthetic
VVSGWSS

SEQ ID NO: 13999 - protein, 7 aa, Artificial Sequence
  Synthetic
DASSARW

SEQ ID NO: 14000 - protein, 7 aa, Artificial Sequence
  Synthetic
WDHVRNF

SEQ ID NO: 14001 - protein, 7 aa, Artificial Sequence
  Synthetic
IRSMGSS

SEQ ID NO: 14002 - protein, 7 aa, Artificial Sequence
  Synthetic
SPTWRVD

SEQ ID NO: 14003 - protein, 7 aa, Artificial Sequence
  Synthetic
MYFPEAS

SEQ ID NO: 14004 - protein, 7 aa, Artificial Sequence
  Synthetic
TAWGGSQ

SEQ ID NO: 14005 - protein, 7 aa, Artificial Sequence
  Synthetic
DSTPGRW

SEQ ID NO: 14006 - protein, 7 aa, Artificial Sequence
  Synthetic
LWQGSST

SEQ ID NO: 14007 - protein, 7 aa, Artificial Sequence
  Synthetic
EAGNSRW

SEQ ID NO: 14008 - protein, 7 aa, Artificial Sequence
  Synthetic
DTSTNRW

SEQ ID NO: 14009 - protein, 7 aa, Artificial Sequence
  Synthetic
MWDNVRG

SEQ ID NO: 14010 - protein, 7 aa, Artificial Sequence
  Synthetic
FGSDGRW

SEQ ID NO: 14011 - protein, 7 aa, Artificial Sequence
  Synthetic
FHFEGSS

SEQ ID NO: 14012 - protein, 7 aa, Artificial Sequence
  Synthetic
VGPFHQT

SEQ ID NO: 14013 - protein, 7 aa, Artificial Sequence
  Synthetic
QRFDNRV

SEQ ID NO: 14014 - protein, 7 aa, Artificial Sequence
  Synthetic
IREGYSS

SEQ ID NO: 14015 - protein, 7 aa, Artificial Sequence
  Synthetic
MIYSGSH

SEQ ID NO: 14016 - protein, 7 aa, Artificial Sequence
  Synthetic
GHPMSFG

SEQ ID NO: 14017 - protein, 7 aa, Artificial Sequence
  Synthetic
SREGWST

SEQ ID NO: 14018 - protein, 7 aa, Artificial Sequence
  Synthetic
YGSLAPI

SEQ ID NO: 14019 - protein, 7 aa, Artificial Sequence
  Synthetic
ERAGWSA

SEQ ID NO: 14020 - protein, 7 aa, Artificial Sequence
  Synthetic
DKPYYST

SEQ ID NO: 14021 - protein, 7 aa, Artificial Sequence
  Synthetic
ARHMGST

SEQ ID NO: 14022 - protein, 7 aa, Artificial Sequence
  Synthetic
ARHMGST

SEQ ID NO: 14023 - protein, 7 aa, Artificial Sequence
  Synthetic
NTWGVVA

SEQ ID NO: 14024 - protein, 7 aa, Artificial Sequence
  Synthetic
MDLGWSS

SEQ ID NO: 14025 - protein, 7 aa, Artificial Sequence
  Synthetic
KFLGQAQ

SEQ ID NO: 14026 - protein, 7 aa, Artificial Sequence
  Synthetic
WHSLATR

SEQ ID NO: 14027 - protein, 7 aa, Artificial Sequence
  Synthetic
NHRYEAS

SEQ ID NO: 14028 - protein, 7 aa, Artificial Sequence
  Synthetic
PWPGHAA

SEQ ID NO: 14029 - protein, 7 aa, Artificial Sequence
  Synthetic
GFAIRQV

SEQ ID NO: 14030 - protein, 7 aa, Artificial Sequence
  Synthetic
YLAGFGT

SEQ ID NO: 14031 - protein, 7 aa, Artificial Sequence
  Synthetic
HVSLGSS

SEQ ID NO: 14032 - protein, 7 aa, Artificial Sequence
  Synthetic
FVTYGSA

SEQ ID NO: 14033 - protein, 7 aa, Artificial Sequence
  Synthetic
LKYAGST

SEQ ID NO: 14034 - protein, 7 aa, Artificial Sequence
  Synthetic
VTQQNMW

SEQ ID NO: 14035 - protein, 7 aa, Artificial Sequence
  Synthetic
ARNPGVW

SEQ ID NO: 14036 - protein, 7 aa, Artificial Sequence
  Synthetic
TRAGYAV

SEQ ID NO: 14037 - protein, 7 aa, Artificial Sequence
  Synthetic
ESHAGRW

SEQ ID NO: 14038 - protein, 7 aa, Artificial Sequence
  Synthetic
MYQGGSQ

SEQ ID NO: 14039 - protein, 7 aa, Artificial Sequence
  Synthetic
GDFRMIV

SEQ ID NO: 14040 - protein, 7 aa, Artificial Sequence
  Synthetic
GVDRGPW

SEQ ID NO: 14041 - protein, 7 aa, Artificial Sequence
  Synthetic
VMKGYSS

SEQ ID NO: 14042 - protein, 7 aa, Artificial Sequence
  Synthetic
LYVGGAQ

SEQ ID NO: 14043 - protein, 7 aa, Artificial Sequence
  Synthetic
VVYAGSS

SEQ ID NO: 14044 - protein, 7 aa, Artificial Sequence
  Synthetic
HVASQYY

SEQ ID NO: 14045 - protein, 7 aa, Artificial Sequence
  Synthetic
AWLGGAT

SEQ ID NO: 14046 - protein, 7 aa, Artificial Sequence
  Synthetic
SWQGSSS

SEQ ID NO: 14047 - protein, 7 aa, Artificial Sequence
  Synthetic
LLYGSAQ

SEQ ID NO: 14048 - protein, 7 aa, Artificial Sequence
  Synthetic
TRTGYSV

SEQ ID NO: 14049 - protein, 7 aa, Artificial Sequence
  Synthetic
LFLGSSM

SEQ ID NO: 14050 - protein, 7 aa, Artificial Sequence
  Synthetic
VWGGLGV

SEQ ID NO: 14051 - protein, 7 aa, Artificial Sequence
  Synthetic
EVSHGSA

SEQ ID NO: 14052 - protein, 7 aa, Artificial Sequence
  Synthetic
ISRGFAQ

SEQ ID NO: 14053 - protein, 7 aa, Artificial Sequence
  Synthetic
LVRLGSA

SEQ ID NO: 14054 - protein, 7 aa, Artificial Sequence
  Synthetic
VAAGWST

SEQ ID NO: 14055 - protein, 7 aa, Artificial Sequence
  Synthetic
PYERSYG

SEQ ID NO: 14056 - protein, 7 aa, Artificial Sequence
  Synthetic
TLGYGSS

SEQ ID NO: 14057 - protein, 7 aa, Artificial Sequence
  Synthetic
YGSLASI

SEQ ID NO: 14058 - protein, 7 aa, Artificial Sequence
  Synthetic
VVENWHL

SEQ ID NO: 14059 - protein, 7 aa, Artificial Sequence
  Synthetic
AYLGYSA

SEQ ID NO: 14060 - protein, 7 aa, Artificial Sequence
  Synthetic
VRSGMSQ

SEQ ID NO: 14061 - protein, 7 aa, Artificial Sequence
  Synthetic
TGHGYSS

SEQ ID NO: 14062 - protein, 7 aa, Artificial Sequence
  Synthetic
VRVQLVN

SEQ ID NO: 14063 - protein, 7 aa, Artificial Sequence
  Synthetic
VAAFGSS

SEQ ID NO: 14064 - protein, 7 aa, Artificial Sequence
  Synthetic
GYDLRTP

SEQ ID NO: 14065 - protein, 7 aa, Artificial Sequence
  Synthetic
SRTGFST

SEQ ID NO: 14066 - protein, 7 aa, Artificial Sequence
  Synthetic
PIDSARW

SEQ ID NO: 14067 - protein, 7 aa, Artificial Sequence
  Synthetic
ILSGYSM

SEQ ID NO: 14068 - protein, 7 aa, Artificial Sequence
  Synthetic
LWPGQSS

SEQ ID NO: 14069 - protein, 7 aa, Artificial Sequence
  Synthetic
YGSLEVL

SEQ ID NO: 14070 - protein, 7 aa, Artificial Sequence
  Synthetic
HISHGSA

SEQ ID NO: 14071 - protein, 7 aa, Artificial Sequence
  Synthetic
ILSGYNS

SEQ ID NO: 14072 - protein, 7 aa, Artificial Sequence
  Synthetic
AGFDLRG

SEQ ID NO: 14073 - protein, 7 aa, Artificial Sequence
  Synthetic
GHVNWSS

SEQ ID NO: 14074 - protein, 7 aa, Artificial Sequence
  Synthetic
TEGVYRW

SEQ ID NO: 14075 - protein, 7 aa, Artificial Sequence
  Synthetic
RRPAEAQ

SEQ ID NO: 14076 - protein, 7 aa, Artificial Sequence
  Synthetic
RHATEYY

SEQ ID NO: 14077 - protein, 7 aa, Artificial Sequence
  Synthetic
LDVGWSS

SEQ ID NO: 14078 - protein, 7 aa, Artificial Sequence
  Synthetic
GVPGWSS

SEQ ID NO: 14079 - protein, 7 aa, Artificial Sequence
  Synthetic
RVGDTRW

SEQ ID NO: 14080 - protein, 7 aa, Artificial Sequence
  Synthetic
LAYLGSQ

SEQ ID NO: 14081 - protein, 7 aa, Artificial Sequence
  Synthetic
DTTTNRW

SEQ ID NO: 14082 - protein, 7 aa, Artificial Sequence
  Synthetic
SQIWGSA

SEQ ID NO: 14083 - protein, 7 aa, Artificial Sequence
  Synthetic
WGSLNSL

SEQ ID NO: 14084 - protein, 7 aa, Artificial Sequence
  Synthetic
RVLLDRA

SEQ ID NO: 14085 - protein, 7 aa, Artificial Sequence
  Synthetic
SAHPGMW

SEQ ID NO: 14086 - protein, 7 aa, Artificial Sequence
  Synthetic
LIPLMSS

SEQ ID NO: 14087 - protein, 7 aa, Artificial Sequence
  Synthetic
SAPGWSH

SEQ ID NO: 14088 - protein, 7 aa, Artificial Sequence
  Synthetic
PQYESRW

SEQ ID NO: 14089 - protein, 7 aa, Artificial Sequence
  Synthetic
LRPFDST

SEQ ID NO: 14090 - protein, 7 aa, Artificial Sequence
  Synthetic
VFFEGSS

SEQ ID NO: 14091 - protein, 7 aa, Artificial Sequence
  Synthetic
LNPGWST

SEQ ID NO: 14092 - protein, 7 aa, Artificial Sequence
  Synthetic
MFGGGSQ

SEQ ID NO: 14093 - protein, 7 aa, Artificial Sequence
  Synthetic
LRFEGSQ

SEQ ID NO: 14094 - protein, 7 aa, Artificial Sequence
  Synthetic
ERNWGST

SEQ ID NO: 14095 - protein, 7 aa, Artificial Sequence
  Synthetic
AYPGAAA

SEQ ID NO: 14096 - protein, 7 aa, Artificial Sequence
  Synthetic
WVIGSQV

SEQ ID NO: 14097 - protein, 7 aa, Artificial Sequence
  Synthetic
WHSLARP

SEQ ID NO: 14098 - protein, 7 aa, Artificial Sequence
  Synthetic
WAKMGSV

SEQ ID NO: 14099 - protein, 7 aa, Artificial Sequence
  Synthetic
WALHGSQ

SEQ ID NO: 14100 - protein, 7 aa, Artificial Sequence
  Synthetic
RADHNHW

SEQ ID NO: 14101 - protein, 7 aa, Artificial Sequence
  Synthetic
SARLMSS

SEQ ID NO: 14102 - protein, 7 aa, Artificial Sequence
  Synthetic
VWGGLGV

SEQ ID NO: 14103 - protein, 7 aa, Artificial Sequence
  Synthetic
WSPNTGY

SEQ ID NO: 14104 - protein, 7 aa, Artificial Sequence
  Synthetic
WLRGYAE

SEQ ID NO: 14105 - protein, 7 aa, Artificial Sequence
  Synthetic
LLRGLSS

SEQ ID NO: 14106 - protein, 7 aa, Artificial Sequence
  Synthetic
GVVVLRN

SEQ ID NO: 14107 - protein, 7 aa, Artificial Sequence
  Synthetic
RFTNDSS

SEQ ID NO: 14108 - protein, 7 aa, Artificial Sequence
  Synthetic
DFFKGSA

SEQ ID NO: 14109 - protein, 7 aa, Artificial Sequence
  Synthetic
TPAWTAS

SEQ ID NO: 14110 - protein, 7 aa, Artificial Sequence
  Synthetic
MVYSGSS

SEQ ID NO: 14111 - protein, 7 aa, Artificial Sequence
  Synthetic
IASWMPQ

SEQ ID NO: 14112 - protein, 7 aa, Artificial Sequence
  Synthetic
YTLQAGY

SEQ ID NO: 14113 - protein, 7 aa, Artificial Sequence
  Synthetic
TVPNWHQ

SEQ ID NO: 14114 - protein, 7 aa, Artificial Sequence
  Synthetic
PYQPAPG

SEQ ID NO: 14115 - protein, 7 aa, Artificial Sequence
  Synthetic
YNSLWPA

SEQ ID NO: 14116 - protein, 7 aa, Artificial Sequence
  Synthetic
EKPFFSA

SEQ ID NO: 14117 - protein, 7 aa, Artificial Sequence
  Synthetic
DRHLNQW

SEQ ID NO: 14118 - protein, 7 aa, Artificial Sequence
  Synthetic
RYVHEAS

SEQ ID NO: 14119 - protein, 7 aa, Artificial Sequence
  Synthetic
TVTLSKY

SEQ ID NO: 14120 - protein, 7 aa, Artificial Sequence
  Synthetic
TVHSGVW

SEQ ID NO: 14121 - protein, 7 aa, Artificial Sequence
  Synthetic
WVSLPTS

SEQ ID NO: 14122 - protein, 7 aa, Artificial Sequence
  Synthetic
LQLGFAQ

SEQ ID NO: 14123 - protein, 7 aa, Artificial Sequence
  Synthetic
WRTLPDV

SEQ ID NO: 14124 - protein, 7 aa, Artificial Sequence
  Synthetic
VTHGFSS

SEQ ID NO: 14125 - protein, 7 aa, Artificial Sequence
  Synthetic
AMRGFST

SEQ ID NO: 14126 - protein, 7 aa, Artificial Sequence
  Synthetic
TYAHYSS

SEQ ID NO: 14127 - protein, 7 aa, Artificial Sequence
  Synthetic
GETNGRW

SEQ ID NO: 14128 - protein, 7 aa, Artificial Sequence
  Synthetic
DIPFGSS

SEQ ID NO: 14129 - protein, 7 aa, Artificial Sequence
  Synthetic
LRPGWAT

SEQ ID NO: 14130 - protein, 7 aa, Artificial Sequence
  Synthetic
EFYRGAV

SEQ ID NO: 14131 - protein, 7 aa, Artificial Sequence
  Synthetic
SRNLGST

SEQ ID NO: 14132 - protein, 7 aa, Artificial Sequence
  Synthetic
AVHEVRW

SEQ ID NO: 14133 - protein, 7 aa, Artificial Sequence
  Synthetic
VAWGGST

SEQ ID NO: 14134 - protein, 7 aa, Artificial Sequence
  Synthetic
EFRGGSS

SEQ ID NO: 14135 - protein, 7 aa, Artificial Sequence
  Synthetic
WMARGAA

SEQ ID NO: 14136 - protein, 7 aa, Artificial Sequence
  Synthetic
WGAYPGA

SEQ ID NO: 14137 - protein, 7 aa, Artificial Sequence
  Synthetic
YERLGST

SEQ ID NO: 14138 - protein, 7 aa, Artificial Sequence
  Synthetic
SWAHGAA

SEQ ID NO: 14139 - protein, 7 aa, Artificial Sequence
  Synthetic
KFIGGAA

SEQ ID NO: 14140 - protein, 7 aa, Artificial Sequence
  Synthetic
ERTYGSS

SEQ ID NO: 14141 - protein, 7 aa, Artificial Sequence
  Synthetic
VLIGRSG

SEQ ID NO: 14142 - protein, 7 aa, Artificial Sequence
  Synthetic
VAIGQTW

SEQ ID NO: 14143 - protein, 7 aa, Artificial Sequence
  Synthetic
EYIRGSA

SEQ ID NO: 14144 - protein, 7 aa, Artificial Sequence
  Synthetic
GESVGKW

SEQ ID NO: 14145 - protein, 7 aa, Artificial Sequence
  Synthetic
IRPFSDF

SEQ ID NO: 14146 - protein, 7 aa, Artificial Sequence
  Synthetic
WSQTHGY

SEQ ID NO: 14147 - protein, 7 aa, Artificial Sequence
  Synthetic
LFPGYAS

SEQ ID NO: 14148 - protein, 7 aa, Artificial Sequence
  Synthetic
SYAIKSI

SEQ ID NO: 14149 - protein, 7 aa, Artificial Sequence
  Synthetic
TQYNGSI

SEQ ID NO: 14150 - protein, 7 aa, Artificial Sequence
  Synthetic
SLIGYSS

SEQ ID NO: 14151 - protein, 7 aa, Artificial Sequence
  Synthetic
HLSGYNT

SEQ ID NO: 14152 - protein, 7 aa, Artificial Sequence
  Synthetic
LNVNWAS

SEQ ID NO: 14153 - protein, 7 aa, Artificial Sequence
  Synthetic
YRALGSA

SEQ ID NO: 14154 - protein, 7 aa, Artificial Sequence
  Synthetic
NAPVQHW

SEQ ID NO: 14155 - protein, 7 aa, Artificial Sequence
  Synthetic
FGSLDAI

SEQ ID NO: 14156 - protein, 7 aa, Artificial Sequence
  Synthetic
REVHNIW

SEQ ID NO: 14157 - protein, 7 aa, Artificial Sequence
  Synthetic
IFLHGST

SEQ ID NO: 14158 - protein, 7 aa, Artificial Sequence
  Synthetic
IINDNRW

SEQ ID NO: 14159 - protein, 7 aa, Artificial Sequence
  Synthetic
PKNDGRW

SEQ ID NO: 14160 - protein, 7 aa, Artificial Sequence
  Synthetic
LRVSYAQ

SEQ ID NO: 14161 - protein, 7 aa, Artificial Sequence
  Synthetic
DPPNWAY

SEQ ID NO: 14162 - protein, 7 aa, Artificial Sequence
  Synthetic
NGPFMST

SEQ ID NO: 14163 - protein, 7 aa, Artificial Sequence
  Synthetic
PKNTYGY

SEQ ID NO: 14164 - protein, 7 aa, Artificial Sequence
  Synthetic
GASWTAS

SEQ ID NO: 14165 - protein, 7 aa, Artificial Sequence
  Synthetic
SAANWSH

SEQ ID NO: 14166 - protein, 7 aa, Artificial Sequence
  Synthetic
PDAWNRV

SEQ ID NO: 14167 - protein, 7 aa, Artificial Sequence
  Synthetic
FTLSDRP

SEQ ID NO: 14168 - protein, 7 aa, Artificial Sequence
  Synthetic
AVIRLTN

SEQ ID NO: 14169 - protein, 7 aa, Artificial Sequence
  Synthetic
ERTTWSA

SEQ ID NO: 14170 - protein, 7 aa, Artificial Sequence
  Synthetic
PAPPFSL

SEQ ID NO: 14171 - protein, 7 aa, Artificial Sequence
  Synthetic
RSVGTIY

SEQ ID NO: 14172 - protein, 7 aa, Artificial Sequence
  Synthetic
GKVANAW

SEQ ID NO: 14173 - protein, 7 aa, Artificial Sequence
  Synthetic
FAHLYSS

SEQ ID NO: 14174 - protein, 7 aa, Artificial Sequence
  Synthetic
RWPSEAS

SEQ ID NO: 14175 - protein, 7 aa, Artificial Sequence
  Synthetic
WGALQGL

SEQ ID NO: 14176 - protein, 7 aa, Artificial Sequence
  Synthetic
TASWDRV

SEQ ID NO: 14177 - protein, 7 aa, Artificial Sequence
  Synthetic
ERLHGAS

SEQ ID NO: 14178 - protein, 7 aa, Artificial Sequence
  Synthetic
LCVPCSS

SEQ ID NO: 14179 - protein, 7 aa, Artificial Sequence
  Synthetic
MVRPMAS

SEQ ID NO: 14180 - protein, 7 aa, Artificial Sequence
  Synthetic
STYLGST

SEQ ID NO: 14181 - protein, 7 aa, Artificial Sequence
  Synthetic
ERVIMKP

SEQ ID NO: 14182 - protein, 7 aa, Artificial Sequence
  Synthetic
LRLAGST

SEQ ID NO: 14183 - protein, 7 aa, Artificial Sequence
  Synthetic
DRFLGSS

SEQ ID NO: 14184 - protein, 7 aa, Artificial Sequence
  Synthetic
PGPNWSA

SEQ ID NO: 14185 - protein, 7 aa, Artificial Sequence
  Synthetic
LVHESRW

SEQ ID NO: 14186 - protein, 7 aa, Artificial Sequence
  Synthetic
SKVLNGW

SEQ ID NO: 14187 - protein, 7 aa, Artificial Sequence
  Synthetic
AGPGRAQ

SEQ ID NO: 14188 - protein, 7 aa, Artificial Sequence
  Synthetic
MQIRGST

SEQ ID NO: 14189 - protein, 7 aa, Artificial Sequence
  Synthetic
RTSGSVY

SEQ ID NO: 14190 - protein, 7 aa, Artificial Sequence
  Synthetic
AFQFQAS

SEQ ID NO: 14191 - protein, 7 aa, Artificial Sequence
  Synthetic
SDPGWSS

SEQ ID NO: 14192 - protein, 7 aa, Artificial Sequence
  Synthetic
GVHTGSW

SEQ ID NO: 14193 - protein, 7 aa, Artificial Sequence
  Synthetic
LDVGRVY

SEQ ID NO: 14194 - protein, 7 aa, Artificial Sequence
  Synthetic
MRPMEAQ

SEQ ID NO: 14195 - protein, 7 aa, Artificial Sequence
  Synthetic
RDFGYAQ

SEQ ID NO: 14196 - protein, 7 aa, Artificial Sequence
  Synthetic
ERYGGFH

SEQ ID NO: 14197 - protein, 7 aa, Artificial Sequence
  Synthetic
NSPGWSS

SEQ ID NO: 14198 - protein, 7 aa, Artificial Sequence
  Synthetic
WRLGGSV

SEQ ID NO: 14199 - protein, 7 aa, Artificial Sequence
  Synthetic
MMRLGAS

SEQ ID NO: 14200 - protein, 7 aa, Artificial Sequence
  Synthetic
LWERGAS

SEQ ID NO: 14201 - protein, 7 aa, Artificial Sequence
  Synthetic
DRTGWST

SEQ ID NO: 14202 - protein, 7 aa, Artificial Sequence
  Synthetic
WQAHGSQ

SEQ ID NO: 14203 - protein, 7 aa, Artificial Sequence
  Synthetic
SLLQGYG

SEQ ID NO: 14204 - protein, 7 aa, Artificial Sequence
  Synthetic
PNAPGPW

SEQ ID NO: 14205 - protein, 7 aa, Artificial Sequence
  Synthetic
SVRLGSS

SEQ ID NO: 14206 - protein, 7 aa, Artificial Sequence
  Synthetic
REGEARW

SEQ ID NO: 14207 - protein, 7 aa, Artificial Sequence
  Synthetic
QRAGFSQ

SEQ ID NO: 14208 - protein, 7 aa, Artificial Sequence
  Synthetic
EYALLGR

SEQ ID NO: 14209 - protein, 7 aa, Artificial Sequence
  Synthetic
TQRGYSS

SEQ ID NO: 14210 - protein, 7 aa, Artificial Sequence
  Synthetic
DVRSTWT

SEQ ID NO: 14211 - protein, 7 aa, Artificial Sequence
  Synthetic
LSRGMAQ

SEQ ID NO: 14212 - protein, 7 aa, Artificial Sequence
  Synthetic
YGMLGPM

SEQ ID NO: 14213 - protein, 7 aa, Artificial Sequence
  Synthetic
IRIGTVY

SEQ ID NO: 14214 - protein, 7 aa, Artificial Sequence
  Synthetic
HLVGFSS

SEQ ID NO: 14215 - protein, 7 aa, Artificial Sequence
  Synthetic
LGKGYST

SEQ ID NO: 14216 - protein, 7 aa, Artificial Sequence
  Synthetic
MRIGASQ

SEQ ID NO: 14217 - protein, 7 aa, Artificial Sequence
  Synthetic
MHKWESS

SEQ ID NO: 14218 - protein, 7 aa, Artificial Sequence
  Synthetic
LARGMSS

SEQ ID NO: 14219 - protein, 7 aa, Artificial Sequence
  Synthetic
VRVVLTN

SEQ ID NO: 14220 - protein, 7 aa, Artificial Sequence
  Synthetic
IVTHGWA

SEQ ID NO: 14221 - protein, 7 aa, Artificial Sequence
  Synthetic
FMPGYSA

SEQ ID NO: 14222 - protein, 7 aa, Artificial Sequence
  Synthetic
RFPGDGA

SEQ ID NO: 14223 - protein, 7 aa, Artificial Sequence
  Synthetic
KEYGSAW

SEQ ID NO: 14224 - protein, 7 aa, Artificial Sequence
  Synthetic
SAIYGSR

SEQ ID NO: 14225 - protein, 7 aa, Artificial Sequence
  Synthetic
RYVGSSA

SEQ ID NO: 14226 - protein, 7 aa, Artificial Sequence
  Synthetic
GGETGRW

SEQ ID NO: 14227 - protein, 7 aa, Artificial Sequence
  Synthetic
GESLGPW

SEQ ID NO: 14228 - protein, 7 aa, Artificial Sequence
  Synthetic
LLYREGL

SEQ ID NO: 14229 - protein, 7 aa, Artificial Sequence
  Synthetic
VPSNYHT

SEQ ID NO: 14230 - protein, 7 aa, Artificial Sequence
  Synthetic
SVIGYSQ

SEQ ID NO: 14231 - protein, 7 aa, Artificial Sequence
  Synthetic
SFPYSSS

SEQ ID NO: 14232 - protein, 7 aa, Artificial Sequence
  Synthetic
MIRHGSA

SEQ ID NO: 14233 - protein, 7 aa, Artificial Sequence
  Synthetic
ERHAYSS

SEQ ID NO: 14234 - protein, 7 aa, Artificial Sequence
  Synthetic
LLAGYND

SEQ ID NO: 14235 - protein, 7 aa, Artificial Sequence
  Synthetic
YLSGYVN

SEQ ID NO: 14236 - protein, 7 aa, Artificial Sequence
  Synthetic
LFEFHSS

SEQ ID NO: 14237 - protein, 7 aa, Artificial Sequence
  Synthetic
PSDLGRW

SEQ ID NO: 14238 - protein, 7 aa, Artificial Sequence
  Synthetic
LATSRWD

SEQ ID NO: 14239 - protein, 7 aa, Artificial Sequence
  Synthetic
YGSLNLL

SEQ ID NO: 14240 - protein, 7 aa, Artificial Sequence
  Synthetic
GLGWRVD

SEQ ID NO: 14241 - protein, 7 aa, Artificial Sequence
  Synthetic
KIGLTPI

SEQ ID NO: 14242 - protein, 7 aa, Artificial Sequence
  Synthetic
MWHTGSS

SEQ ID NO: 14243 - protein, 7 aa, Artificial Sequence
  Synthetic
GNDPGPW

SEQ ID NO: 14244 - protein, 7 aa, Artificial Sequence
  Synthetic
WSPYVSG

SEQ ID NO: 14245 - protein, 7 aa, Artificial Sequence
  Synthetic
WGAYGSQ

SEQ ID NO: 14246 - protein, 7 aa, Artificial Sequence
  Synthetic
TAMGFSS

SEQ ID NO: 14247 - protein, 7 aa, Artificial Sequence
  Synthetic
MFSLGKP

SEQ ID NO: 14248 - protein, 7 aa, Artificial Sequence
  Synthetic
PHPGASS

SEQ ID NO: 14249 - protein, 7 aa, Artificial Sequence
  Synthetic
QGLGFSS

SEQ ID NO: 14250 - protein, 7 aa, Artificial Sequence
  Synthetic
PRWGEST

SEQ ID NO: 14251 - protein, 7 aa, Artificial Sequence
  Synthetic
PQHSAIW

SEQ ID NO: 14252 - protein, 7 aa, Artificial Sequence
  Synthetic
RHHADSA

SEQ ID NO: 14253 - protein, 7 aa, Artificial Sequence
  Synthetic
LMYGMAS

SEQ ID NO: 14254 - protein, 7 aa, Artificial Sequence
  Synthetic
GAELGRW

SEQ ID NO: 14255 - protein, 7 aa, Artificial Sequence
  Synthetic
EQYRGST

SEQ ID NO: 14256 - protein, 7 aa, Artificial Sequence
  Synthetic
WSERGSS

SEQ ID NO: 14257 - protein, 7 aa, Artificial Sequence
  Synthetic
HFHGGAS

SEQ ID NO: 14258 - protein, 7 aa, Artificial Sequence
  Synthetic
GLYEIFN

SEQ ID NO: 14259 - protein, 7 aa, Artificial Sequence
  Synthetic
ANHGYSM

SEQ ID NO: 14260 - protein, 7 aa, Artificial Sequence
  Synthetic
GWSSGQF

SEQ ID NO: 14261 - protein, 7 aa, Artificial Sequence
  Synthetic
WFGGGSQ

SEQ ID NO: 14262 - protein, 7 aa, Artificial Sequence
  Synthetic
LHIGAAQ

SEQ ID NO: 14263 - protein, 7 aa, Artificial Sequence
  Synthetic
EVPHQYH

SEQ ID NO: 14264 - protein, 7 aa, Artificial Sequence
  Synthetic
LFYGGSS

SEQ ID NO: 14265 - protein, 7 aa, Artificial Sequence
  Synthetic
GGIGWSS

SEQ ID NO: 14266 - protein, 7 aa, Artificial Sequence
  Synthetic
LWIGGSQ

SEQ ID NO: 14267 - protein, 7 aa, Artificial Sequence
  Synthetic
QVGWRSD

SEQ ID NO: 14268 - protein, 7 aa, Artificial Sequence
  Synthetic
WRELGST

SEQ ID NO: 14269 - protein, 7 aa, Artificial Sequence
  Synthetic
LMHMGSS

SEQ ID NO: 14270 - protein, 7 aa, Artificial Sequence
  Synthetic
DVATNRW

SEQ ID NO: 14271 - protein, 7 aa, Artificial Sequence
  Synthetic
WSVEGSR

SEQ ID NO: 14272 - protein, 7 aa, Artificial Sequence
  Synthetic
IARLGSS

SEQ ID NO: 14273 - protein, 7 aa, Artificial Sequence
  Synthetic
DAPGWAT

SEQ ID NO: 14274 - protein, 7 aa, Artificial Sequence
  Synthetic
GNMPFAY

SEQ ID NO: 14275 - protein, 7 aa, Artificial Sequence
  Synthetic
GKAGYGF

SEQ ID NO: 14276 - protein, 7 aa, Artificial Sequence
  Synthetic
YGSLSMV

SEQ ID NO: 14277 - protein, 7 aa, Artificial Sequence
  Synthetic
TWQGGAT

SEQ ID NO: 14278 - protein, 7 aa, Artificial Sequence
  Synthetic
TIAYGST

SEQ ID NO: 14279 - protein, 7 aa, Artificial Sequence
  Synthetic
GNPNWST

SEQ ID NO: 14280 - protein, 7 aa, Artificial Sequence
  Synthetic
TDRTWSH

SEQ ID NO: 14281 - protein, 7 aa, Artificial Sequence
  Synthetic
LWTTGST

SEQ ID NO: 14282 - protein, 7 aa, Artificial Sequence
  Synthetic
DVVSSRW

SEQ ID NO: 14283 - protein, 7 aa, Artificial Sequence
  Synthetic
LDGSGRW

SEQ ID NO: 14284 - protein, 7 aa, Artificial Sequence
  Synthetic
LAIRLAS

SEQ ID NO: 14285 - protein, 7 aa, Artificial Sequence
  Synthetic
TWLGSSS

SEQ ID NO: 14286 - protein, 7 aa, Artificial Sequence
  Synthetic
AEPRSWV

SEQ ID NO: 14287 - protein, 7 aa, Artificial Sequence
  Synthetic
GWHGAAS

SEQ ID NO: 14288 - protein, 7 aa, Artificial Sequence
  Synthetic
GPNPGKW

SEQ ID NO: 14289 - protein, 7 aa, Artificial Sequence
  Synthetic
QHPGFSV

SEQ ID NO: 14290 - protein, 7 aa, Artificial Sequence
  Synthetic
GWQGGSV

SEQ ID NO: 14291 - protein, 7 aa, Artificial Sequence
  Synthetic
WQMGGST

SEQ ID NO: 14292 - protein, 7 aa, Artificial Sequence
  Synthetic
WKTGGST

SEQ ID NO: 14293 - protein, 7 aa, Artificial Sequence
  Synthetic
LREWSIS

SEQ ID NO: 14294 - protein, 7 aa, Artificial Sequence
  Synthetic
VFRGMSS

SEQ ID NO: 14295 - protein, 7 aa, Artificial Sequence
  Synthetic
WRPGGSS

SEQ ID NO: 14296 - protein, 7 aa, Artificial Sequence
  Synthetic
DWRGGAT

SEQ ID NO: 14297 - protein, 7 aa, Artificial Sequence
  Synthetic
IGPPGKW

SEQ ID NO: 14298 - protein, 7 aa, Artificial Sequence
  Synthetic
AGQVRWD

SEQ ID NO: 14299 - protein, 7 aa, Artificial Sequence
  Synthetic
HVSYGSQ

SEQ ID NO: 14300 - protein, 7 aa, Artificial Sequence
  Synthetic
ERPYGSA

SEQ ID NO: 14301 - protein, 7 aa, Artificial Sequence
  Synthetic
ARSTDYW

SEQ ID NO: 14302 - protein, 7 aa, Artificial Sequence
  Synthetic
RFTADST

SEQ ID NO: 14303 - protein, 7 aa, Artificial Sequence
  Synthetic
GSELGRW

SEQ ID NO: 14304 - protein, 7 aa, Artificial Sequence
  Synthetic
RPDEVRW

SEQ ID NO: 14305 - protein, 7 aa, Artificial Sequence
  Synthetic
RWHGEAA

SEQ ID NO: 14306 - protein, 7 aa, Artificial Sequence
  Synthetic
KSVGSVY

SEQ ID NO: 14307 - protein, 7 aa, Artificial Sequence
  Synthetic
GWMGGAS

SEQ ID NO: 14308 - protein, 7 aa, Artificial Sequence
  Synthetic
DRVFGSA

SEQ ID NO: 14309 - protein, 7 aa, Artificial Sequence
  Synthetic
DLASARW

SEQ ID NO: 14310 - protein, 7 aa, Artificial Sequence
  Synthetic
LGSLGRF

SEQ ID NO: 14311 - protein, 7 aa, Artificial Sequence
  Synthetic
WSLPNGG

SEQ ID NO: 14312 - protein, 7 aa, Artificial Sequence
  Synthetic
PFEPNRW

SEQ ID NO: 14313 - protein, 7 aa, Artificial Sequence
  Synthetic
PRIAYAS

SEQ ID NO: 14314 - protein, 7 aa, Artificial Sequence
  Synthetic
ERWAGAA

SEQ ID NO: 14315 - protein, 7 aa, Artificial Sequence
  Synthetic
MWSGSST

SEQ ID NO: 14316 - protein, 7 aa, Artificial Sequence
  Synthetic
RFSIGPP

SEQ ID NO: 14317 - protein, 7 aa, Artificial Sequence
  Synthetic
PRAAFSA

SEQ ID NO: 14318 - protein, 7 aa, Artificial Sequence
  Synthetic
RSVGTLY

SEQ ID NO: 14319 - protein, 7 aa, Artificial Sequence
  Synthetic
WSEWSKG

SEQ ID NO: 14320 - protein, 7 aa, Artificial Sequence
  Synthetic
ERMGYSV

SEQ ID NO: 14321 - protein, 7 aa, Artificial Sequence
  Synthetic
RWHGDGS

SEQ ID NO: 14322 - protein, 7 aa, Artificial Sequence
  Synthetic
EAPGYSS

SEQ ID NO: 14323 - protein, 7 aa, Artificial Sequence
  Synthetic
VHVGFSS

SEQ ID NO: 14324 - protein, 7 aa, Artificial Sequence
  Synthetic
EALGWAS

SEQ ID NO: 14325 - protein, 7 aa, Artificial Sequence
  Synthetic
LWPGSAT

SEQ ID NO: 14326 - protein, 7 aa, Artificial Sequence
  Synthetic
SYIPAGH

SEQ ID NO: 14327 - protein, 7 aa, Artificial Sequence
  Synthetic
SEGDATI

SEQ ID NO: 14328 - protein, 7 aa, Artificial Sequence
  Synthetic
GTLRLTN

SEQ ID NO: 14329 - protein, 7 aa, Artificial Sequence
  Synthetic
IVSNYHI

SEQ ID NO: 14330 - protein, 7 aa, Artificial Sequence
  Synthetic
EKSWSAA

SEQ ID NO: 14331 - protein, 7 aa, Artificial Sequence
  Synthetic
LWPSGSV

SEQ ID NO: 14332 - protein, 7 aa, Artificial Sequence
  Synthetic
PYSNYAA

SEQ ID NO: 14333 - protein, 7 aa, Artificial Sequence
  Synthetic
ELFRGFA

SEQ ID NO: 14334 - protein, 7 aa, Artificial Sequence
  Synthetic
HKVLGSS

SEQ ID NO: 14335 - protein, 7 aa, Artificial Sequence
  Synthetic
LYVPASS

SEQ ID NO: 14336 - protein, 7 aa, Artificial Sequence
  Synthetic
WRLGPEP

SEQ ID NO: 14337 - protein, 7 aa, Artificial Sequence
  Synthetic
DWARGAS

SEQ ID NO: 14338 - protein, 7 aa, Artificial Sequence
  Synthetic
HLLLGSS

SEQ ID NO: 14339 - protein, 7 aa, Artificial Sequence
  Synthetic
LDWGGST

SEQ ID NO: 14340 - protein, 7 aa, Artificial Sequence
  Synthetic
MDYRLPT

SEQ ID NO: 14341 - protein, 7 aa, Artificial Sequence
  Synthetic
SGPFLSS

SEQ ID NO: 14342 - protein, 7 aa, Artificial Sequence
  Synthetic
LHFGHAQ

SEQ ID NO: 14343 - protein, 7 aa, Artificial Sequence
  Synthetic
EWSRGSS

SEQ ID NO: 14344 - protein, 7 aa, Artificial Sequence
  Synthetic
MWHNGAA

SEQ ID NO: 14345 - protein, 7 aa, Artificial Sequence
  Synthetic
EKWGGSS

SEQ ID NO: 14346 - protein, 7 aa, Artificial Sequence
  Synthetic
SALYGST

SEQ ID NO: 14347 - protein, 7 aa, Artificial Sequence
  Synthetic
MYPGSSS

SEQ ID NO: 14348 - protein, 7 aa, Artificial Sequence
  Synthetic
KGLADHW

SEQ ID NO: 14349 - protein, 7 aa, Artificial Sequence
  Synthetic
ASAARWD

SEQ ID NO: 14350 - protein, 7 aa, Artificial Sequence
  Synthetic
KHWEGST

SEQ ID NO: 14351 - protein, 7 aa, Artificial Sequence
  Synthetic
RGVLLQL

SEQ ID NO: 14352 - protein, 7 aa, Artificial Sequence
  Synthetic
LWPGMAS

SEQ ID NO: 14353 - protein, 7 aa, Artificial Sequence
  Synthetic
THANWAS

SEQ ID NO: 14354 - protein, 7 aa, Artificial Sequence
  Synthetic
NPGLLPY

SEQ ID NO: 14355 - protein, 7 aa, Artificial Sequence
  Synthetic
YRALPGV

SEQ ID NO: 14356 - protein, 7 aa, Artificial Sequence
  Synthetic
DVRSTWT

SEQ ID NO: 14357 - protein, 7 aa, Artificial Sequence
  Synthetic
PAAGMNW

SEQ ID NO: 14358 - protein, 7 aa, Artificial Sequence
  Synthetic
GASPGPW

SEQ ID NO: 14359 - protein, 7 aa, Artificial Sequence
  Synthetic
FKVLGSS

SEQ ID NO: 14360 - protein, 7 aa, Artificial Sequence
  Synthetic
WIIGGSA

SEQ ID NO: 14361 - protein, 7 aa, Artificial Sequence
  Synthetic
LWVAGAS

SEQ ID NO: 14362 - protein, 7 aa, Artificial Sequence
  Synthetic
VMYGGSS

SEQ ID NO: 14363 - protein, 7 aa, Artificial Sequence
  Synthetic
LAWSGST

SEQ ID NO: 14364 - protein, 7 aa, Artificial Sequence
  Synthetic
MKPWESS

SEQ ID NO: 14365 - protein, 7 aa, Artificial Sequence
  Synthetic
QTNHGYW

SEQ ID NO: 14366 - protein, 7 aa, Artificial Sequence
  Synthetic
SAKWEAS

SEQ ID NO: 14367 - protein, 7 aa, Artificial Sequence
  Synthetic
AYVGYAV

SEQ ID NO: 14368 - protein, 7 aa, Artificial Sequence
  Synthetic
EHFRGAT

SEQ ID NO: 14369 - protein, 7 aa, Artificial Sequence
  Synthetic
VRAGYSA

SEQ ID NO: 14370 - protein, 7 aa, Artificial Sequence
  Synthetic
LRSLMSS

SEQ ID NO: 14371 - protein, 7 aa, Artificial Sequence
  Synthetic
WGSLSDY

SEQ ID NO: 14372 - protein, 7 aa, Artificial Sequence
  Synthetic
AQSPGRW

SEQ ID NO: 14373 - protein, 7 aa, Artificial Sequence
  Synthetic
LDYASRF

SEQ ID NO: 14374 - protein, 7 aa, Artificial Sequence
  Synthetic
KFLGGSS

SEQ ID NO: 14375 - protein, 7 aa, Artificial Sequence
  Synthetic
WIDRGSM

SEQ ID NO: 14376 - protein, 7 aa, Artificial Sequence
  Synthetic
AKYALPI

SEQ ID NO: 14377 - protein, 7 aa, Artificial Sequence
  Synthetic
NEVSGRW

SEQ ID NO: 14378 - protein, 7 aa, Artificial Sequence
  Synthetic
PGQPGVW

SEQ ID NO: 14379 - protein, 7 aa, Artificial Sequence
  Synthetic
SWQGSAS

SEQ ID NO: 14380 - protein, 7 aa, Artificial Sequence
  Synthetic
GYIGGST

SEQ ID NO: 14381 - protein, 7 aa, Artificial Sequence
  Synthetic
PIAHYSA

SEQ ID NO: 14382 - protein, 7 aa, Artificial Sequence
  Synthetic
IMYHLEK

SEQ ID NO: 14383 - protein, 7 aa, Artificial Sequence
  Synthetic
AKEYTGW

SEQ ID NO: 14384 - protein, 7 aa, Artificial Sequence
  Synthetic
ERHSGAW

SEQ ID NO: 14385 - protein, 7 aa, Artificial Sequence
  Synthetic
SVWQGSV

SEQ ID NO: 14386 - protein, 7 aa, Artificial Sequence
  Synthetic
QPEEFRW

SEQ ID NO: 14387 - protein, 7 aa, Artificial Sequence
  Synthetic
FAVEGSR

SEQ ID NO: 14388 - protein, 7 aa, Artificial Sequence
  Synthetic
SHLHGSS

SEQ ID NO: 14389 - protein, 7 aa, Artificial Sequence
  Synthetic
LERGYSQ

SEQ ID NO: 14390 - protein, 7 aa, Artificial Sequence
  Synthetic
LNPGYSQ

SEQ ID NO: 14391 - protein, 7 aa, Artificial Sequence
  Synthetic
TGHGYST

SEQ ID NO: 14392 - protein, 7 aa, Artificial Sequence
  Synthetic
ERWVGSV

SEQ ID NO: 14393 - protein, 7 aa, Artificial Sequence
  Synthetic
MSTHGSS

SEQ ID NO: 14394 - protein, 7 aa, Artificial Sequence
  Synthetic
PVWKDYA

SEQ ID NO: 14395 - protein, 7 aa, Artificial Sequence
  Synthetic
QAWNGST

SEQ ID NO: 14396 - protein, 7 aa, Artificial Sequence
  Synthetic
LTKGYST

SEQ ID NO: 14397 - protein, 7 aa, Artificial Sequence
  Synthetic
GEGSRWN

SEQ ID NO: 14398 - protein, 7 aa, Artificial Sequence
  Synthetic
YANFAYG

SEQ ID NO: 14399 - protein, 7 aa, Artificial Sequence
  Synthetic
PFIGSAA

SEQ ID NO: 14400 - protein, 7 aa, Artificial Sequence
  Synthetic
DISHRYM

SEQ ID NO: 14401 - protein, 7 aa, Artificial Sequence
  Synthetic
VLQGYRD

SEQ ID NO: 14402 - protein, 7 aa, Artificial Sequence
  Synthetic
DFSRGAS

SEQ ID NO: 14403 - protein, 7 aa, Artificial Sequence
  Synthetic
WTVAGGH

SEQ ID NO: 14404 - protein, 7 aa, Artificial Sequence
  Synthetic
RGVGLSQ

SEQ ID NO: 14405 - protein, 7 aa, Artificial Sequence
  Synthetic
LLKYGSS

SEQ ID NO: 14406 - protein, 7 aa, Artificial Sequence
  Synthetic
KYVGGAA

SEQ ID NO: 14407 - protein, 7 aa, Artificial Sequence
  Synthetic
LGDIGRW

SEQ ID NO: 14408 - protein, 7 aa, Artificial Sequence
  Synthetic
MVVGSIY

SEQ ID NO: 14409 - protein, 7 aa, Artificial Sequence
  Synthetic
WRLAGSA

SEQ ID NO: 14410 - protein, 7 aa, Artificial Sequence
  Synthetic
KVTDGFR

SEQ ID NO: 14411 - protein, 7 aa, Artificial Sequence
  Synthetic
TASWTAS

SEQ ID NO: 14412 - protein, 7 aa, Artificial Sequence
  Synthetic
RLDEVRW

SEQ ID NO: 14413 - protein, 7 aa, Artificial Sequence
  Synthetic
QYIGGAS

SEQ ID NO: 14414 - protein, 7 aa, Artificial Sequence
  Synthetic
SWPGGAA

SEQ ID NO: 14415 - protein, 7 aa, Artificial Sequence
  Synthetic
LFAAGST

SEQ ID NO: 14416 - protein, 7 aa, Artificial Sequence
  Synthetic
EVFKLPH

SEQ ID NO: 14417 - protein, 7 aa, Artificial Sequence
  Synthetic
GILRLVN

SEQ ID NO: 14418 - protein, 7 aa, Artificial Sequence
  Synthetic
LEFLGST

SEQ ID NO: 14419 - protein, 7 aa, Artificial Sequence
  Synthetic
VWGGPDR

SEQ ID NO: 14420 - protein, 7 aa, Artificial Sequence
  Synthetic
VALYGST

SEQ ID NO: 14421 - protein, 7 aa, Artificial Sequence
  Synthetic
MYYNGSH

SEQ ID NO: 14422 - protein, 7 aa, Artificial Sequence
  Synthetic
LLSYGSS

SEQ ID NO: 14423 - protein, 7 aa, Artificial Sequence
  Synthetic
TYVPAGS

SEQ ID NO: 14424 - protein, 7 aa, Artificial Sequence
  Synthetic
GVPNWSS

SEQ ID NO: 14425 - protein, 7 aa, Artificial Sequence
  Synthetic
GENSNRW

SEQ ID NO: 14426 - protein, 7 aa, Artificial Sequence
  Synthetic
DRWGLSQ

SEQ ID NO: 14427 - protein, 7 aa, Artificial Sequence
  Synthetic
ELVGVGW

SEQ ID NO: 14428 - protein, 7 aa, Artificial Sequence
  Synthetic
KVGDYAW

SEQ ID NO: 14429 - protein, 7 aa, Artificial Sequence
  Synthetic
RAMGSIY

SEQ ID NO: 14430 - protein, 7 aa, Artificial Sequence
  Synthetic
FGVLHAH

SEQ ID NO: 14431 - protein, 7 aa, Artificial Sequence
  Synthetic
WVYGSSE

SEQ ID NO: 14432 - protein, 7 aa, Artificial Sequence
  Synthetic
SFKGGST

SEQ ID NO: 14433 - protein, 7 aa, Artificial Sequence
  Synthetic
RWDNDMV

SEQ ID NO: 14434 - protein, 7 aa, Artificial Sequence
  Synthetic
GHSPGIW

SEQ ID NO: 14435 - protein, 7 aa, Artificial Sequence
  Synthetic
GTRYDLS

SEQ ID NO: 14436 - protein, 7 aa, Artificial Sequence
  Synthetic
VPFRPDV

SEQ ID NO: 14437 - protein, 7 aa, Artificial Sequence
  Synthetic
WRANGSV

SEQ ID NO: 14438 - protein, 7 aa, Artificial Sequence
  Synthetic
SRLGSLM

SEQ ID NO: 14439 - protein, 7 aa, Artificial Sequence
  Synthetic
RAPGLSS

SEQ ID NO: 14440 - protein, 7 aa, Artificial Sequence
  Synthetic
APYVVQT

SEQ ID NO: 14441 - protein, 7 aa, Artificial Sequence
  Synthetic
WHTQTGY

SEQ ID NO: 14442 - protein, 7 aa, Artificial Sequence
  Synthetic
TFHGSST

SEQ ID NO: 14443 - protein, 7 aa, Artificial Sequence
  Synthetic
VRAGSVY

SEQ ID NO: 14444 - protein, 7 aa, Artificial Sequence
  Synthetic
WKLESGF

SEQ ID NO: 14445 - protein, 7 aa, Artificial Sequence
  Synthetic
VAKYGST

SEQ ID NO: 14446 - protein, 7 aa, Artificial Sequence
  Synthetic
AREHWSS

SEQ ID NO: 14447 - protein, 7 aa, Artificial Sequence
  Synthetic
MASQWSH

SEQ ID NO: 14448 - protein, 7 aa, Artificial Sequence
  Synthetic
LKEYGSS

SEQ ID NO: 14449 - protein, 7 aa, Artificial Sequence
  Synthetic
FVFGSEY

SEQ ID NO: 14450 - protein, 7 aa, Artificial Sequence
  Synthetic
SASWGSS

SEQ ID NO: 14451 - protein, 7 aa, Artificial Sequence
  Synthetic
YATWVHN

SEQ ID NO: 14452 - protein, 7 aa, Artificial Sequence
  Synthetic
LNLGYSQ

SEQ ID NO: 14453 - protein, 7 aa, Artificial Sequence
  Synthetic
SEVGSVY

SEQ ID NO: 14454 - protein, 7 aa, Artificial Sequence
  Synthetic
GFPENRW

SEQ ID NO: 14455 - protein, 7 aa, Artificial Sequence
  Synthetic
WGSLNNF

SEQ ID NO: 14456 - protein, 7 aa, Artificial Sequence
  Synthetic
LYYPSSA

SEQ ID NO: 14457 - protein, 7 aa, Artificial Sequence
  Synthetic
EVWAGSR

SEQ ID NO: 14458 - protein, 7 aa, Artificial Sequence
  Synthetic
PMVRSFG

SEQ ID NO: 14459 - protein, 7 aa, Artificial Sequence
  Synthetic
ERWSGSM

SEQ ID NO: 14460 - protein, 7 aa, Artificial Sequence
  Synthetic
TEVTGRW

SEQ ID NO: 14461 - protein, 7 aa, Artificial Sequence
  Synthetic
EWEHYSA

SEQ ID NO: 14462 - protein, 7 aa, Artificial Sequence
  Synthetic
LFVGSST

SEQ ID NO: 14463 - protein, 7 aa, Artificial Sequence
  Synthetic
RYHSDSA

SEQ ID NO: 14464 - protein, 7 aa, Artificial Sequence
  Synthetic
PFYSGSA

SEQ ID NO: 14465 - protein, 7 aa, Artificial Sequence
  Synthetic
FVFPHGE

SEQ ID NO: 14466 - protein, 7 aa, Artificial Sequence
  Synthetic
FLAGYST

SEQ ID NO: 14467 - protein, 7 aa, Artificial Sequence
  Synthetic
QQFRLDL

SEQ ID NO: 14468 - protein, 7 aa, Artificial Sequence
  Synthetic
WGSLNQF

SEQ ID NO: 14469 - protein, 7 aa, Artificial Sequence
  Synthetic
LWGQGAQ

SEQ ID NO: 14470 - protein, 7 aa, Artificial Sequence
  Synthetic
VKSSTWN

SEQ ID NO: 14471 - protein, 7 aa, Artificial Sequence
  Synthetic
ANFGQAQ

SEQ ID NO: 14472 - protein, 7 aa, Artificial Sequence
  Synthetic
VSYEARY

SEQ ID NO: 14473 - protein, 7 aa, Artificial Sequence
  Synthetic
VRIGGAQ

SEQ ID NO: 14474 - protein, 7 aa, Artificial Sequence
  Synthetic
LWERGSM

SEQ ID NO: 14475 - protein, 7 aa, Artificial Sequence
  Synthetic
DRHSAIW

SEQ ID NO: 14476 - protein, 7 aa, Artificial Sequence
  Synthetic
PAYHLGA

SEQ ID NO: 14477 - protein, 7 aa, Artificial Sequence
  Synthetic
MKGYGSS

SEQ ID NO: 14478 - protein, 7 aa, Artificial Sequence
  Synthetic
IGSLYGL

SEQ ID NO: 14479 - protein, 7 aa, Artificial Sequence
  Synthetic
MDYRLPV

SEQ ID NO: 14480 - protein, 7 aa, Artificial Sequence
  Synthetic
LHPPWSS

SEQ ID NO: 14481 - protein, 7 aa, Artificial Sequence
  Synthetic
HTLLGAA

SEQ ID NO: 14482 - protein, 7 aa, Artificial Sequence
  Synthetic
PHDPGIW

SEQ ID NO: 14483 - protein, 7 aa, Artificial Sequence
  Synthetic
ESPGLWS

SEQ ID NO: 14484 - protein, 7 aa, Artificial Sequence
  Synthetic
VMFHGSS

SEQ ID NO: 14485 - protein, 7 aa, Artificial Sequence
  Synthetic
VWHGGAA

SEQ ID NO: 14486 - protein, 7 aa, Artificial Sequence
  Synthetic
SYPNFSV

SEQ ID NO: 14487 - protein, 7 aa, Artificial Sequence
  Synthetic
THTGFST

SEQ ID NO: 14488 - protein, 7 aa, Artificial Sequence
  Synthetic
GFGEARW

SEQ ID NO: 14489 - protein, 7 aa, Artificial Sequence
  Synthetic
WSPGGSQ

SEQ ID NO: 14490 - protein, 7 aa, Artificial Sequence
  Synthetic
GTWSKFP

SEQ ID NO: 14491 - protein, 7 aa, Artificial Sequence
  Synthetic
LWAGTSM

SEQ ID NO: 14492 - protein, 7 aa, Artificial Sequence
  Synthetic
RFPGDGS

SEQ ID NO: 14493 - protein, 7 aa, Artificial Sequence
  Synthetic
KEYSLER

SEQ ID NO: 14494 - protein, 7 aa, Artificial Sequence
  Synthetic
FSKGYST

SEQ ID NO: 14495 - protein, 7 aa, Artificial Sequence
  Synthetic
YKSGWSS

SEQ ID NO: 14496 - protein, 7 aa, Artificial Sequence
  Synthetic
WAAHGSQ

SEQ ID NO: 14497 - protein, 7 aa, Artificial Sequence
  Synthetic
WSVGGST

SEQ ID NO: 14498 - protein, 7 aa, Artificial Sequence
  Synthetic
RYPGESM

SEQ ID NO: 14499 - protein, 7 aa, Artificial Sequence
  Synthetic
RYMGELL

SEQ ID NO: 14500 - protein, 7 aa, Artificial Sequence
  Synthetic
SFPGYAT

SEQ ID NO: 14501 - protein, 7 aa, Artificial Sequence
  Synthetic
DPSRSWT

SEQ ID NO: 14502 - protein, 7 aa, Artificial Sequence
  Synthetic
ASRGSIY

SEQ ID NO: 14503 - protein, 7 aa, Artificial Sequence
  Synthetic
RGSGLSQ

SEQ ID NO: 14504 - protein, 7 aa, Artificial Sequence
  Synthetic
ERYAGSS

SEQ ID NO: 14505 - protein, 7 aa, Artificial Sequence
  Synthetic
GKIVGPW

SEQ ID NO: 14506 - protein, 7 aa, Artificial Sequence
  Synthetic
AAWAGSQ

SEQ ID NO: 14507 - protein, 7 aa, Artificial Sequence
  Synthetic
GGETGRW

SEQ ID NO: 14508 - protein, 7 aa, Artificial Sequence
  Synthetic
LYIGASS

SEQ ID NO: 14509 - protein, 7 aa, Artificial Sequence
  Synthetic
WHSLAGS

SEQ ID NO: 14510 - protein, 7 aa, Artificial Sequence
  Synthetic
VHLGFSS

SEQ ID NO: 14511 - protein, 7 aa, Artificial Sequence
  Synthetic
YENYRYP

SEQ ID NO: 14512 - protein, 7 aa, Artificial Sequence
  Synthetic
SHWQGSA

SEQ ID NO: 14513 - protein, 7 aa, Artificial Sequence
  Synthetic
LLGGYSQ

SEQ ID NO: 14514 - protein, 7 aa, Artificial Sequence
  Synthetic
SMSRYDI

SEQ ID NO: 14515 - protein, 7 aa, Artificial Sequence
  Synthetic
SWHSGSS

SEQ ID NO: 14516 - protein, 7 aa, Artificial Sequence
  Synthetic
IYPGTST

SEQ ID NO: 14517 - protein, 7 aa, Artificial Sequence
  Synthetic
PPNDSRW

SEQ ID NO: 14518 - protein, 7 aa, Artificial Sequence
  Synthetic
RYVNDAS

SEQ ID NO: 14519 - protein, 7 aa, Artificial Sequence
  Synthetic
TIVYGSS

SEQ ID NO: 14520 - protein, 7 aa, Artificial Sequence
  Synthetic
WRLAGSA

SEQ ID NO: 14521 - protein, 7 aa, Artificial Sequence
  Synthetic
WVSLPLN

SEQ ID NO: 14522 - protein, 7 aa, Artificial Sequence
  Synthetic
WGSPAHT

SEQ ID NO: 14523 - protein, 7 aa, Artificial Sequence
  Synthetic
WRDQGST

SEQ ID NO: 14524 - protein, 7 aa, Artificial Sequence
  Synthetic
WGDVRWN

SEQ ID NO: 14525 - protein, 7 aa, Artificial Sequence
  Synthetic
PSEHSRW

SEQ ID NO: 14526 - protein, 7 aa, Artificial Sequence
  Synthetic
IPHSGVW

SEQ ID NO: 14527 - protein, 7 aa, Artificial Sequence
  Synthetic
GEVTGRW

SEQ ID NO: 14528 - protein, 7 aa, Artificial Sequence
  Synthetic
TQRMGAA

SEQ ID NO: 14529 - protein, 7 aa, Artificial Sequence
  Synthetic
HEYRGSA

SEQ ID NO: 14530 - protein, 7 aa, Artificial Sequence
  Synthetic
PPAHGSW

SEQ ID NO: 14531 - protein, 7 aa, Artificial Sequence
  Synthetic
KFIVGTI

SEQ ID NO: 14532 - protein, 7 aa, Artificial Sequence
  Synthetic
RYTLGAA

SEQ ID NO: 14533 - protein, 7 aa, Artificial Sequence
  Synthetic
PVWGSTS

SEQ ID NO: 14534 - protein, 7 aa, Artificial Sequence
  Synthetic
WDLVEGY

SEQ ID NO: 14535 - protein, 7 aa, Artificial Sequence
  Synthetic
LKWGNAT

SEQ ID NO: 14536 - protein, 7 aa, Artificial Sequence
  Synthetic
TSIVRWD

SEQ ID NO: 14537 - protein, 7 aa, Artificial Sequence
  Synthetic
WFEHGSA

SEQ ID NO: 14538 - protein, 7 aa, Artificial Sequence
  Synthetic
VPYSLTV

SEQ ID NO: 14539 - protein, 7 aa, Artificial Sequence
  Synthetic
MAVGWSA

SEQ ID NO: 14540 - protein, 7 aa, Artificial Sequence
  Synthetic
TVPTSHW

SEQ ID NO: 14541 - protein, 7 aa, Artificial Sequence
  Synthetic
GSVASHW

SEQ ID NO: 14542 - protein, 7 aa, Artificial Sequence
  Synthetic
PRAPGAW

SEQ ID NO: 14543 - protein, 7 aa, Artificial Sequence
  Synthetic
AGYGYSS

SEQ ID NO: 14544 - protein, 7 aa, Artificial Sequence
  Synthetic
QGHSSWA

SEQ ID NO: 14545 - protein, 7 aa, Artificial Sequence
  Synthetic
ARWEGSA

SEQ ID NO: 14546 - protein, 7 aa, Artificial Sequence
  Synthetic
VYIGGAQ

SEQ ID NO: 14547 - protein, 7 aa, Artificial Sequence
  Synthetic
SVHWKAD

SEQ ID NO: 14548 - protein, 7 aa, Artificial Sequence
  Synthetic
MFQGYSV

SEQ ID NO: 14549 - protein, 7 aa, Artificial Sequence
  Synthetic
LQHGLSQ

SEQ ID NO: 14550 - protein, 7 aa, Artificial Sequence
  Synthetic
SFLGGAS

SEQ ID NO: 14551 - protein, 7 aa, Artificial Sequence
  Synthetic
EYIGMSS

SEQ ID NO: 14552 - protein, 7 aa, Artificial Sequence
  Synthetic
HIYSGSM

SEQ ID NO: 14553 - protein, 7 aa, Artificial Sequence
  Synthetic
VMTGYSA

SEQ ID NO: 14554 - protein, 7 aa, Artificial Sequence
  Synthetic
AAVTHGW

SEQ ID NO: 14555 - protein, 7 aa, Artificial Sequence
  Synthetic
VVPYGSS

SEQ ID NO: 14556 - protein, 7 aa, Artificial Sequence
  Synthetic
LNVGFST

SEQ ID NO: 14557 - protein, 7 aa, Artificial Sequence
  Synthetic
YMQMYSN

SEQ ID NO: 14558 - protein, 7 aa, Artificial Sequence
  Synthetic
ARALGSA

SEQ ID NO: 14559 - protein, 7 aa, Artificial Sequence
  Synthetic
WDIATGY

SEQ ID NO: 14560 - protein, 7 aa, Artificial Sequence
  Synthetic
HGHGFAQ

SEQ ID NO: 14561 - protein, 7 aa, Artificial Sequence
  Synthetic
PQASGIW

SEQ ID NO: 14562 - protein, 7 aa, Artificial Sequence
  Synthetic
AALRLTN

SEQ ID NO: 14563 - protein, 7 aa, Artificial Sequence
  Synthetic
YRSLPQV

SEQ ID NO: 14564 - protein, 7 aa, Artificial Sequence
  Synthetic
PKIVLAA

SEQ ID NO: 14565 - protein, 7 aa, Artificial Sequence
  Synthetic
ERTWSAA

SEQ ID NO: 14566 - protein, 7 aa, Artificial Sequence
  Synthetic
TGLGFSS

SEQ ID NO: 14567 - protein, 7 aa, Artificial Sequence
  Synthetic
ALWAGSS

SEQ ID NO: 14568 - protein, 7 aa, Artificial Sequence
  Synthetic
MMSRFSA

SEQ ID NO: 14569 - protein, 7 aa, Artificial Sequence
  Synthetic
RQYSLEM

SEQ ID NO: 14570 - protein, 7 aa, Artificial Sequence
  Synthetic
DESSALR

SEQ ID NO: 14571 - protein, 7 aa, Artificial Sequence
  Synthetic
TAAWMAQ

SEQ ID NO: 14572 - protein, 7 aa, Artificial Sequence
  Synthetic
RHIGESS

SEQ ID NO: 14573 - protein, 7 aa, Artificial Sequence
  Synthetic
SWDLRHS

SEQ ID NO: 14574 - protein, 7 aa, Artificial Sequence
  Synthetic
EYPAFSM

SEQ ID NO: 14575 - protein, 7 aa, Artificial Sequence
  Synthetic
SDAWNRV

SEQ ID NO: 14576 - protein, 7 aa, Artificial Sequence
  Synthetic
DRDAARW

SEQ ID NO: 14577 - protein, 7 aa, Artificial Sequence
  Synthetic
QAWAGST

SEQ ID NO: 14578 - protein, 7 aa, Artificial Sequence
  Synthetic
AWGGFGP

SEQ ID NO: 14579 - protein, 7 aa, Artificial Sequence
  Synthetic
GAVPGAW

SEQ ID NO: 14580 - protein, 7 aa, Artificial Sequence
  Synthetic
GYVPAAS

SEQ ID NO: 14581 - protein, 7 aa, Artificial Sequence
  Synthetic
DARNTWT

SEQ ID NO: 14582 - protein, 7 aa, Artificial Sequence
  Synthetic
LWAGNSS

SEQ ID NO: 14583 - protein, 7 aa, Artificial Sequence
  Synthetic
SWAQGSS

SEQ ID NO: 14584 - protein, 7 aa, Artificial Sequence
  Synthetic
ILSGFRD

SEQ ID NO: 14585 - protein, 7 aa, Artificial Sequence
  Synthetic
ESTRSMW

SEQ ID NO: 14586 - protein, 7 aa, Artificial Sequence
  Synthetic
DLLFGYA

SEQ ID NO: 14587 - protein, 7 aa, Artificial Sequence
  Synthetic
TVLRGST

SEQ ID NO: 14588 - protein, 7 aa, Artificial Sequence
  Synthetic
GANSGMW

SEQ ID NO: 14589 - protein, 7 aa, Artificial Sequence
  Synthetic
HNDYYRP

SEQ ID NO: 14590 - protein, 7 aa, Artificial Sequence
  Synthetic
HTQDGRW

SEQ ID NO: 14591 - protein, 7 aa, Artificial Sequence
  Synthetic
NQRYEGW

SEQ ID NO: 14592 - protein, 7 aa, Artificial Sequence
  Synthetic
RWTGESQ

SEQ ID NO: 14593 - protein, 7 aa, Artificial Sequence
  Synthetic
YRPLPEY

SEQ ID NO: 14594 - protein, 7 aa, Artificial Sequence
  Synthetic
GTEAGRW

SEQ ID NO: 14595 - protein, 7 aa, Artificial Sequence
  Synthetic
GEGSSRW

SEQ ID NO: 14596 - protein, 7 aa, Artificial Sequence
  Synthetic
SYPGESS

SEQ ID NO: 14597 - protein, 7 aa, Artificial Sequence
  Synthetic
LEPNSWK

SEQ ID NO: 14598 - protein, 7 aa, Artificial Sequence
  Synthetic
LNYNLSS

SEQ ID NO: 14599 - protein, 7 aa, Artificial Sequence
  Synthetic
SGLTRWD

SEQ ID NO: 14600 - protein, 7 aa, Artificial Sequence
  Synthetic
VHITQGW

SEQ ID NO: 14601 - protein, 7 aa, Artificial Sequence
  Synthetic
GIHTGMW

SEQ ID NO: 14602 - protein, 7 aa, Artificial Sequence
  Synthetic
VKLGTIY

SEQ ID NO: 14603 - protein, 7 aa, Artificial Sequence
  Synthetic
QGHFESW

SEQ ID NO: 14604 - protein, 7 aa, Artificial Sequence
  Synthetic
MIQLGSA

SEQ ID NO: 14605 - protein, 7 aa, Artificial Sequence
  Synthetic
THSGWAS

SEQ ID NO: 14606 - protein, 7 aa, Artificial Sequence
  Synthetic
REGWRVD

SEQ ID NO: 14607 - protein, 7 aa, Artificial Sequence
  Synthetic
DTNTGRW

SEQ ID NO: 14608 - protein, 7 aa, Artificial Sequence
  Synthetic
GFDSSRW

SEQ ID NO: 14609 - protein, 7 aa, Artificial Sequence
  Synthetic
WAKLFSA

SEQ ID NO: 14610 - protein, 7 aa, Artificial Sequence
  Synthetic
HLAGYAL

SEQ ID NO: 14611 - protein, 7 aa, Artificial Sequence
  Synthetic
MVSTQHW

SEQ ID NO: 14612 - protein, 7 aa, Artificial Sequence
  Synthetic
THYSGST

SEQ ID NO: 14613 - protein, 7 aa, Artificial Sequence
  Synthetic
GSRYDLS

SEQ ID NO: 14614 - protein, 7 aa, Artificial Sequence
  Synthetic
WALMGAA

SEQ ID NO: 14615 - protein, 7 aa, Artificial Sequence
  Synthetic
ERVHGSS

SEQ ID NO: 14616 - protein, 7 aa, Artificial Sequence
  Synthetic
LKPAWSS

SEQ ID NO: 14617 - protein, 7 aa, Artificial Sequence
  Synthetic
VGKPGVW

SEQ ID NO: 14618 - protein, 7 aa, Artificial Sequence
  Synthetic
WTPGAGF

SEQ ID NO: 14619 - protein, 7 aa, Artificial Sequence
  Synthetic
PNKWDIA

SEQ ID NO: 14620 - protein, 7 aa, Artificial Sequence
  Synthetic
EKAQWST

SEQ ID NO: 14621 - protein, 7 aa, Artificial Sequence
  Synthetic
VERGWSS

SEQ ID NO: 14622 - protein, 7 aa, Artificial Sequence
  Synthetic
YPPGLSS

SEQ ID NO: 14623 - protein, 7 aa, Artificial Sequence
  Synthetic
RFIGNSA

SEQ ID NO: 14624 - protein, 7 aa, Artificial Sequence
  Synthetic
GGLSRWD

SEQ ID NO: 14625 - protein, 7 aa, Artificial Sequence
  Synthetic
SGPGMSQ

SEQ ID NO: 14626 - protein, 7 aa, Artificial Sequence
  Synthetic
FYKLGSA

SEQ ID NO: 14627 - protein, 7 aa, Artificial Sequence
  Synthetic
NVLNGFR

SEQ ID NO: 14628 - protein, 7 aa, Artificial Sequence
  Synthetic
WVDLGSV

SEQ ID NO: 14629 - protein, 7 aa, Artificial Sequence
  Synthetic
IVPGFSV

SEQ ID NO: 14630 - protein, 7 aa, Artificial Sequence
  Synthetic
MRFNGSA

SEQ ID NO: 14631 - protein, 7 aa, Artificial Sequence
  Synthetic
YRELWSA

SEQ ID NO: 14632 - protein, 7 aa, Artificial Sequence
  Synthetic
SEGSSRW

SEQ ID NO: 14633 - protein, 7 aa, Artificial Sequence
  Synthetic
IRLGEAQ

SEQ ID NO: 14634 - protein, 7 aa, Artificial Sequence
  Synthetic
LHYSGSS

SEQ ID NO: 14635 - protein, 7 aa, Artificial Sequence
  Synthetic
FPVGWSA

SEQ ID NO: 14636 - protein, 7 aa, Artificial Sequence
  Synthetic
GFAGGST

SEQ ID NO: 14637 - protein, 7 aa, Artificial Sequence
  Synthetic
PDFRLPR

SEQ ID NO: 14638 - protein, 7 aa, Artificial Sequence
  Synthetic
RFPADRI

SEQ ID NO: 14639 - protein, 7 aa, Artificial Sequence
  Synthetic
GVYGSIY

SEQ ID NO: 14640 - protein, 7 aa, Artificial Sequence
  Synthetic
TMPQGIW

SEQ ID NO: 14641 - protein, 7 aa, Artificial Sequence
  Synthetic
FEPWFSS

SEQ ID NO: 14642 - protein, 7 aa, Artificial Sequence
  Synthetic
WHHSLSL

SEQ ID NO: 14643 - protein, 7 aa, Artificial Sequence
  Synthetic
WAEWGSA

SEQ ID NO: 14644 - protein, 7 aa, Artificial Sequence
  Synthetic
DAIGNRW

SEQ ID NO: 14645 - protein, 7 aa, Artificial Sequence
  Synthetic
TVAGFSS

SEQ ID NO: 14646 - protein, 7 aa, Artificial Sequence
  Synthetic
HPVFHSS

SEQ ID NO: 14647 - protein, 7 aa, Artificial Sequence
  Synthetic
EKWSGSS

SEQ ID NO: 14648 - protein, 7 aa, Artificial Sequence
  Synthetic
WPRYVDS

SEQ ID NO: 14649 - protein, 7 aa, Artificial Sequence
  Synthetic
GLDAARW

SEQ ID NO: 14650 - protein, 7 aa, Artificial Sequence
  Synthetic
VYYSGSS

SEQ ID NO: 14651 - protein, 7 aa, Artificial Sequence
  Synthetic
LFHGMSM

SEQ ID NO: 14652 - protein, 7 aa, Artificial Sequence
  Synthetic
DVKFGST

SEQ ID NO: 14653 - protein, 7 aa, Artificial Sequence
  Synthetic
VRGVEWV

SEQ ID NO: 14654 - protein, 7 aa, Artificial Sequence
  Synthetic
SSRGYSS

SEQ ID NO: 14655 - protein, 7 aa, Artificial Sequence
  Synthetic
HTGYGSS

SEQ ID NO: 14656 - protein, 7 aa, Artificial Sequence
  Synthetic
PARGSVY

SEQ ID NO: 14657 - protein, 7 aa, Artificial Sequence
  Synthetic
RWDRDAQ

SEQ ID NO: 14658 - protein, 7 aa, Artificial Sequence
  Synthetic
HLAGYTI

SEQ ID NO: 14659 - protein, 7 aa, Artificial Sequence
  Synthetic
DDYKWPV

SEQ ID NO: 14660 - protein, 7 aa, Artificial Sequence
  Synthetic
EQYKGST

SEQ ID NO: 14661 - protein, 7 aa, Artificial Sequence
  Synthetic
GERVGLW

SEQ ID NO: 14662 - protein, 7 aa, Artificial Sequence
  Synthetic
ILHGYAT

SEQ ID NO: 14663 - protein, 7 aa, Artificial Sequence
  Synthetic
AGANWSH

SEQ ID NO: 14664 - protein, 7 aa, Artificial Sequence
  Synthetic
SVYMGSS

SEQ ID NO: 14665 - protein, 7 aa, Artificial Sequence
  Synthetic
KDFPGPW

SEQ ID NO: 14666 - protein, 7 aa, Artificial Sequence
  Synthetic
WSKFSDG

SEQ ID NO: 14667 - protein, 7 aa, Artificial Sequence
  Synthetic
VTPVGIW

SEQ ID NO: 14668 - protein, 7 aa, Artificial Sequence
  Synthetic
RGTLGPY

SEQ ID NO: 14669 - protein, 7 aa, Artificial Sequence
  Synthetic
FEFRGSS

SEQ ID NO: 14670 - protein, 7 aa, Artificial Sequence
  Synthetic
AANESRW

SEQ ID NO: 14671 - protein, 7 aa, Artificial Sequence
  Synthetic
VPESVRW

SEQ ID NO: 14672 - protein, 7 aa, Artificial Sequence
  Synthetic
ENYRYPV

SEQ ID NO: 14673 - protein, 7 aa, Artificial Sequence
  Synthetic
FGVGFSS

SEQ ID NO: 14674 - protein, 7 aa, Artificial Sequence
  Synthetic
LGASSRF

SEQ ID NO: 14675 - protein, 7 aa, Artificial Sequence
  Synthetic
PTVHNQW

SEQ ID NO: 14676 - protein, 7 aa, Artificial Sequence
  Synthetic
WAVYGAA

SEQ ID NO: 14677 - protein, 7 aa, Artificial Sequence
  Synthetic
LYSLGSS

SEQ ID NO: 14678 - protein, 7 aa, Artificial Sequence
  Synthetic
LFEHGSV

SEQ ID NO: 14679 - protein, 7 aa, Artificial Sequence
  Synthetic
AGSPGVW

SEQ ID NO: 14680 - protein, 7 aa, Artificial Sequence
  Synthetic
SYYGGSA

SEQ ID NO: 14681 - protein, 7 aa, Artificial Sequence
  Synthetic
HMTQGSA

SEQ ID NO: 14682 - protein, 7 aa, Artificial Sequence
  Synthetic
EHEWALS

SEQ ID NO: 14683 - protein, 7 aa, Artificial Sequence
  Synthetic
PHAGFSS

SEQ ID NO: 14684 - protein, 7 aa, Artificial Sequence
  Synthetic
IKAGYSS

SEQ ID NO: 14685 - protein, 7 aa, Artificial Sequence
  Synthetic
EYYKLPT

SEQ ID NO: 14686 - protein, 7 aa, Artificial Sequence
  Synthetic
LMAGYSA

SEQ ID NO: 14687 - protein, 7 aa, Artificial Sequence
  Synthetic
PVNDHRW

SEQ ID NO: 14688 - protein, 7 aa, Artificial Sequence
  Synthetic
RYPGDPS

SEQ ID NO: 14689 - protein, 7 aa, Artificial Sequence
  Synthetic
QAPFYSQ

SEQ ID NO: 14690 - protein, 7 aa, Artificial Sequence
  Synthetic
YRPLPGL

SEQ ID NO: 14691 - protein, 7 aa, Artificial Sequence
  Synthetic
GAWHGSS

SEQ ID NO: 14692 - protein, 7 aa, Artificial Sequence
  Synthetic
ELPTARY

SEQ ID NO: 14693 - protein, 7 aa, Artificial Sequence
  Synthetic
ERLYASS

SEQ ID NO: 14694 - protein, 7 aa, Artificial Sequence
  Synthetic
IDFLKFE

SEQ ID NO: 14695 - protein, 7 aa, Artificial Sequence
  Synthetic
TAYGQAQ

SEQ ID NO: 14696 - protein, 7 aa, Artificial Sequence
  Synthetic
FTPWIDE

SEQ ID NO: 14697 - protein, 7 aa, Artificial Sequence
  Synthetic
RALGLSS

SEQ ID NO: 14698 - protein, 7 aa, Artificial Sequence
  Synthetic
RYSGDSV

SEQ ID NO: 14699 - protein, 7 aa, Artificial Sequence
  Synthetic
AQFYGSA

SEQ ID NO: 14700 - protein, 7 aa, Artificial Sequence
  Synthetic
MIYGSAQ

SEQ ID NO: 14701 - protein, 7 aa, Artificial Sequence
  Synthetic
PWAGNLA

SEQ ID NO: 14702 - protein, 7 aa, Artificial Sequence
  Synthetic
ARFGGST

SEQ ID NO: 14703 - protein, 7 aa, Artificial Sequence
  Synthetic
FRSGGAQ

SEQ ID NO: 14704 - protein, 7 aa, Artificial Sequence
  Synthetic
PRVNYSS

SEQ ID NO: 14705 - protein, 7 aa, Artificial Sequence
  Synthetic
NIIRLHN

SEQ ID NO: 14706 - protein, 7 aa, Artificial Sequence
  Synthetic
GTSPGPW

SEQ ID NO: 14707 - protein, 7 aa, Artificial Sequence
  Synthetic
GVLGNMW

SEQ ID NO: 14708 - protein, 7 aa, Artificial Sequence
  Synthetic
EWLGGAA

SEQ ID NO: 14709 - protein, 7 aa, Artificial Sequence
  Synthetic
QIPGFSA

SEQ ID NO: 14710 - protein, 7 aa, Artificial Sequence
  Synthetic
FVSLPHS

SEQ ID NO: 14711 - protein, 7 aa, Artificial Sequence
  Synthetic
WGSLSDL

SEQ ID NO: 14712 - protein, 7 aa, Artificial Sequence
  Synthetic
NWDLRDR

SEQ ID NO: 14713 - protein, 7 aa, Artificial Sequence
  Synthetic
VAGDGRW

SEQ ID NO: 14714 - protein, 7 aa, Artificial Sequence
  Synthetic
WQVLGAS

SEQ ID NO: 14715 - protein, 7 aa, Artificial Sequence
  Synthetic
LDHSGRW

SEQ ID NO: 14716 - protein, 7 aa, Artificial Sequence
  Synthetic
SLLTGYG

SEQ ID NO: 14717 - protein, 7 aa, Artificial Sequence
  Synthetic
DLHSPLW

SEQ ID NO: 14718 - protein, 7 aa, Artificial Sequence
  Synthetic
ERTNWAA

SEQ ID NO: 14719 - protein, 7 aa, Artificial Sequence
  Synthetic
EVSYGSS

SEQ ID NO: 14720 - protein, 7 aa, Artificial Sequence
  Synthetic
PTIVLKP

SEQ ID NO: 14721 - protein, 7 aa, Artificial Sequence
  Synthetic
EGRPGVW

SEQ ID NO: 14722 - protein, 7 aa, Artificial Sequence
  Synthetic
VVAWDRV

SEQ ID NO: 14723 - protein, 7 aa, Artificial Sequence
  Synthetic
IHWPQAS

SEQ ID NO: 14724 - protein, 7 aa, Artificial Sequence
  Synthetic
VLLRGYN

SEQ ID NO: 14725 - protein, 7 aa, Artificial Sequence
  Synthetic
LGPIRWD

SEQ ID NO: 14726 - protein, 7 aa, Artificial Sequence
  Synthetic
PSGNWAY

SEQ ID NO: 14727 - protein, 7 aa, Artificial Sequence
  Synthetic
IPKFWSD

SEQ ID NO: 14728 - protein, 7 aa, Artificial Sequence
  Synthetic
EWPGGAS

SEQ ID NO: 14729 - protein, 7 aa, Artificial Sequence
  Synthetic
MVVMGSA

SEQ ID NO: 14730 - protein, 7 aa, Artificial Sequence
  Synthetic
PYEPGRW

SEQ ID NO: 14731 - protein, 7 aa, Artificial Sequence
  Synthetic
RYAGEAA

SEQ ID NO: 14732 - protein, 7 aa, Artificial Sequence
  Synthetic
FIRLGAA

SEQ ID NO: 14733 - protein, 7 aa, Artificial Sequence
  Synthetic
LIRGYSS

SEQ ID NO: 14734 - protein, 7 aa, Artificial Sequence
  Synthetic
PSGHGSW

SEQ ID NO: 14735 - protein, 7 aa, Artificial Sequence
  Synthetic
RGLGLSS

SEQ ID NO: 14736 - protein, 7 aa, Artificial Sequence
  Synthetic
VWHAGSS

SEQ ID NO: 14737 - protein, 7 aa, Artificial Sequence
  Synthetic
TVYGGST

SEQ ID NO: 14738 - protein, 7 aa, Artificial Sequence
  Synthetic
TLRYEAS

SEQ ID NO: 14739 - protein, 7 aa, Artificial Sequence
  Synthetic
PKNNGVW

SEQ ID NO: 14740 - protein, 7 aa, Artificial Sequence
  Synthetic
HITHGAS

SEQ ID NO: 14741 - protein, 7 aa, Artificial Sequence
  Synthetic
WGVLDKV

SEQ ID NO: 14742 - protein, 7 aa, Artificial Sequence
  Synthetic
SRSGMPV

SEQ ID NO: 14743 - protein, 7 aa, Artificial Sequence
  Synthetic
EKSGYSS

SEQ ID NO: 14744 - protein, 7 aa, Artificial Sequence
  Synthetic
WKLAGSQ

SEQ ID NO: 14745 - protein, 7 aa, Artificial Sequence
  Synthetic
EMPGFSA

SEQ ID NO: 14746 - protein, 7 aa, Artificial Sequence
  Synthetic
QFHLGSA

SEQ ID NO: 14747 - protein, 7 aa, Artificial Sequence
  Synthetic
MGPGGYW

SEQ ID NO: 14748 - protein, 7 aa, Artificial Sequence
  Synthetic
LIQFQSS

SEQ ID NO: 14749 - protein, 7 aa, Artificial Sequence
  Synthetic
DYPAQSS

SEQ ID NO: 14750 - protein, 7 aa, Artificial Sequence
  Synthetic
WSVGGGH

SEQ ID NO: 14751 - protein, 7 aa, Artificial Sequence
  Synthetic
HYTGHSS

SEQ ID NO: 14752 - protein, 7 aa, Artificial Sequence
  Synthetic
QGYNSSF

SEQ ID NO: 14753 - protein, 7 aa, Artificial Sequence
  Synthetic
RPYHVDT

SEQ ID NO: 14754 - protein, 7 aa, Artificial Sequence
  Synthetic
LRYMLSD

SEQ ID NO: 14755 - protein, 7 aa, Artificial Sequence
  Synthetic
SREYGSS

SEQ ID NO: 14756 - protein, 7 aa, Artificial Sequence
  Synthetic
PKVGFSA

SEQ ID NO: 14757 - protein, 7 aa, Artificial Sequence
  Synthetic
VPGLGFR

SEQ ID NO: 14758 - protein, 7 aa, Artificial Sequence
  Synthetic
RPLRIDV

SEQ ID NO: 14759 - protein, 7 aa, Artificial Sequence
  Synthetic
LSYSHTL

SEQ ID NO: 14760 - protein, 7 aa, Artificial Sequence
  Synthetic
GVHSGQW

SEQ ID NO: 14761 - protein, 7 aa, Artificial Sequence
  Synthetic
PWAGMSS

SEQ ID NO: 14762 - protein, 7 aa, Artificial Sequence
  Synthetic
NYRVGVI

SEQ ID NO: 14763 - protein, 7 aa, Artificial Sequence
  Synthetic
WGSPVHT

SEQ ID NO: 14764 - protein, 7 aa, Artificial Sequence
  Synthetic
FTVGSIY

SEQ ID NO: 14765 - protein, 7 aa, Artificial Sequence
  Synthetic
LLDTNYW

SEQ ID NO: 14766 - protein, 7 aa, Artificial Sequence
  Synthetic
RYVGDNT

SEQ ID NO: 14767 - protein, 7 aa, Artificial Sequence
  Synthetic
TMYGGST

SEQ ID NO: 14768 - protein, 7 aa, Artificial Sequence
  Synthetic
VQAWDRV

SEQ ID NO: 14769 - protein, 7 aa, Artificial Sequence
  Synthetic
HIGFGSA

SEQ ID NO: 14770 - protein, 7 aa, Artificial Sequence
  Synthetic
ERYHVGV

SEQ ID NO: 14771 - protein, 7 aa, Artificial Sequence
  Synthetic
ARSGFSS

SEQ ID NO: 14772 - protein, 7 aa, Artificial Sequence
  Synthetic
VVSHGSS

SEQ ID NO: 14773 - protein, 7 aa, Artificial Sequence
  Synthetic
LLHYGSS

SEQ ID NO: 14774 - protein, 7 aa, Artificial Sequence
  Synthetic
AYHGAAA

SEQ ID NO: 14775 - protein, 7 aa, Artificial Sequence
  Synthetic
MVHGFSS

SEQ ID NO: 14776 - protein, 7 aa, Artificial Sequence
  Synthetic
LYPSYSS

SEQ ID NO: 14777 - protein, 7 aa, Artificial Sequence
  Synthetic
MVTHGFS

SEQ ID NO: 14778 - protein, 7 aa, Artificial Sequence
  Synthetic
DRLRGSA

SEQ ID NO: 14779 - protein, 7 aa, Artificial Sequence
  Synthetic
HMKLGST

SEQ ID NO: 14780 - protein, 7 aa, Artificial Sequence
  Synthetic
DPMWNRA

SEQ ID NO: 14781 - protein, 7 aa, Artificial Sequence
  Synthetic
ARVALVN

SEQ ID NO: 14782 - protein, 7 aa, Artificial Sequence
  Synthetic
PYPMMSS

SEQ ID NO: 14783 - protein, 7 aa, Artificial Sequence
  Synthetic
VNVSHFH

SEQ ID NO: 14784 - protein, 7 aa, Artificial Sequence
  Synthetic
YGVLNRL

SEQ ID NO: 14785 - protein, 7 aa, Artificial Sequence
  Synthetic
AAGEVRW

SEQ ID NO: 14786 - protein, 7 aa, Artificial Sequence
  Synthetic
MNFGLAQ

SEQ ID NO: 14787 - protein, 7 aa, Artificial Sequence
  Synthetic
EPVTNRW

SEQ ID NO: 14788 - protein, 7 aa, Artificial Sequence
  Synthetic
LWNMGSS

SEQ ID NO: 14789 - protein, 7 aa, Artificial Sequence
  Synthetic
LYGGYAQ

SEQ ID NO: 14790 - protein, 7 aa, Artificial Sequence
  Synthetic
AWAGSAS

SEQ ID NO: 14791 - protein, 7 aa, Artificial Sequence
  Synthetic
GSDVGVW

SEQ ID NO: 14792 - protein, 7 aa, Artificial Sequence
  Synthetic
AYHMGAA

SEQ ID NO: 14793 - protein, 7 aa, Artificial Sequence
  Synthetic
WMKGYSM

SEQ ID NO: 14794 - protein, 7 aa, Artificial Sequence
  Synthetic
SLYLGST

SEQ ID NO: 14795 - protein, 7 aa, Artificial Sequence
  Synthetic
TTNDGRW

SEQ ID NO: 14796 - protein, 7 aa, Artificial Sequence
  Synthetic
LHIGAAQ

SEQ ID NO: 14797 - protein, 7 aa, Artificial Sequence
  Synthetic
PWVPASS

SEQ ID NO: 14798 - protein, 7 aa, Artificial Sequence
  Synthetic
LDYGMAQ

SEQ ID NO: 14799 - protein, 7 aa, Artificial Sequence
  Synthetic
ERTGWSV

SEQ ID NO: 14800 - protein, 7 aa, Artificial Sequence
  Synthetic
MFGYGSS

SEQ ID NO: 14801 - protein, 7 aa, Artificial Sequence
  Synthetic
MKFSGST

SEQ ID NO: 14802 - protein, 7 aa, Artificial Sequence
  Synthetic
VFIGSST

SEQ ID NO: 14803 - protein, 7 aa, Artificial Sequence
  Synthetic
GASPGLW

SEQ ID NO: 14804 - protein, 7 aa, Artificial Sequence
  Synthetic
GPTWTSS

SEQ ID NO: 14805 - protein, 7 aa, Artificial Sequence
  Synthetic
WSLHGSS

SEQ ID NO: 14806 - protein, 7 aa, Artificial Sequence
  Synthetic
GSDSGRW

SEQ ID NO: 14807 - protein, 7 aa, Artificial Sequence
  Synthetic
WAVGRAG

SEQ ID NO: 14808 - protein, 7 aa, Artificial Sequence
  Synthetic
RQVADRA

SEQ ID NO: 14809 - protein, 7 aa, Artificial Sequence
  Synthetic
LITGGFR

SEQ ID NO: 14810 - protein, 7 aa, Artificial Sequence
  Synthetic
TLNPGRW

SEQ ID NO: 14811 - protein, 7 aa, Artificial Sequence
  Synthetic
AGDSKNE

SEQ ID NO: 14812 - protein, 7 aa, Artificial Sequence
  Synthetic
FETSRWA

SEQ ID NO: 14813 - protein, 7 aa, Artificial Sequence
  Synthetic
LVGSGKW

SEQ ID NO: 14814 - protein, 7 aa, Artificial Sequence
  Synthetic
DWGRVGI

SEQ ID NO: 14815 - protein, 7 aa, Artificial Sequence
  Synthetic
FEPIGRW

SEQ ID NO: 14816 - protein, 7 aa, Artificial Sequence
  Synthetic
YDVGLGW

SEQ ID NO: 14817 - protein, 7 aa, Artificial Sequence
  Synthetic
TARMGSA

SEQ ID NO: 14818 - protein, 7 aa, Artificial Sequence
  Synthetic
PIPRSIG

SEQ ID NO: 14819 - protein, 7 aa, Artificial Sequence
  Synthetic
VGYSSSL

SEQ ID NO: 14820 - protein, 7 aa, Artificial Sequence
  Synthetic
VRVYESS

SEQ ID NO: 14821 - protein, 7 aa, Artificial Sequence
  Synthetic
LVVGSVY

SEQ ID NO: 14822 - protein, 7 aa, Artificial Sequence
  Synthetic
ERLQGWA

SEQ ID NO: 14823 - protein, 7 aa, Artificial Sequence
  Synthetic
RRLGDSS

SEQ ID NO: 14824 - protein, 7 aa, Artificial Sequence
  Synthetic
CYPVGIC

SEQ ID NO: 14825 - protein, 7 aa, Artificial Sequence
  Synthetic
AGTPGPW

SEQ ID NO: 14826 - protein, 7 aa, Artificial Sequence
  Synthetic
LYLGSAS

SEQ ID NO: 14827 - protein, 7 aa, Artificial Sequence
  Synthetic
RVYSGSA

SEQ ID NO: 14828 - protein, 7 aa, Artificial Sequence
  Synthetic
ARLGYST

SEQ ID NO: 14829 - protein, 7 aa, Artificial Sequence
  Synthetic
DGRPGLW

SEQ ID NO: 14830 - protein, 7 aa, Artificial Sequence
  Synthetic
SKAGYSA

SEQ ID NO: 14831 - protein, 7 aa, Artificial Sequence
  Synthetic
WKSGFSS

SEQ ID NO: 14832 - protein, 7 aa, Artificial Sequence
  Synthetic
VPGEVRW

SEQ ID NO: 14833 - protein, 7 aa, Artificial Sequence
  Synthetic
NQSLFSS

SEQ ID NO: 14834 - protein, 7 aa, Artificial Sequence
  Synthetic
QHTAQTW

SEQ ID NO: 14835 - protein, 7 aa, Artificial Sequence
  Synthetic
LLPRWST

SEQ ID NO: 14836 - protein, 7 aa, Artificial Sequence
  Synthetic
LTYGGAQ

SEQ ID NO: 14837 - protein, 7 aa, Artificial Sequence
  Synthetic
LVVRGST

SEQ ID NO: 14838 - protein, 7 aa, Artificial Sequence
  Synthetic
ERPLFSA

SEQ ID NO: 14839 - protein, 7 aa, Artificial Sequence
  Synthetic
EILGRGW

SEQ ID NO: 14840 - protein, 7 aa, Artificial Sequence
  Synthetic
SRPMYSA

SEQ ID NO: 14841 - protein, 7 aa, Artificial Sequence
  Synthetic
KFYGDAS

SEQ ID NO: 14842 - protein, 7 aa, Artificial Sequence
  Synthetic
LLHGYSV

SEQ ID NO: 14843 - protein, 7 aa, Artificial Sequence
  Synthetic
PQRGSVY

SEQ ID NO: 14844 - protein, 7 aa, Artificial Sequence
  Synthetic
DRTMGYY

SEQ ID NO: 14845 - protein, 7 aa, Artificial Sequence
  Synthetic
QFYSGAA

SEQ ID NO: 14846 - protein, 7 aa, Artificial Sequence
  Synthetic
TVFKGSS

SEQ ID NO: 14847 - protein, 7 aa, Artificial Sequence
  Synthetic
NDATARY

SEQ ID NO: 14848 - protein, 7 aa, Artificial Sequence
  Synthetic
PREVHGW

SEQ ID NO: 14849 - protein, 7 aa, Artificial Sequence
  Synthetic
WETHGSS

SEQ ID NO: 14850 - protein, 7 aa, Artificial Sequence
  Synthetic
RYLADAS

SEQ ID NO: 14851 - protein, 7 aa, Artificial Sequence
  Synthetic
AYPGYSS

SEQ ID NO: 14852 - protein, 7 aa, Artificial Sequence
  Synthetic
MRETWAS

SEQ ID NO: 14853 - protein, 7 aa, Artificial Sequence
  Synthetic
FLPFGSS

SEQ ID NO: 14854 - protein, 7 aa, Artificial Sequence
  Synthetic
RYAHDSM

SEQ ID NO: 14855 - protein, 7 aa, Artificial Sequence
  Synthetic
IATGYSS

SEQ ID NO: 14856 - protein, 7 aa, Artificial Sequence
  Synthetic
EDTRRYF

SEQ ID NO: 14857 - protein, 7 aa, Artificial Sequence
  Synthetic
SEKWTAS

SEQ ID NO: 14858 - protein, 7 aa, Artificial Sequence
  Synthetic
TSTHGST

SEQ ID NO: 14859 - protein, 7 aa, Artificial Sequence
  Synthetic
PTDYSAW

SEQ ID NO: 14860 - protein, 7 aa, Artificial Sequence
  Synthetic
MSAGSIY

SEQ ID NO: 14861 - protein, 7 aa, Artificial Sequence
  Synthetic
PVRGFSA

SEQ ID NO: 14862 - protein, 7 aa, Artificial Sequence
  Synthetic
WTMELGY

SEQ ID NO: 14863 - protein, 7 aa, Artificial Sequence
  Synthetic
PAWGSVA

SEQ ID NO: 14864 - protein, 7 aa, Artificial Sequence
  Synthetic
MRVGTVY

SEQ ID NO: 14865 - protein, 7 aa, Artificial Sequence
  Synthetic
AMGREWT

SEQ ID NO: 14866 - protein, 7 aa, Artificial Sequence
  Synthetic
FAAHWSS

SEQ ID NO: 14867 - protein, 7 aa, Artificial Sequence
  Synthetic
RHGTEWA

SEQ ID NO: 14868 - protein, 7 aa, Artificial Sequence
  Synthetic
GNVLERW

SEQ ID NO: 14869 - protein, 7 aa, Artificial Sequence
  Synthetic
DPRWMSG

SEQ ID NO: 14870 - protein, 7 aa, Artificial Sequence
  Synthetic
FILHGAA

SEQ ID NO: 14871 - protein, 7 aa, Artificial Sequence
  Synthetic
PTVNFSA

SEQ ID NO: 14872 - protein, 7 aa, Artificial Sequence
  Synthetic
RAVGNSW

SEQ ID NO: 14873 - protein, 7 aa, Artificial Sequence
  Synthetic
AWPGGSS

SEQ ID NO: 14874 - protein, 7 aa, Artificial Sequence
  Synthetic
GPEWNRP

SEQ ID NO: 14875 - protein, 7 aa, Artificial Sequence
  Synthetic
WRDQGSQ

SEQ ID NO: 14876 - protein, 7 aa, Artificial Sequence
  Synthetic
WGLNMGY

SEQ ID NO: 14877 - protein, 7 aa, Artificial Sequence
  Synthetic
LVPGWSV

SEQ ID NO: 14878 - protein, 7 aa, Artificial Sequence
  Synthetic
WSVYSSN

SEQ ID NO: 14879 - protein, 7 aa, Artificial Sequence
  Synthetic
EILKSFA

SEQ ID NO: 14880 - protein, 7 aa, Artificial Sequence
  Synthetic
PAVGFSA

SEQ ID NO: 14881 - protein, 7 aa, Artificial Sequence
  Synthetic
NTNEYRW

SEQ ID NO: 14882 - protein, 7 aa, Artificial Sequence
  Synthetic
GYLPRPG

SEQ ID NO: 14883 - protein, 7 aa, Artificial Sequence
  Synthetic
LGLGFSV

SEQ ID NO: 14884 - protein, 7 aa, Artificial Sequence
  Synthetic
TENAGRW

SEQ ID NO: 14885 - protein, 7 aa, Artificial Sequence
  Synthetic
FRILGAA

SEQ ID NO: 14886 - protein, 7 aa, Artificial Sequence
  Synthetic
CGRACWE

SEQ ID NO: 14887 - protein, 7 aa, Artificial Sequence
  Synthetic
QWPSGST

SEQ ID NO: 14888 - protein, 7 aa, Artificial Sequence
  Synthetic
WHHGGAQ

SEQ ID NO: 14889 - protein, 7 aa, Artificial Sequence
  Synthetic
LLSGYSI

SEQ ID NO: 14890 - protein, 7 aa, Artificial Sequence
  Synthetic
LCVPCSS

SEQ ID NO: 14891 - protein, 7 aa, Artificial Sequence
  Synthetic
WVVGGAQ

SEQ ID NO: 14892 - protein, 7 aa, Artificial Sequence
  Synthetic
ISVGWSS

SEQ ID NO: 14893 - protein, 7 aa, Artificial Sequence
  Synthetic
APDDNRW

SEQ ID NO: 14894 - protein, 7 aa, Artificial Sequence
  Synthetic
GYGEVRW

SEQ ID NO: 14895 - protein, 7 aa, Artificial Sequence
  Synthetic
VMLGSVY

SEQ ID NO: 14896 - protein, 7 aa, Artificial Sequence
  Synthetic
VGHGFSQ

SEQ ID NO: 14897 - protein, 7 aa, Artificial Sequence
  Synthetic
DRWVGSV

SEQ ID NO: 14898 - protein, 7 aa, Artificial Sequence
  Synthetic
LFPGASM

SEQ ID NO: 14899 - protein, 7 aa, Artificial Sequence
  Synthetic
LMPGWAH

SEQ ID NO: 14900 - protein, 7 aa, Artificial Sequence
  Synthetic
SRVGYST

SEQ ID NO: 14901 - protein, 7 aa, Artificial Sequence
  Synthetic
MRQMGSV

SEQ ID NO: 14902 - protein, 7 aa, Artificial Sequence
  Synthetic
FIPLGST

SEQ ID NO: 14903 - protein, 7 aa, Artificial Sequence
  Synthetic
GRIILMP

SEQ ID NO: 14904 - protein, 7 aa, Artificial Sequence
  Synthetic
DIEWLAS

SEQ ID NO: 14905 - protein, 7 aa, Artificial Sequence
  Synthetic
DEPRSWT

SEQ ID NO: 14906 - protein, 7 aa, Artificial Sequence
  Synthetic
DRTFGSA

SEQ ID NO: 14907 - protein, 7 aa, Artificial Sequence
  Synthetic
TRIHGSA

SEQ ID NO: 14908 - protein, 7 aa, Artificial Sequence
  Synthetic
LVRFESS

SEQ ID NO: 14909 - protein, 7 aa, Artificial Sequence
  Synthetic
TRVVLIN

SEQ ID NO: 14910 - protein, 7 aa, Artificial Sequence
  Synthetic
EEPVGRW

SEQ ID NO: 14911 - protein, 7 aa, Artificial Sequence
  Synthetic
VAVYMSS

SEQ ID NO: 14912 - protein, 7 aa, Artificial Sequence
  Synthetic
GSNVGVW

SEQ ID NO: 14913 - protein, 7 aa, Artificial Sequence
  Synthetic
EDGSGRW

SEQ ID NO: 14914 - protein, 7 aa, Artificial Sequence
  Synthetic
NVDSQWY

SEQ ID NO: 14915 - protein, 7 aa, Artificial Sequence
  Synthetic
PDGVVRW

SEQ ID NO: 14916 - protein, 7 aa, Artificial Sequence
  Synthetic
PPYVLGE

SEQ ID NO: 14917 - protein, 7 aa, Artificial Sequence
  Synthetic
PVLRLLN

SEQ ID NO: 14918 - protein, 7 aa, Artificial Sequence
  Synthetic
FIRMGSA

SEQ ID NO: 14919 - protein, 7 aa, Artificial Sequence
  Synthetic
EIWAGSV

SEQ ID NO: 14920 - protein, 7 aa, Artificial Sequence
  Synthetic
EPGSGRW

SEQ ID NO: 14921 - protein, 7 aa, Artificial Sequence
  Synthetic
DLNSSRW

SEQ ID NO: 14922 - protein, 7 aa, Artificial Sequence
  Synthetic
LAPYLSS

SEQ ID NO: 14923 - protein, 7 aa, Artificial Sequence
  Synthetic
LTPYDRI

SEQ ID NO: 14924 - protein, 7 aa, Artificial Sequence
  Synthetic
RENVGVW

SEQ ID NO: 14925 - protein, 7 aa, Artificial Sequence
  Synthetic
RWPADLA

SEQ ID NO: 14926 - protein, 7 aa, Artificial Sequence
  Synthetic
PIGVGSW

SEQ ID NO: 14927 - protein, 7 aa, Artificial Sequence
  Synthetic
GIWISSP

SEQ ID NO: 14928 - protein, 7 aa, Artificial Sequence
  Synthetic
EDGWRAD

SEQ ID NO: 14929 - protein, 7 aa, Artificial Sequence
  Synthetic
WGTLNVL

SEQ ID NO: 14930 - protein, 7 aa, Artificial Sequence
  Synthetic
RFASDSS

SEQ ID NO: 14931 - protein, 7 aa, Artificial Sequence
  Synthetic
SGSDGRW

SEQ ID NO: 14932 - protein, 7 aa, Artificial Sequence
  Synthetic
IADWYRA

SEQ ID NO: 14933 - protein, 7 aa, Artificial Sequence
  Synthetic
RGAGLSS

SEQ ID NO: 14934 - protein, 7 aa, Artificial Sequence
  Synthetic
GDNVGRW

SEQ ID NO: 14935 - protein, 7 aa, Artificial Sequence
  Synthetic
TAAYGSS

SEQ ID NO: 14936 - protein, 7 aa, Artificial Sequence
  Synthetic
LLSHGSS

SEQ ID NO: 14937 - protein, 7 aa, Artificial Sequence
  Synthetic
EKHLYST

SEQ ID NO: 14938 - protein, 7 aa, Artificial Sequence
  Synthetic
ERFNLSS

SEQ ID NO: 14939 - protein, 7 aa, Artificial Sequence
  Synthetic
EAWKHPV

SEQ ID NO: 14940 - protein, 7 aa, Artificial Sequence
  Synthetic
VYYTGSS

SEQ ID NO: 14941 - protein, 7 aa, Artificial Sequence
  Synthetic
GRWEVFE

SEQ ID NO: 14942 - protein, 7 aa, Artificial Sequence
  Synthetic
EYYTGST

SEQ ID NO: 14943 - protein, 7 aa, Artificial Sequence
  Synthetic
LFHGGAA

SEQ ID NO: 14944 - protein, 7 aa, Artificial Sequence
  Synthetic
MWTAGST

SEQ ID NO: 14945 - protein, 7 aa, Artificial Sequence
  Synthetic
RYAGESA

SEQ ID NO: 14946 - protein, 7 aa, Artificial Sequence
  Synthetic
YGSLSAL

SEQ ID NO: 14947 - protein, 7 aa, Artificial Sequence
  Synthetic
HVRLGSS

SEQ ID NO: 14948 - protein, 7 aa, Artificial Sequence
  Synthetic
DATGQYW

SEQ ID NO: 14949 - protein, 7 aa, Artificial Sequence
  Synthetic
HPYALGV

SEQ ID NO: 14950 - protein, 7 aa, Artificial Sequence
  Synthetic
SVAGYSQ

SEQ ID NO: 14951 - protein, 7 aa, Artificial Sequence
  Synthetic
LLYGGST

SEQ ID NO: 14952 - protein, 7 aa, Artificial Sequence
  Synthetic
DNHAGRW

SEQ ID NO: 14953 - protein, 7 aa, Artificial Sequence
  Synthetic
DPSWSSA

SEQ ID NO: 14954 - protein, 7 aa, Artificial Sequence
  Synthetic
ELPGWSV

SEQ ID NO: 14955 - protein, 7 aa, Artificial Sequence
  Synthetic
WVDLPSV

SEQ ID NO: 14956 - protein, 7 aa, Artificial Sequence
  Synthetic
LGYTFAD

SEQ ID NO: 14957 - protein, 7 aa, Artificial Sequence
  Synthetic
VQPVWSS

SEQ ID NO: 14958 - protein, 7 aa, Artificial Sequence
  Synthetic
QVSSQHW

SEQ ID NO: 14959 - protein, 7 aa, Artificial Sequence
  Synthetic
AWGSLGV

SEQ ID NO: 14960 - protein, 7 aa, Artificial Sequence
  Synthetic
GINAGVW

SEQ ID NO: 14961 - protein, 7 aa, Artificial Sequence
  Synthetic
ANYMGSM

SEQ ID NO: 14962 - protein, 7 aa, Artificial Sequence
  Synthetic
DRWQGAV

SEQ ID NO: 14963 - protein, 7 aa, Artificial Sequence
  Synthetic
ERDSGRW

SEQ ID NO: 14964 - protein, 7 aa, Artificial Sequence
  Synthetic
LSPGMSQ

SEQ ID NO: 14965 - protein, 7 aa, Artificial Sequence
  Synthetic
HLNFYSD

SEQ ID NO: 14966 - protein, 7 aa, Artificial Sequence
  Synthetic
RSPGYSQ

SEQ ID NO: 14967 - protein, 7 aa, Artificial Sequence
  Synthetic
WGTYTSL

SEQ ID NO: 14968 - protein, 7 aa, Artificial Sequence
  Synthetic
AREWGSA

SEQ ID NO: 14969 - protein, 7 aa, Artificial Sequence
  Synthetic
LETYGSS

SEQ ID NO: 14970 - protein, 7 aa, Artificial Sequence
  Synthetic
CYPAGEC

SEQ ID NO: 14971 - protein, 7 aa, Artificial Sequence
  Synthetic
TRTGMAQ

SEQ ID NO: 14972 - protein, 7 aa, Artificial Sequence
  Synthetic
ASLGTVY

SEQ ID NO: 14973 - protein, 7 aa, Artificial Sequence
  Synthetic
RAYSLEV

SEQ ID NO: 14974 - protein, 7 aa, Artificial Sequence
  Synthetic
WSTFSVG

SEQ ID NO: 14975 - protein, 7 aa, Artificial Sequence
  Synthetic
FIYSGSS

SEQ ID NO: 14976 - protein, 7 aa, Artificial Sequence
  Synthetic
WGSPPHA

SEQ ID NO: 14977 - protein, 7 aa, Artificial Sequence
  Synthetic
GKQLGAW

SEQ ID NO: 14978 - protein, 7 aa, Artificial Sequence
  Synthetic
GPGESRW

SEQ ID NO: 14979 - protein, 7 aa, Artificial Sequence
  Synthetic
TLYMGSS

SEQ ID NO: 14980 - protein, 7 aa, Artificial Sequence
  Synthetic
LGYTFQA

SEQ ID NO: 14981 - protein, 7 aa, Artificial Sequence
  Synthetic
DRVGYGY

SEQ ID NO: 14982 - protein, 7 aa, Artificial Sequence
  Synthetic
LWGSTGA

SEQ ID NO: 14983 - protein, 7 aa, Artificial Sequence
  Synthetic
MLPNWSQ

SEQ ID NO: 14984 - protein, 7 aa, Artificial Sequence
  Synthetic
FIPGFSQ

SEQ ID NO: 14985 - protein, 7 aa, Artificial Sequence
  Synthetic
LFGGYST

SEQ ID NO: 14986 - protein, 7 aa, Artificial Sequence
  Synthetic
WHSLTTA

SEQ ID NO: 14987 - protein, 7 aa, Artificial Sequence
  Synthetic
MINEGRW

SEQ ID NO: 14988 - protein, 7 aa, Artificial Sequence
  Synthetic
LVIGQGW

SEQ ID NO: 14989 - protein, 7 aa, Artificial Sequence
  Synthetic
WVLEQGY

SEQ ID NO: 14990 - protein, 7 aa, Artificial Sequence
  Synthetic
LIGRLMG

SEQ ID NO: 14991 - protein, 7 aa, Artificial Sequence
  Synthetic
VGVGTIY

SEQ ID NO: 14992 - protein, 7 aa, Artificial Sequence
  Synthetic
WREYPER

SEQ ID NO: 14993 - protein, 7 aa, Artificial Sequence
  Synthetic
VDLSARY

SEQ ID NO: 14994 - protein, 7 aa, Artificial Sequence
  Synthetic
VDYRMAY

SEQ ID NO: 14995 - protein, 7 aa, Artificial Sequence
  Synthetic
LRWEGAT

SEQ ID NO: 14996 - protein, 7 aa, Artificial Sequence
  Synthetic
GIDSARF

SEQ ID NO: 14997 - protein, 7 aa, Artificial Sequence
  Synthetic
PPYGSFD

SEQ ID NO: 14998 - protein, 7 aa, Artificial Sequence
  Synthetic
AEVGRVY

SEQ ID NO: 14999 - protein, 7 aa, Artificial Sequence
  Synthetic
WMLGGST

SEQ ID NO: 15000 - protein, 7 aa, Artificial Sequence
  Synthetic
LVPGMSS

SEQ ID NO: 15001 - protein, 7 aa, Artificial Sequence
  Synthetic
VTDRVLW

SEQ ID NO: 15002 - protein, 7 aa, Artificial Sequence
  Synthetic
KVPYALA

SEQ ID NO: 15003 - protein, 7 aa, Artificial Sequence
  Synthetic
FYYGGSS

SEQ ID NO: 15004 - protein, 7 aa, Artificial Sequence
  Synthetic
DFTRGST

SEQ ID NO: 15005 - protein, 7 aa, Artificial Sequence
  Synthetic
DWARGAA

SEQ ID NO: 15006 - protein, 7 aa, Artificial Sequence
  Synthetic
YQHLGSY

SEQ ID NO: 15007 - protein, 7 aa, Artificial Sequence
  Synthetic
DRHYGAS

SEQ ID NO: 15008 - protein, 7 aa, Artificial Sequence
  Synthetic
PSLGGHW

SEQ ID NO: 15009 - protein, 7 aa, Artificial Sequence
  Synthetic
DVPGLRW

SEQ ID NO: 15010 - protein, 7 aa, Artificial Sequence
  Synthetic
LYAGRSQ

SEQ ID NO: 15011 - protein, 7 aa, Artificial Sequence
  Synthetic
WGSLAQM

SEQ ID NO: 15012 - protein, 7 aa, Artificial Sequence
  Synthetic
VRDGWSS

SEQ ID NO: 15013 - protein, 7 aa, Artificial Sequence
  Synthetic
HVGDGRW

SEQ ID NO: 15014 - protein, 7 aa, Artificial Sequence
  Synthetic
VRVGQAQ

SEQ ID NO: 15015 - protein, 7 aa, Artificial Sequence
  Synthetic
PYPGYAS

SEQ ID NO: 15016 - protein, 7 aa, Artificial Sequence
  Synthetic
TEYRGAT

SEQ ID NO: 15017 - protein, 7 aa, Artificial Sequence
  Synthetic
WGMLASG

SEQ ID NO: 15018 - protein, 7 aa, Artificial Sequence
  Synthetic
TKAYEAS

SEQ ID NO: 15019 - protein, 7 aa, Artificial Sequence
  Synthetic
QGDSRWN

SEQ ID NO: 15020 - protein, 7 aa, Artificial Sequence
  Synthetic
RVGYDYM

SEQ ID NO: 15021 - protein, 7 aa, Artificial Sequence
  Synthetic
RVIGEAQ

SEQ ID NO: 15022 - protein, 7 aa, Artificial Sequence
  Synthetic
QHWAGSS

SEQ ID NO: 15023 - protein, 7 aa, Artificial Sequence
  Synthetic
REWSVGL

SEQ ID NO: 15024 - protein, 7 aa, Artificial Sequence
  Synthetic
FDERYWA

SEQ ID NO: 15025 - protein, 7 aa, Artificial Sequence
  Synthetic
MDRGFSS

SEQ ID NO: 15026 - protein, 7 aa, Artificial Sequence
  Synthetic
QAANWAS

SEQ ID NO: 15027 - protein, 7 aa, Artificial Sequence
  Synthetic
LVGRLMG

SEQ ID NO: 15028 - protein, 7 aa, Artificial Sequence
  Synthetic
WVYPDGG

SEQ ID NO: 15029 - protein, 7 aa, Artificial Sequence
  Synthetic
LWSGDRS

SEQ ID NO: 15030 - protein, 7 aa, Artificial Sequence
  Synthetic
MYSLGGP

SEQ ID NO: 15031 - protein, 7 aa, Artificial Sequence
  Synthetic
LSIGWSQ

SEQ ID NO: 15032 - protein, 7 aa, Artificial Sequence
  Synthetic
ESPGYRW

SEQ ID NO: 15033 - protein, 7 aa, Artificial Sequence
  Synthetic
GIDHARF

SEQ ID NO: 15034 - protein, 7 aa, Artificial Sequence
  Synthetic
IQWAGST

SEQ ID NO: 15035 - protein, 7 aa, Artificial Sequence
  Synthetic
WRPSDGY

SEQ ID NO: 15036 - protein, 7 aa, Artificial Sequence
  Synthetic
RGPGLSM

SEQ ID NO: 15037 - protein, 7 aa, Artificial Sequence
  Synthetic
SRLLMSS

SEQ ID NO: 15038 - protein, 7 aa, Artificial Sequence
  Synthetic
SRFDNRN

SEQ ID NO: 15039 - protein, 7 aa, Artificial Sequence
  Synthetic
WVHEGSK

SEQ ID NO: 15040 - protein, 7 aa, Artificial Sequence
  Synthetic
EHFHGSA

SEQ ID NO: 15041 - protein, 7 aa, Artificial Sequence
  Synthetic
GETVGRW

SEQ ID NO: 15042 - protein, 7 aa, Artificial Sequence
  Synthetic
SRAGYAT

SEQ ID NO: 15043 - protein, 7 aa, Artificial Sequence
  Synthetic
MYPLGSA

SEQ ID NO: 15044 - protein, 7 aa, Artificial Sequence
  Synthetic
GVVRLMN

SEQ ID NO: 15045 - protein, 7 aa, Artificial Sequence
  Synthetic
AQVGWSA

SEQ ID NO: 15046 - protein, 7 aa, Artificial Sequence
  Synthetic
SAWGMAQ

SEQ ID NO: 15047 - protein, 7 aa, Artificial Sequence
  Synthetic
AWPAGSS

SEQ ID NO: 15048 - protein, 7 aa, Artificial Sequence
  Synthetic
LWPGEST

SEQ ID NO: 15049 - protein, 7 aa, Artificial Sequence
  Synthetic
ALHGWTN

SEQ ID NO: 15050 - protein, 7 aa, Artificial Sequence
  Synthetic
RHVGDSS

SEQ ID NO: 15051 - protein, 7 aa, Artificial Sequence
  Synthetic
LLAFGSA

SEQ ID NO: 15052 - protein, 7 aa, Artificial Sequence
  Synthetic
VTRGYSM

SEQ ID NO: 15053 - protein, 7 aa, Artificial Sequence
  Synthetic
WTLGEGH

SEQ ID NO: 15054 - protein, 7 aa, Artificial Sequence
  Synthetic
WGMLERV

SEQ ID NO: 15055 - protein, 7 aa, Artificial Sequence
  Synthetic
AEPWLSS

SEQ ID NO: 15056 - protein, 7 aa, Artificial Sequence
  Synthetic
RYMPQPD

SEQ ID NO: 15057 - protein, 7 aa, Artificial Sequence
  Synthetic
VQFQGSS

SEQ ID NO: 15058 - protein, 7 aa, Artificial Sequence
  Synthetic
YASYGSM

SEQ ID NO: 15059 - protein, 7 aa, Artificial Sequence
  Synthetic
PGSPGRW

SEQ ID NO: 15060 - protein, 7 aa, Artificial Sequence
  Synthetic
SMRGYAS

SEQ ID NO: 15061 - protein, 7 aa, Artificial Sequence
  Synthetic
PPVIMRN

SEQ ID NO: 15062 - protein, 7 aa, Artificial Sequence
  Synthetic
VGAPGAW

SEQ ID NO: 15063 - protein, 7 aa, Artificial Sequence
  Synthetic
WGVGSGY

SEQ ID NO: 15064 - protein, 7 aa, Artificial Sequence
  Synthetic
ILRGYDI

SEQ ID NO: 15065 - protein, 7 aa, Artificial Sequence
  Synthetic
WILKDKV

SEQ ID NO: 15066 - protein, 7 aa, Artificial Sequence
  Synthetic
TFLNGSQ

SEQ ID NO: 15067 - protein, 7 aa, Artificial Sequence
  Synthetic
MDQRHWA

SEQ ID NO: 15068 - protein, 7 aa, Artificial Sequence
  Synthetic
QYVPHPS

SEQ ID NO: 15069 - protein, 7 aa, Artificial Sequence
  Synthetic
KGPHDFY

SEQ ID NO: 15070 - protein, 7 aa, Artificial Sequence
  Synthetic
VGNWYRD

SEQ ID NO: 15071 - protein, 7 aa, Artificial Sequence
  Synthetic
ARIVLTN

SEQ ID NO: 15072 - protein, 7 aa, Artificial Sequence
  Synthetic
LLPGYSA

SEQ ID NO: 15073 - protein, 7 aa, Artificial Sequence
  Synthetic
SFNTGVW

SEQ ID NO: 15074 - protein, 7 aa, Artificial Sequence
  Synthetic
VVRPQGW

SEQ ID NO: 15075 - protein, 7 aa, Artificial Sequence
  Synthetic
RVPGYSM

SEQ ID NO: 15076 - protein, 7 aa, Artificial Sequence
  Synthetic
PEWGGLS

SEQ ID NO: 15077 - protein, 7 aa, Artificial Sequence
  Synthetic
TVHGYST

SEQ ID NO: 15078 - protein, 7 aa, Artificial Sequence
  Synthetic
RWEGFSQ

SEQ ID NO: 15079 - protein, 7 aa, Artificial Sequence
  Synthetic
TYPGRSI

SEQ ID NO: 15080 - protein, 7 aa, Artificial Sequence
  Synthetic
SKPGYSM

SEQ ID NO: 15081 - protein, 7 aa, Artificial Sequence
  Synthetic
LASHFSV

SEQ ID NO: 15082 - protein, 7 aa, Artificial Sequence
  Synthetic
SYKPAAS

SEQ ID NO: 15083 - protein, 7 aa, Artificial Sequence
  Synthetic
WSVHGSA

SEQ ID NO: 15084 - protein, 7 aa, Artificial Sequence
  Synthetic
GDLAGRW

SEQ ID NO: 15085 - protein, 7 aa, Artificial Sequence
  Synthetic
SWAAGAS

SEQ ID NO: 15086 - protein, 7 aa, Artificial Sequence
  Synthetic
VAVGMHW

SEQ ID NO: 15087 - protein, 7 aa, Artificial Sequence
  Synthetic
WAVNGSS

SEQ ID NO: 15088 - protein, 7 aa, Artificial Sequence
  Synthetic
KSEFITW

SEQ ID NO: 15089 - protein, 7 aa, Artificial Sequence
  Synthetic
VLYNGSM

SEQ ID NO: 15090 - protein, 7 aa, Artificial Sequence
  Synthetic
WRPLGAS

SEQ ID NO: 15091 - protein, 7 aa, Artificial Sequence
  Synthetic
LRYAGST

SEQ ID NO: 15092 - protein, 7 aa, Artificial Sequence
  Synthetic
RWNADLL

SEQ ID NO: 15093 - protein, 7 aa, Artificial Sequence
  Synthetic
GGDPGRW

SEQ ID NO: 15094 - protein, 7 aa, Artificial Sequence
  Synthetic
TVTGFSQ

SEQ ID NO: 15095 - protein, 7 aa, Artificial Sequence
  Synthetic
RLPGMSQ

SEQ ID NO: 15096 - protein, 7 aa, Artificial Sequence
  Synthetic
TLDRYHT

SEQ ID NO: 15097 - protein, 7 aa, Artificial Sequence
  Synthetic
VSNYAGW

SEQ ID NO: 15098 - protein, 7 aa, Artificial Sequence
  Synthetic
HPVYNSS

SEQ ID NO: 15099 - protein, 7 aa, Artificial Sequence
  Synthetic
QWAGASQ

SEQ ID NO: 15100 - protein, 7 aa, Artificial Sequence
  Synthetic
RSAGFSS

SEQ ID NO: 15101 - protein, 7 aa, Artificial Sequence
  Synthetic
ILVGYQK

SEQ ID NO: 15102 - protein, 7 aa, Artificial Sequence
  Synthetic
LWVSSSS

SEQ ID NO: 15103 - protein, 7 aa, Artificial Sequence
  Synthetic
MVRMGSS

SEQ ID NO: 15104 - protein, 7 aa, Artificial Sequence
  Synthetic
AAFTRFD

SEQ ID NO: 15105 - protein, 7 aa, Artificial Sequence
  Synthetic
GVEVGRW

SEQ ID NO: 15106 - protein, 7 aa, Artificial Sequence
  Synthetic
DERWIAA

SEQ ID NO: 15107 - protein, 7 aa, Artificial Sequence
  Synthetic
DVREVRW

SEQ ID NO: 15108 - protein, 7 aa, Artificial Sequence
  Synthetic
KAPSFSS

SEQ ID NO: 15109 - protein, 7 aa, Artificial Sequence
  Synthetic
GVDLGMW

SEQ ID NO: 15110 - protein, 7 aa, Artificial Sequence
  Synthetic
VLHGYTN

SEQ ID NO: 15111 - protein, 7 aa, Artificial Sequence
  Synthetic
RYVHEIA

SEQ ID NO: 15112 - protein, 7 aa, Artificial Sequence
  Synthetic
KMDHGYW

SEQ ID NO: 15113 - protein, 7 aa, Artificial Sequence
  Synthetic
REHYSDW

SEQ ID NO: 15114 - protein, 7 aa, Artificial Sequence
  Synthetic
AVPTGLW

SEQ ID NO: 15115 - protein, 7 aa, Artificial Sequence
  Synthetic
FGVLNGI

SEQ ID NO: 15116 - protein, 7 aa, Artificial Sequence
  Synthetic
DDRTGRW

SEQ ID NO: 15117 - protein, 7 aa, Artificial Sequence
  Synthetic
SRVILFD

SEQ ID NO: 15118 - protein, 7 aa, Artificial Sequence
  Synthetic
GPGYSST

SEQ ID NO: 15119 - protein, 7 aa, Artificial Sequence
  Synthetic
VFPFPNV

SEQ ID NO: 15120 - protein, 7 aa, Artificial Sequence
  Synthetic
GQVSWSS

SEQ ID NO: 15121 - protein, 7 aa, Artificial Sequence
  Synthetic
STANWHV

SEQ ID NO: 15122 - protein, 7 aa, Artificial Sequence
  Synthetic
SFPGWSA

SEQ ID NO: 15123 - protein, 7 aa, Artificial Sequence
  Synthetic
LLPNCRL

SEQ ID NO: 15124 - protein, 7 aa, Artificial Sequence
  Synthetic
TTRWESS

SEQ ID NO: 15125 - protein, 7 aa, Artificial Sequence
  Synthetic
REFVLPT

SEQ ID NO: 15126 - protein, 7 aa, Artificial Sequence
  Synthetic
HYVGGST

SEQ ID NO: 15127 - protein, 7 aa, Artificial Sequence
  Synthetic
SSEVRWN

SEQ ID NO: 15128 - protein, 7 aa, Artificial Sequence
  Synthetic
LHYAGAM

SEQ ID NO: 15129 - protein, 7 aa, Artificial Sequence
  Synthetic
KWQNDMY

SEQ ID NO: 15130 - protein, 7 aa, Artificial Sequence
  Synthetic
EVYKRYD

SEQ ID NO: 15131 - protein, 7 aa, Artificial Sequence
  Synthetic
HAYHGST

SEQ ID NO: 15132 - protein, 7 aa, Artificial Sequence
  Synthetic
LKYGMSS

SEQ ID NO: 15133 - protein, 7 aa, Artificial Sequence
  Synthetic
QSMSQHW

SEQ ID NO: 15134 - protein, 7 aa, Artificial Sequence
  Synthetic
LMYSGSQ

SEQ ID NO: 15135 - protein, 7 aa, Artificial Sequence
  Synthetic
DARWPGS

SEQ ID NO: 15136 - protein, 7 aa, Artificial Sequence
  Synthetic
VYWEGSA

SEQ ID NO: 15137 - protein, 7 aa, Artificial Sequence
  Synthetic
LAYGAAQ

SEQ ID NO: 15138 - protein, 7 aa, Artificial Sequence
  Synthetic
PISLYGA

SEQ ID NO: 15139 - protein, 7 aa, Artificial Sequence
  Synthetic
CYGNSCG

SEQ ID NO: 15140 - protein, 7 aa, Artificial Sequence
  Synthetic
QRVVLER

SEQ ID NO: 15141 - protein, 7 aa, Artificial Sequence
  Synthetic
WVREGDR

SEQ ID NO: 15142 - protein, 7 aa, Artificial Sequence
  Synthetic
FPTDNRW

SEQ ID NO: 15143 - protein, 7 aa, Artificial Sequence
  Synthetic
FPRFHAD

SEQ ID NO: 15144 - protein, 7 aa, Artificial Sequence
  Synthetic
YYDTYRP

SEQ ID NO: 15145 - protein, 7 aa, Artificial Sequence
  Synthetic
TARLGST

SEQ ID NO: 15146 - protein, 7 aa, Artificial Sequence
  Synthetic
WMTSGSA

SEQ ID NO: 15147 - protein, 7 aa, Artificial Sequence
  Synthetic
SNRYEAS

SEQ ID NO: 15148 - protein, 7 aa, Artificial Sequence
  Synthetic
EAGTHRW

SEQ ID NO: 15149 - protein, 7 aa, Artificial Sequence
  Synthetic
YSLSQGF

SEQ ID NO: 15150 - protein, 7 aa, Artificial Sequence
  Synthetic
EWDHGSS

SEQ ID NO: 15151 - protein, 7 aa, Artificial Sequence
  Synthetic
DVRWGAA

SEQ ID NO: 15152 - protein, 7 aa, Artificial Sequence
  Synthetic
WSLPSMG

SEQ ID NO: 15153 - protein, 7 aa, Artificial Sequence
  Synthetic
AYLGAAQ

SEQ ID NO: 15154 - protein, 7 aa, Artificial Sequence
  Synthetic
EHRGSLW

SEQ ID NO: 15155 - protein, 7 aa, Artificial Sequence
  Synthetic
EMRPGAW

SEQ ID NO: 15156 - protein, 7 aa, Artificial Sequence
  Synthetic
HVVNQAR

SEQ ID NO: 15157 - protein, 7 aa, Artificial Sequence
  Synthetic
YGMLGPM

SEQ ID NO: 15158 - protein, 7 aa, Artificial Sequence
  Synthetic
KFAGGSQ

SEQ ID NO: 15159 - protein, 7 aa, Artificial Sequence
  Synthetic
EWRSGSA

SEQ ID NO: 15160 - protein, 7 aa, Artificial Sequence
  Synthetic
DLYHLPH

SEQ ID NO: 15161 - protein, 7 aa, Artificial Sequence
  Synthetic
TRDSGYW

SEQ ID NO: 15162 - protein, 7 aa, Artificial Sequence
  Synthetic
TRLLGSS

SEQ ID NO: 15163 - protein, 7 aa, Artificial Sequence
  Synthetic
WRDQGST

SEQ ID NO: 15164 - protein, 7 aa, Artificial Sequence
  Synthetic
GTPYLSS

SEQ ID NO: 15165 - protein, 7 aa, Artificial Sequence
  Synthetic
GLIGWSS

SEQ ID NO: 15166 - protein, 7 aa, Artificial Sequence
  Synthetic
SPDSGRW

SEQ ID NO: 15167 - protein, 7 aa, Artificial Sequence
  Synthetic
MLVGMAQ

SEQ ID NO: 15168 - protein, 7 aa, Artificial Sequence
  Synthetic
WLAGYRD

SEQ ID NO: 15169 - protein, 7 aa, Artificial Sequence
  Synthetic
TFTLGAA

SEQ ID NO: 15170 - protein, 7 aa, Artificial Sequence
  Synthetic
LGSPGLW

SEQ ID NO: 15171 - protein, 7 aa, Artificial Sequence
  Synthetic
REPWSSS

SEQ ID NO: 15172 - protein, 7 aa, Artificial Sequence
  Synthetic
REYSLDK

SEQ ID NO: 15173 - protein, 7 aa, Artificial Sequence
  Synthetic
AKYALPT

SEQ ID NO: 15174 - protein, 7 aa, Artificial Sequence
  Synthetic
SGVGWSS

SEQ ID NO: 15175 - protein, 7 aa, Artificial Sequence
  Synthetic
EYRGGST

SEQ ID NO: 15176 - protein, 7 aa, Artificial Sequence
  Synthetic
LRFNGAM

SEQ ID NO: 15177 - protein, 7 aa, Artificial Sequence
  Synthetic
SSNQARY

SEQ ID NO: 15178 - protein, 7 aa, Artificial Sequence
  Synthetic
QMTGWSS

SEQ ID NO: 15179 - protein, 7 aa, Artificial Sequence
  Synthetic
SIADRLY

SEQ ID NO: 15180 - protein, 7 aa, Artificial Sequence
  Synthetic
LIEHGWA

SEQ ID NO: 15181 - protein, 7 aa, Artificial Sequence
  Synthetic
GRIMLNQ

SEQ ID NO: 15182 - protein, 7 aa, Artificial Sequence
  Synthetic
PLHSAFR

SEQ ID NO: 15183 - protein, 7 aa, Artificial Sequence
  Synthetic
LQLNWAS

SEQ ID NO: 15184 - protein, 7 aa, Artificial Sequence
  Synthetic
RYTGGSS

SEQ ID NO: 15185 - protein, 7 aa, Artificial Sequence
  Synthetic
ESWAGSS

SEQ ID NO: 15186 - protein, 7 aa, Artificial Sequence
  Synthetic
SVYHGSS

SEQ ID NO: 15187 - protein, 7 aa, Artificial Sequence
  Synthetic
LNYSIAL

SEQ ID NO: 15188 - protein, 7 aa, Artificial Sequence
  Synthetic
LYSAHAS

SEQ ID NO: 15189 - protein, 7 aa, Artificial Sequence
  Synthetic
TSRGYSM

SEQ ID NO: 15190 - protein, 7 aa, Artificial Sequence
  Synthetic
WVIEGAR

SEQ ID NO: 15191 - protein, 7 aa, Artificial Sequence
  Synthetic
EYPFGSS

SEQ ID NO: 15192 - protein, 7 aa, Artificial Sequence
  Synthetic
LNSMFSV

SEQ ID NO: 15193 - protein, 7 aa, Artificial Sequence
  Synthetic
LISRGST

SEQ ID NO: 15194 - protein, 7 aa, Artificial Sequence
  Synthetic
TVLRGST

SEQ ID NO: 15195 - protein, 7 aa, Artificial Sequence
  Synthetic
ARPGFSS

SEQ ID NO: 15196 - protein, 7 aa, Artificial Sequence
  Synthetic
EPQTVRW

SEQ ID NO: 15197 - protein, 7 aa, Artificial Sequence
  Synthetic
PRLAGGW

SEQ ID NO: 15198 - protein, 7 aa, Artificial Sequence
  Synthetic
GTFGGSS

SEQ ID NO: 15199 - protein, 7 aa, Artificial Sequence
  Synthetic
WTVGSVY

SEQ ID NO: 15200 - protein, 7 aa, Artificial Sequence
  Synthetic
HPEWMAS

SEQ ID NO: 15201 - protein, 7 aa, Artificial Sequence
  Synthetic
GFPGYSS

SEQ ID NO: 15202 - protein, 7 aa, Artificial Sequence
  Synthetic
SLVGNRW

SEQ ID NO: 15203 - protein, 7 aa, Artificial Sequence
  Synthetic
TLYLGAS

SEQ ID NO: 15204 - protein, 7 aa, Artificial Sequence
  Synthetic
YVRGTWD

SEQ ID NO: 15205 - protein, 7 aa, Artificial Sequence
  Synthetic
YGALAGL

SEQ ID NO: 15206 - protein, 7 aa, Artificial Sequence
  Synthetic
SVYLGSV

SEQ ID NO: 15207 - protein, 7 aa, Artificial Sequence
  Synthetic
RWPAEAS

SEQ ID NO: 15208 - protein, 7 aa, Artificial Sequence
  Synthetic
VIPLGST

SEQ ID NO: 15209 - protein, 7 aa, Artificial Sequence
  Synthetic
RLSGYSQ

SEQ ID NO: 15210 - protein, 7 aa, Artificial Sequence
  Synthetic
TYVPSGH

SEQ ID NO: 15211 - protein, 7 aa, Artificial Sequence
  Synthetic
YMLPGRG

SEQ ID NO: 15212 - protein, 7 aa, Artificial Sequence
  Synthetic
LSYSTGL

SEQ ID NO: 15213 - protein, 7 aa, Artificial Sequence
  Synthetic
RRELGYG

SEQ ID NO: 15214 - protein, 7 aa, Artificial Sequence
  Synthetic
NGTEGRW

SEQ ID NO: 15215 - protein, 7 aa, Artificial Sequence
  Synthetic
DIGTRYY

SEQ ID NO: 15216 - protein, 7 aa, Artificial Sequence
  Synthetic
WGTLAAH

SEQ ID NO: 15217 - protein, 7 aa, Artificial Sequence
  Synthetic
QAAGWAS

SEQ ID NO: 15218 - protein, 7 aa, Artificial Sequence
  Synthetic
LWTHGAA

SEQ ID NO: 15219 - protein, 7 aa, Artificial Sequence
  Synthetic
WAVDNGF

SEQ ID NO: 15220 - protein, 7 aa, Artificial Sequence
  Synthetic
EAIGWAS

SEQ ID NO: 15221 - protein, 7 aa, Artificial Sequence
  Synthetic
LERNWAS

SEQ ID NO: 15222 - protein, 7 aa, Artificial Sequence
  Synthetic
LYYGAAS

SEQ ID NO: 15223 - protein, 7 aa, Artificial Sequence
  Synthetic
RRLGDAA

SEQ ID NO: 15224 - protein, 7 aa, Artificial Sequence
  Synthetic
LVPHGWN

SEQ ID NO: 15225 - protein, 7 aa, Artificial Sequence
  Synthetic
WMPGGST

SEQ ID NO: 15226 - protein, 7 aa, Artificial Sequence
  Synthetic
WGAPLHS

SEQ ID NO: 15227 - protein, 7 aa, Artificial Sequence
  Synthetic
TNQMVAV

SEQ ID NO: 15228 - protein, 7 aa, Artificial Sequence
  Synthetic
ARPGQSQ

SEQ ID NO: 15229 - protein, 7 aa, Artificial Sequence
  Synthetic
RFRPDPG

SEQ ID NO: 15230 - protein, 7 aa, Artificial Sequence
  Synthetic
WSVGGST

SEQ ID NO: 15231 - protein, 7 aa, Artificial Sequence
  Synthetic
VFDLRLS

SEQ ID NO: 15232 - protein, 7 aa, Artificial Sequence
  Synthetic
LMHGRAQ

SEQ ID NO: 15233 - protein, 7 aa, Artificial Sequence
  Synthetic
PLNAGMW

SEQ ID NO: 15234 - protein, 7 aa, Artificial Sequence
  Synthetic
VPKWSLD

SEQ ID NO: 15235 - protein, 7 aa, Artificial Sequence
  Synthetic
LYPGMAT

SEQ ID NO: 15236 - protein, 7 aa, Artificial Sequence
  Synthetic
PNSSGIW

SEQ ID NO: 15237 - protein, 7 aa, Artificial Sequence
  Synthetic
VVWGEAQ

SEQ ID NO: 15238 - protein, 7 aa, Artificial Sequence
  Synthetic
KSPGMSW

SEQ ID NO: 15239 - protein, 7 aa, Artificial Sequence
  Synthetic
EGPSRWS

SEQ ID NO: 15240 - protein, 7 aa, Artificial Sequence
  Synthetic
LTKGSVY

SEQ ID NO: 15241 - protein, 7 aa, Artificial Sequence
  Synthetic
FDIGPNA

SEQ ID NO: 15242 - protein, 7 aa, Artificial Sequence
  Synthetic
SFRPAPA

SEQ ID NO: 15243 - protein, 7 aa, Artificial Sequence
  Synthetic
EAPWESQ

SEQ ID NO: 15244 - protein, 7 aa, Artificial Sequence
  Synthetic
TARLGST

SEQ ID NO: 15245 - protein, 7 aa, Artificial Sequence
  Synthetic
SLRWEAS

SEQ ID NO: 15246 - protein, 7 aa, Artificial Sequence
  Synthetic
RVEMGFS

SEQ ID NO: 15247 - protein, 7 aa, Artificial Sequence
  Synthetic
ERYHGSQ

SEQ ID NO: 15248 - protein, 7 aa, Artificial Sequence
  Synthetic
VPGWGSS

SEQ ID NO: 15249 - protein, 7 aa, Artificial Sequence
  Synthetic
RYPAEAM

SEQ ID NO: 15250 - protein, 7 aa, Artificial Sequence
  Synthetic
KSIGTIY

SEQ ID NO: 15251 - protein, 7 aa, Artificial Sequence
  Synthetic
GSYTNSW

SEQ ID NO: 15252 - protein, 7 aa, Artificial Sequence
  Synthetic
ATQWDRV

SEQ ID NO: 15253 - protein, 7 aa, Artificial Sequence
  Synthetic
ARNGSVY

SEQ ID NO: 15254 - protein, 7 aa, Artificial Sequence
  Synthetic
GFAYGSS

SEQ ID NO: 15255 - protein, 7 aa, Artificial Sequence
  Synthetic
SFIHGSS

SEQ ID NO: 15256 - protein, 7 aa, Artificial Sequence
  Synthetic
SERGSWN

SEQ ID NO: 15257 - protein, 7 aa, Artificial Sequence
  Synthetic
GLDRGHW

SEQ ID NO: 15258 - protein, 7 aa, Artificial Sequence
  Synthetic
VLYLGSA

SEQ ID NO: 15259 - protein, 7 aa, Artificial Sequence
  Synthetic
MERFGSA

SEQ ID NO: 15260 - protein, 7 aa, Artificial Sequence
  Synthetic
TYAGYSA

SEQ ID NO: 15261 - protein, 7 aa, Artificial Sequence
  Synthetic
RYPAEAT

SEQ ID NO: 15262 - protein, 7 aa, Artificial Sequence
  Synthetic
TATRGST

SEQ ID NO: 15263 - protein, 7 aa, Artificial Sequence
  Synthetic
PQVHNQW

SEQ ID NO: 15264 - protein, 7 aa, Artificial Sequence
  Synthetic
DYVGQAS

SEQ ID NO: 15265 - protein, 7 aa, Artificial Sequence
  Synthetic
LDRGFSS

SEQ ID NO: 15266 - protein, 7 aa, Artificial Sequence
  Synthetic
HGNPGIW

SEQ ID NO: 15267 - protein, 7 aa, Artificial Sequence
  Synthetic
QAMHMSW

SEQ ID NO: 15268 - protein, 7 aa, Artificial Sequence
  Synthetic
SSPGFSS

SEQ ID NO: 15269 - protein, 7 aa, Artificial Sequence
  Synthetic
IYAGYTV

SEQ ID NO: 15270 - protein, 7 aa, Artificial Sequence
  Synthetic
GSNLGAW

SEQ ID NO: 15271 - protein, 7 aa, Artificial Sequence
  Synthetic
SVFHGSA

SEQ ID NO: 15272 - protein, 7 aa, Artificial Sequence
  Synthetic
EKPYTNW

SEQ ID NO: 15273 - protein, 7 aa, Artificial Sequence
  Synthetic
WLDFTYG

SEQ ID NO: 15274 - protein, 7 aa, Artificial Sequence
  Synthetic
FSSWATG

SEQ ID NO: 15275 - protein, 7 aa, Artificial Sequence
  Synthetic
SYIGGAQ

SEQ ID NO: 15276 - protein, 7 aa, Artificial Sequence
  Synthetic
GDGARWN

SEQ ID NO: 15277 - protein, 7 aa, Artificial Sequence
  Synthetic
KMPGWST

SEQ ID NO: 15278 - protein, 7 aa, Artificial Sequence
  Synthetic
PAPYSSS

SEQ ID NO: 15279 - protein, 7 aa, Artificial Sequence
  Synthetic
VARGYSM

SEQ ID NO: 15280 - protein, 7 aa, Artificial Sequence
  Synthetic
FSLDSRP

SEQ ID NO: 15281 - protein, 7 aa, Artificial Sequence
  Synthetic
YATYGST

SEQ ID NO: 15282 - protein, 7 aa, Artificial Sequence
  Synthetic
GHPTWSS

SEQ ID NO: 15283 - protein, 7 aa, Artificial Sequence
  Synthetic
RSFGLAQ

SEQ ID NO: 15284 - protein, 7 aa, Artificial Sequence
  Synthetic
ALSRYDI

SEQ ID NO: 15285 - protein, 7 aa, Artificial Sequence
  Synthetic
AGVGFSS

SEQ ID NO: 15286 - protein, 7 aa, Artificial Sequence
  Synthetic
AVRGFSS

SEQ ID NO: 15287 - protein, 7 aa, Artificial Sequence
  Synthetic
MSNEGRW

SEQ ID NO: 15288 - protein, 7 aa, Artificial Sequence
  Synthetic
LSGREWT

SEQ ID NO: 15289 - protein, 7 aa, Artificial Sequence
  Synthetic
QHYLGSS

SEQ ID NO: 15290 - protein, 7 aa, Artificial Sequence
  Synthetic
CREWGAA

SEQ ID NO: 15291 - protein, 7 aa, Artificial Sequence
  Synthetic
DASSNRW

SEQ ID NO: 15292 - protein, 7 aa, Artificial Sequence
  Synthetic
MIANFSA

SEQ ID NO: 15293 - protein, 7 aa, Artificial Sequence
  Synthetic
MLSGYSM

SEQ ID NO: 15294 - protein, 7 aa, Artificial Sequence
  Synthetic
WRVTDGF

SEQ ID NO: 15295 - protein, 7 aa, Artificial Sequence
  Synthetic
WSMNGSM

SEQ ID NO: 15296 - protein, 7 aa, Artificial Sequence
  Synthetic
GFDAVRW

SEQ ID NO: 15297 - protein, 7 aa, Artificial Sequence
  Synthetic
WSLGEGY

SEQ ID NO: 15298 - protein, 7 aa, Artificial Sequence
  Synthetic
PANRAIF

SEQ ID NO: 15299 - protein, 7 aa, Artificial Sequence
  Synthetic
RQFELPV

SEQ ID NO: 15300 - protein, 7 aa, Artificial Sequence
  Synthetic
AWSHGST

SEQ ID NO: 15301 - protein, 7 aa, Artificial Sequence
  Synthetic
ERYQGSH

SEQ ID NO: 15302 - protein, 7 aa, Artificial Sequence
  Synthetic
DWRGYSS

SEQ ID NO: 15303 - protein, 7 aa, Artificial Sequence
  Synthetic
RHTGDAA

SEQ ID NO: 15304 - protein, 7 aa, Artificial Sequence
  Synthetic
VRSMGSS

SEQ ID NO: 15305 - protein, 7 aa, Artificial Sequence
  Synthetic
LFPSGST

SEQ ID NO: 15306 - protein, 7 aa, Artificial Sequence
  Synthetic
LYHGSSH

SEQ ID NO: 15307 - protein, 7 aa, Artificial Sequence
  Synthetic
LGPHWST

SEQ ID NO: 15308 - protein, 7 aa, Artificial Sequence
  Synthetic
LYSEFHY

SEQ ID NO: 15309 - protein, 7 aa, Artificial Sequence
  Synthetic
LVSYGSS

SEQ ID NO: 15310 - protein, 7 aa, Artificial Sequence
  Synthetic
SPYSGFH

SEQ ID NO: 15311 - protein, 7 aa, Artificial Sequence
  Synthetic
SRPMGSS

SEQ ID NO: 15312 - protein, 7 aa, Artificial Sequence
  Synthetic
ANVLAGW

SEQ ID NO: 15313 - protein, 7 aa, Artificial Sequence
  Synthetic
HGQPGVW

SEQ ID NO: 15314 - protein, 7 aa, Artificial Sequence
  Synthetic
MFLAGST

SEQ ID NO: 15315 - protein, 7 aa, Artificial Sequence
  Synthetic
GGGLRWD

SEQ ID NO: 15316 - protein, 7 aa, Artificial Sequence
  Synthetic
ELVGHGW

SEQ ID NO: 15317 - protein, 7 aa, Artificial Sequence
  Synthetic
IYHGSST

SEQ ID NO: 15318 - protein, 7 aa, Artificial Sequence
  Synthetic
SMTSSMW

SEQ ID NO: 15319 - protein, 7 aa, Artificial Sequence
  Synthetic
HGAGWST

SEQ ID NO: 15320 - protein, 7 aa, Artificial Sequence
  Synthetic
KPAWAVD

SEQ ID NO: 15321 - protein, 7 aa, Artificial Sequence
  Synthetic
WGVLHSI

SEQ ID NO: 15322 - protein, 7 aa, Artificial Sequence
  Synthetic
VFGYNVT

SEQ ID NO: 15323 - protein, 7 aa, Artificial Sequence
  Synthetic
LGYSMSL

SEQ ID NO: 15324 - protein, 7 aa, Artificial Sequence
  Synthetic
MWHGDAS

SEQ ID NO: 15325 - protein, 7 aa, Artificial Sequence
  Synthetic
ERTLYSS

SEQ ID NO: 15326 - protein, 7 aa, Artificial Sequence
  Synthetic
KGASGNW

SEQ ID NO: 15327 - protein, 7 aa, Artificial Sequence
  Synthetic
DVTVSRW

SEQ ID NO: 15328 - protein, 7 aa, Artificial Sequence
  Synthetic
WSATAGY

SEQ ID NO: 15329 - protein, 7 aa, Artificial Sequence
  Synthetic
EASWSAS

SEQ ID NO: 15330 - protein, 7 aa, Artificial Sequence
  Synthetic
FSKFYDS

SEQ ID NO: 15331 - protein, 7 aa, Artificial Sequence
  Synthetic
DHSWQAS

SEQ ID NO: 15332 - protein, 7 aa, Artificial Sequence
  Synthetic
AFHGGSM

SEQ ID NO: 15333 - protein, 7 aa, Artificial Sequence
  Synthetic
TYAFSAS

SEQ ID NO: 15334 - protein, 7 aa, Artificial Sequence
  Synthetic
GSHVGAW

SEQ ID NO: 15335 - protein, 7 aa, Artificial Sequence
  Synthetic
GLEGGRW

SEQ ID NO: 15336 - protein, 7 aa, Artificial Sequence
  Synthetic
EKDSARW

SEQ ID NO: 15337 - protein, 7 aa, Artificial Sequence
  Synthetic
GASPGRW

SEQ ID NO: 15338 - protein, 7 aa, Artificial Sequence
  Synthetic
YGRLELL

SEQ ID NO: 15339 - protein, 7 aa, Artificial Sequence
  Synthetic
PAPLFSA

SEQ ID NO: 15340 - protein, 7 aa, Artificial Sequence
  Synthetic
QSYDTRW

SEQ ID NO: 15341 - protein, 7 aa, Artificial Sequence
  Synthetic
RYSGDSA

SEQ ID NO: 15342 - protein, 7 aa, Artificial Sequence
  Synthetic
RLFELPT

SEQ ID NO: 15343 - protein, 7 aa, Artificial Sequence
  Synthetic
ETPLQRW

SEQ ID NO: 15344 - protein, 7 aa, Artificial Sequence
  Synthetic
IVPGMSS

SEQ ID NO: 15345 - protein, 7 aa, Artificial Sequence
  Synthetic
SWPGEAS

SEQ ID NO: 15346 - protein, 7 aa, Artificial Sequence
  Synthetic
WKEMGSV

SEQ ID NO: 15347 - protein, 7 aa, Artificial Sequence
  Synthetic
GEAAGRW

SEQ ID NO: 15348 - protein, 7 aa, Artificial Sequence
  Synthetic
LVHHGFS

SEQ ID NO: 15349 - protein, 7 aa, Artificial Sequence
  Synthetic
SIPGMSS

SEQ ID NO: 15350 - protein, 7 aa, Artificial Sequence
  Synthetic
WAAGYSY

SEQ ID NO: 15351 - protein, 7 aa, Artificial Sequence
  Synthetic
EWRIGQV

SEQ ID NO: 15352 - protein, 7 aa, Artificial Sequence
  Synthetic
WAHAGSS

SEQ ID NO: 15353 - protein, 7 aa, Artificial Sequence
  Synthetic
PLQASGW

SEQ ID NO: 15354 - protein, 7 aa, Artificial Sequence
  Synthetic
WIGGGSQ

SEQ ID NO: 15355 - protein, 7 aa, Artificial Sequence
  Synthetic
MHWEGSS

SEQ ID NO: 15356 - protein, 7 aa, Artificial Sequence
  Synthetic
LTGDFRW

SEQ ID NO: 15357 - protein, 7 aa, Artificial Sequence
  Synthetic
VVLGYSM

SEQ ID NO: 15358 - protein, 7 aa, Artificial Sequence
  Synthetic
RFAEGFK

SEQ ID NO: 15359 - protein, 7 aa, Artificial Sequence
  Synthetic
WVSLPVT

SEQ ID NO: 15360 - protein, 7 aa, Artificial Sequence
  Synthetic
MYEGHSQ

SEQ ID NO: 15361 - protein, 7 aa, Artificial Sequence
  Synthetic
VHQGYST

SEQ ID NO: 15362 - protein, 7 aa, Artificial Sequence
  Synthetic
NHVGNLW

SEQ ID NO: 15363 - protein, 7 aa, Artificial Sequence
  Synthetic
WSLGGST

SEQ ID NO: 15364 - protein, 7 aa, Artificial Sequence
  Synthetic
TRTMGSV

SEQ ID NO: 15365 - protein, 7 aa, Artificial Sequence
  Synthetic
RVAWPGD

SEQ ID NO: 15366 - protein, 7 aa, Artificial Sequence
  Synthetic
WAVGSIY

SEQ ID NO: 15367 - protein, 7 aa, Artificial Sequence
  Synthetic
GYTEGRW

SEQ ID NO: 15368 - protein, 7 aa, Artificial Sequence
  Synthetic
SDRFRFD

SEQ ID NO: 15369 - protein, 7 aa, Artificial Sequence
  Synthetic
LGSGWST

SEQ ID NO: 15370 - protein, 7 aa, Artificial Sequence
  Synthetic
GANPGLW

SEQ ID NO: 15371 - protein, 7 aa, Artificial Sequence
  Synthetic
MWSGGSQ

SEQ ID NO: 15372 - protein, 7 aa, Artificial Sequence
  Synthetic
ERKYAFD

SEQ ID NO: 15373 - protein, 7 aa, Artificial Sequence
  Synthetic
PSPHSYH

SEQ ID NO: 15374 - protein, 7 aa, Artificial Sequence
  Synthetic
RWAADPA

SEQ ID NO: 15375 - protein, 7 aa, Artificial Sequence
  Synthetic
GDRVGVW

SEQ ID NO: 15376 - protein, 7 aa, Artificial Sequence
  Synthetic
ERGWGST

SEQ ID NO: 15377 - protein, 7 aa, Artificial Sequence
  Synthetic
PAIRLAS

SEQ ID NO: 15378 - protein, 7 aa, Artificial Sequence
  Synthetic
LVYHGAS

SEQ ID NO: 15379 - protein, 7 aa, Artificial Sequence
  Synthetic
TPFRLPD

SEQ ID NO: 15380 - protein, 7 aa, Artificial Sequence
  Synthetic
KSYGMSS

SEQ ID NO: 15381 - protein, 7 aa, Artificial Sequence
  Synthetic
MVVTGRW

SEQ ID NO: 15382 - protein, 7 aa, Artificial Sequence
  Synthetic
FVPGFSQ

SEQ ID NO: 15383 - protein, 7 aa, Artificial Sequence
  Synthetic
DANSHRW

SEQ ID NO: 15384 - protein, 7 aa, Artificial Sequence
  Synthetic
LAEIGRW

SEQ ID NO: 15385 - protein, 7 aa, Artificial Sequence
  Synthetic
WYVSGSS

SEQ ID NO: 15386 - protein, 7 aa, Artificial Sequence
  Synthetic
PDHVTRW

SEQ ID NO: 15387 - protein, 7 aa, Artificial Sequence
  Synthetic
PTWGVAE

SEQ ID NO: 15388 - protein, 7 aa, Artificial Sequence
  Synthetic
PRLGTVY

SEQ ID NO: 15389 - protein, 7 aa, Artificial Sequence
  Synthetic
RAYDPSG

SEQ ID NO: 15390 - protein, 7 aa, Artificial Sequence
  Synthetic
DNRGWST

SEQ ID NO: 15391 - protein, 7 aa, Artificial Sequence
  Synthetic
VWQHGST

SEQ ID NO: 15392 - protein, 7 aa, Artificial Sequence
  Synthetic
TVKGYST

SEQ ID NO: 15393 - protein, 7 aa, Artificial Sequence
  Synthetic
GPSFVAY

SEQ ID NO: 15394 - protein, 7 aa, Artificial Sequence
  Synthetic
PPKDVRW

SEQ ID NO: 15395 - protein, 7 aa, Artificial Sequence
  Synthetic
DWRRLDP

SEQ ID NO: 15396 - protein, 7 aa, Artificial Sequence
  Synthetic
NIDRYHV

SEQ ID NO: 15397 - protein, 7 aa, Artificial Sequence
  Synthetic
QLVGAGW

SEQ ID NO: 15398 - protein, 7 aa, Artificial Sequence
  Synthetic
GKEGNTW

SEQ ID NO: 15399 - protein, 7 aa, Artificial Sequence
  Synthetic
TVRTLNT

SEQ ID NO: 15400 - protein, 7 aa, Artificial Sequence
  Synthetic
VFKWEST

SEQ ID NO: 15401 - protein, 7 aa, Artificial Sequence
  Synthetic
DRQAWSS

SEQ ID NO: 15402 - protein, 7 aa, Artificial Sequence
  Synthetic
PANRAMY

SEQ ID NO: 15403 - protein, 7 aa, Artificial Sequence
  Synthetic
EHPSARY

SEQ ID NO: 15404 - protein, 7 aa, Artificial Sequence
  Synthetic
ERSGFSS

SEQ ID NO: 15405 - protein, 7 aa, Artificial Sequence
  Synthetic
WGTYIHT

SEQ ID NO: 15406 - protein, 7 aa, Artificial Sequence
  Synthetic
GGWGMSS

SEQ ID NO: 15407 - protein, 7 aa, Artificial Sequence
  Synthetic
RYAHDAS

SEQ ID NO: 15408 - protein, 7 aa, Artificial Sequence
  Synthetic
SVPYGAS

SEQ ID NO: 15409 - protein, 7 aa, Artificial Sequence
  Synthetic
TVPGWAA

SEQ ID NO: 15410 - protein, 7 aa, Artificial Sequence
  Synthetic
TYIGRAQ

SEQ ID NO: 15411 - protein, 7 aa, Artificial Sequence
  Synthetic
PEGSSRW

SEQ ID NO: 15412 - protein, 7 aa, Artificial Sequence
  Synthetic
FLVGFRE

SEQ ID NO: 15413 - protein, 7 aa, Artificial Sequence
  Synthetic
WVIPSGA

SEQ ID NO: 15414 - protein, 7 aa, Artificial Sequence
  Synthetic
TGIGYSQ

SEQ ID NO: 15415 - protein, 7 aa, Artificial Sequence
  Synthetic
LFRTGST

SEQ ID NO: 15416 - protein, 7 aa, Artificial Sequence
  Synthetic
DVDGWHY

SEQ ID NO: 15417 - protein, 7 aa, Artificial Sequence
  Synthetic
GSNLGVW

SEQ ID NO: 15418 - protein, 7 aa, Artificial Sequence
  Synthetic
HLRGYSE

SEQ ID NO: 15419 - protein, 7 aa, Artificial Sequence
  Synthetic
GERPGVW

SEQ ID NO: 15420 - protein, 7 aa, Artificial Sequence
  Synthetic
IYRGMST

SEQ ID NO: 15421 - protein, 7 aa, Artificial Sequence
  Synthetic
GGFGMSQ

SEQ ID NO: 15422 - protein, 7 aa, Artificial Sequence
  Synthetic
RVPGLSS

SEQ ID NO: 15423 - protein, 7 aa, Artificial Sequence
  Synthetic
YDGFRYG

SEQ ID NO: 15424 - protein, 7 aa, Artificial Sequence
  Synthetic
DPRLLAY

SEQ ID NO: 15425 - protein, 7 aa, Artificial Sequence
  Synthetic
RQLAGDR

SEQ ID NO: 15426 - protein, 7 aa, Artificial Sequence
  Synthetic
HRERGSS

SEQ ID NO: 15427 - protein, 7 aa, Artificial Sequence
  Synthetic
GGSQYIK

SEQ ID NO: 15428 - protein, 7 aa, Artificial Sequence
  Synthetic
VVKTQSW

SEQ ID NO: 15429 - protein, 7 aa, Artificial Sequence
  Synthetic
MDGSARW

SEQ ID NO: 15430 - protein, 7 aa, Artificial Sequence
  Synthetic
GGAIGPW

SEQ ID NO: 15431 - protein, 7 aa, Artificial Sequence
  Synthetic
VYRPAPG

SEQ ID NO: 15432 - protein, 7 aa, Artificial Sequence
  Synthetic
AYMPAVH

SEQ ID NO: 15433 - protein, 7 aa, Artificial Sequence
  Synthetic
MIARGST

SEQ ID NO: 15434 - protein, 7 aa, Artificial Sequence
  Synthetic
VHRGLSQ

SEQ ID NO: 15435 - protein, 7 aa, Artificial Sequence
  Synthetic
PKELGSW

SEQ ID NO: 15436 - protein, 7 aa, Artificial Sequence
  Synthetic
EDARRFV

SEQ ID NO: 15437 - protein, 7 aa, Artificial Sequence
  Synthetic
DLFHLRP

SEQ ID NO: 15438 - protein, 7 aa, Artificial Sequence
  Synthetic
WAYGGSS

SEQ ID NO: 15439 - protein, 7 aa, Artificial Sequence
  Synthetic
DITWSAS

SEQ ID NO: 15440 - protein, 7 aa, Artificial Sequence
  Synthetic
ISIGSVY

SEQ ID NO: 15441 - protein, 7 aa, Artificial Sequence
  Synthetic
VHTYGSS

SEQ ID NO: 15442 - protein, 7 aa, Artificial Sequence
  Synthetic
SMSYGSS

SEQ ID NO: 15443 - protein, 7 aa, Artificial Sequence
  Synthetic
RSVGLAQ

SEQ ID NO: 15444 - protein, 7 aa, Artificial Sequence
  Synthetic
EAWKGAA

SEQ ID NO: 15445 - protein, 7 aa, Artificial Sequence
  Synthetic
PYPGGTW

SEQ ID NO: 15446 - protein, 7 aa, Artificial Sequence
  Synthetic
FVSLPRV

SEQ ID NO: 15447 - protein, 7 aa, Artificial Sequence
  Synthetic
TNYGMSQ

SEQ ID NO: 15448 - protein, 7 aa, Artificial Sequence
  Synthetic
ESRYGSA

SEQ ID NO: 15449 - protein, 7 aa, Artificial Sequence
  Synthetic
DGMGWSS

SEQ ID NO: 15450 - protein, 7 aa, Artificial Sequence
  Synthetic
RYLSDSS

SEQ ID NO: 15451 - protein, 7 aa, Artificial Sequence
  Synthetic
GVNEGRW

SEQ ID NO: 15452 - protein, 7 aa, Artificial Sequence
  Synthetic
SVRLGST

SEQ ID NO: 15453 - protein, 7 aa, Artificial Sequence
  Synthetic
HLVGSAW

SEQ ID NO: 15454 - protein, 7 aa, Artificial Sequence
  Synthetic
LRYAVDV

SEQ ID NO: 15455 - protein, 7 aa, Artificial Sequence
  Synthetic
LSYSLGL

SEQ ID NO: 15456 - protein, 7 aa, Artificial Sequence
  Synthetic
HVALGSS

SEQ ID NO: 15457 - protein, 7 aa, Artificial Sequence
  Synthetic
WFSGGSM

SEQ ID NO: 15458 - protein, 7 aa, Artificial Sequence
  Synthetic
RLVHAAN

SEQ ID NO: 15459 - protein, 7 aa, Artificial Sequence
  Synthetic
ERHHGSS

SEQ ID NO: 15460 - protein, 7 aa, Artificial Sequence
  Synthetic
LVHPTWN

SEQ ID NO: 15461 - protein, 7 aa, Artificial Sequence
  Synthetic
EYHFGSA

SEQ ID NO: 15462 - protein, 7 aa, Artificial Sequence
  Synthetic
VVGGDLR

SEQ ID NO: 15463 - protein, 7 aa, Artificial Sequence
  Synthetic
GGIGWSS

SEQ ID NO: 15464 - protein, 7 aa, Artificial Sequence
  Synthetic
NEPSGRM

SEQ ID NO: 15465 - protein, 7 aa, Artificial Sequence
  Synthetic
GLYPPMA

SEQ ID NO: 15466 - protein, 7 aa, Artificial Sequence
  Synthetic
GWHAGAS

SEQ ID NO: 15467 - protein, 7 aa, Artificial Sequence
  Synthetic
DRWRLDP

SEQ ID NO: 15468 - protein, 7 aa, Artificial Sequence
  Synthetic
MLGRYSQ

SEQ ID NO: 15469 - protein, 7 aa, Artificial Sequence
  Synthetic
LFPGSAM

SEQ ID NO: 15470 - protein, 7 aa, Artificial Sequence
  Synthetic
MDLANSW

SEQ ID NO: 15471 - protein, 7 aa, Artificial Sequence
  Synthetic
WVLHGAS

SEQ ID NO: 15472 - protein, 7 aa, Artificial Sequence
  Synthetic
EFFNGSA

SEQ ID NO: 15473 - protein, 7 aa, Artificial Sequence
  Synthetic
RERSSSR

SEQ ID NO: 15474 - protein, 7 aa, Artificial Sequence
  Synthetic
RLAQDGR

SEQ ID NO: 15475 - protein, 7 aa, Artificial Sequence
  Synthetic
PAAGMSW

SEQ ID NO: 15476 - protein, 7 aa, Artificial Sequence
  Synthetic
WSHQGSM

SEQ ID NO: 15477 - protein, 7 aa, Artificial Sequence
  Synthetic
LWTNGSS

SEQ ID NO: 15478 - protein, 7 aa, Artificial Sequence
  Synthetic
KPYTLPS

SEQ ID NO: 15479 - protein, 7 aa, Artificial Sequence
  Synthetic
LHVGYSA

SEQ ID NO: 15480 - protein, 7 aa, Artificial Sequence
  Synthetic
GSPWDLA

SEQ ID NO: 15481 - protein, 7 aa, Artificial Sequence
  Synthetic
GTDYTRW

SEQ ID NO: 15482 - protein, 7 aa, Artificial Sequence
  Synthetic
ESVRSLW

SEQ ID NO: 15483 - protein, 7 aa, Artificial Sequence
  Synthetic
LNHPGAW

SEQ ID NO: 15484 - protein, 7 aa, Artificial Sequence
  Synthetic
AIYHGST

SEQ ID NO: 15485 - protein, 7 aa, Artificial Sequence
  Synthetic
WRGGGST

SEQ ID NO: 15486 - protein, 7 aa, Artificial Sequence
  Synthetic
MDLMPAG

SEQ ID NO: 15487 - protein, 7 aa, Artificial Sequence
  Synthetic
WAVKSGF

SEQ ID NO: 15488 - protein, 7 aa, Artificial Sequence
  Synthetic
WASLGST

SEQ ID NO: 15489 - protein, 7 aa, Artificial Sequence
  Synthetic
LSIGTVY

SEQ ID NO: 15490 - protein, 7 aa, Artificial Sequence
  Synthetic
TYVRELA

SEQ ID NO: 15491 - protein, 7 aa, Artificial Sequence
  Synthetic
QIGTGIW

SEQ ID NO: 15492 - protein, 7 aa, Artificial Sequence
  Synthetic
DLYFSSS

SEQ ID NO: 15493 - protein, 7 aa, Artificial Sequence
  Synthetic
WGSPEHS

SEQ ID NO: 15494 - protein, 7 aa, Artificial Sequence
  Synthetic
NRNPGMW

SEQ ID NO: 15495 - protein, 7 aa, Artificial Sequence
  Synthetic
AYPGNGW

SEQ ID NO: 15496 - protein, 7 aa, Artificial Sequence
  Synthetic
VYEIGFK

SEQ ID NO: 15497 - protein, 7 aa, Artificial Sequence
  Synthetic
QVEWGSA

SEQ ID NO: 15498 - protein, 7 aa, Artificial Sequence
  Synthetic
RFIPEPS

SEQ ID NO: 15499 - protein, 7 aa, Artificial Sequence
  Synthetic
HRVDILR

SEQ ID NO: 15500 - protein, 7 aa, Artificial Sequence
  Synthetic
SWSGYSA

SEQ ID NO: 15501 - protein, 7 aa, Artificial Sequence
  Synthetic
QAYNSSW

SEQ ID NO: 15502 - protein, 7 aa, Artificial Sequence
  Synthetic
FLSGWKD

SEQ ID NO: 15503 - protein, 7 aa, Artificial Sequence
  Synthetic
WQSYGSA

SEQ ID NO: 15504 - protein, 7 aa, Artificial Sequence
  Synthetic
GWLGGAS

SEQ ID NO: 15505 - protein, 7 aa, Artificial Sequence
  Synthetic
YENPGMW

SEQ ID NO: 15506 - protein, 7 aa, Artificial Sequence
  Synthetic
EGGSGRW

SEQ ID NO: 15507 - protein, 7 aa, Artificial Sequence
  Synthetic
LRAGYAS

SEQ ID NO: 15508 - protein, 7 aa, Artificial Sequence
  Synthetic
ERYGTAQ

SEQ ID NO: 15509 - protein, 7 aa, Artificial Sequence
  Synthetic
GPEYRGW

SEQ ID NO: 15510 - protein, 7 aa, Artificial Sequence
  Synthetic
LRGQDWL

SEQ ID NO: 15511 - protein, 7 aa, Artificial Sequence
  Synthetic
PRETNGW

SEQ ID NO: 15512 - protein, 7 aa, Artificial Sequence
  Synthetic
RDLLQLR

SEQ ID NO: 15513 - protein, 7 aa, Artificial Sequence
  Synthetic
PGNHAHW

SEQ ID NO: 15514 - protein, 7 aa, Artificial Sequence
  Synthetic
EAKYANW

SEQ ID NO: 15515 - protein, 7 aa, Artificial Sequence
  Synthetic
WVYEGSA

SEQ ID NO: 15516 - protein, 7 aa, Artificial Sequence
  Synthetic
EHAWERT

SEQ ID NO: 15517 - protein, 7 aa, Artificial Sequence
  Synthetic
GANVGVW

SEQ ID NO: 15518 - protein, 7 aa, Artificial Sequence
  Synthetic
VREFGSS

SEQ ID NO: 15519 - protein, 7 aa, Artificial Sequence
  Synthetic
AVQYGSS

SEQ ID NO: 15520 - protein, 7 aa, Artificial Sequence
  Synthetic
ENYRYSA

SEQ ID NO: 15521 - protein, 7 aa, Artificial Sequence
  Synthetic
GSDMARF

SEQ ID NO: 15522 - protein, 7 aa, Artificial Sequence
  Synthetic
IPLRAPY

SEQ ID NO: 15523 - protein, 7 aa, Artificial Sequence
  Synthetic
DKMWGVV

SEQ ID NO: 15524 - protein, 7 aa, Artificial Sequence
  Synthetic
AVWGTVP

SEQ ID NO: 15525 - protein, 7 aa, Artificial Sequence
  Synthetic
YREFPQR

SEQ ID NO: 15526 - protein, 7 aa, Artificial Sequence
  Synthetic
LQYRGSS

SEQ ID NO: 15527 - protein, 7 aa, Artificial Sequence
  Synthetic
EFLHGAA

SEQ ID NO: 15528 - protein, 7 aa, Artificial Sequence
  Synthetic
VFAGFSA

SEQ ID NO: 15529 - protein, 7 aa, Artificial Sequence
  Synthetic
LKYGMAS

SEQ ID NO: 15530 - protein, 7 aa, Artificial Sequence
  Synthetic
FYALGSS

SEQ ID NO: 15531 - protein, 7 aa, Artificial Sequence
  Synthetic
SVRMGST

SEQ ID NO: 15532 - protein, 7 aa, Artificial Sequence
  Synthetic
ITIGYSQ

SEQ ID NO: 15533 - protein, 7 aa, Artificial Sequence
  Synthetic
AGYNSSF

SEQ ID NO: 15534 - protein, 7 aa, Artificial Sequence
  Synthetic
IPAWSSS

SEQ ID NO: 15535 - protein, 7 aa, Artificial Sequence
  Synthetic
SLSWKVD

SEQ ID NO: 15536 - protein, 7 aa, Artificial Sequence
  Synthetic
MIGYGST

SEQ ID NO: 15537 - protein, 7 aa, Artificial Sequence
  Synthetic
FGSLNQL

SEQ ID NO: 15538 - protein, 7 aa, Artificial Sequence
  Synthetic
MAPMWSQ

SEQ ID NO: 15539 - protein, 7 aa, Artificial Sequence
  Synthetic
LYVGFSS

SEQ ID NO: 15540 - protein, 7 aa, Artificial Sequence
  Synthetic
FMTQGSA

SEQ ID NO: 15541 - protein, 7 aa, Artificial Sequence
  Synthetic
EGAARWA

SEQ ID NO: 15542 - protein, 7 aa, Artificial Sequence
  Synthetic
EKVGWSQ

SEQ ID NO: 15543 - protein, 7 aa, Artificial Sequence
  Synthetic
LAIGWSS

SEQ ID NO: 15544 - protein, 7 aa, Artificial Sequence
  Synthetic
VFPGSSV

SEQ ID NO: 15545 - protein, 7 aa, Artificial Sequence
  Synthetic
WSPYAAD

SEQ ID NO: 15546 - protein, 7 aa, Artificial Sequence
  Synthetic
EFHSGAW

SEQ ID NO: 15547 - protein, 7 aa, Artificial Sequence
  Synthetic
VRTMGSS

SEQ ID NO: 15548 - protein, 7 aa, Artificial Sequence
  Synthetic
ILVGSVY

SEQ ID NO: 15549 - protein, 7 aa, Artificial Sequence
  Synthetic
WGVLERV

SEQ ID NO: 15550 - protein, 7 aa, Artificial Sequence
  Synthetic
WGVLDSL

SEQ ID NO: 15551 - protein, 7 aa, Artificial Sequence
  Synthetic
AWPSGST

SEQ ID NO: 15552 - protein, 7 aa, Artificial Sequence
  Synthetic
PPNTGIW

SEQ ID NO: 15553 - protein, 7 aa, Artificial Sequence
  Synthetic
DAMSSRW

SEQ ID NO: 15554 - protein, 7 aa, Artificial Sequence
  Synthetic
AELSGRW

SEQ ID NO: 15555 - protein, 7 aa, Artificial Sequence
  Synthetic
AMWGSIA

SEQ ID NO: 15556 - protein, 7 aa, Artificial Sequence
  Synthetic
RFSLGDE

SEQ ID NO: 15557 - protein, 7 aa, Artificial Sequence
  Synthetic
RGMSPER

SEQ ID NO: 15558 - protein, 7 aa, Artificial Sequence
  Synthetic
TAIYGST

SEQ ID NO: 15559 - protein, 7 aa, Artificial Sequence
  Synthetic
LALGTVY

SEQ ID NO: 15560 - protein, 7 aa, Artificial Sequence
  Synthetic
SYTHGSA

SEQ ID NO: 15561 - protein, 7 aa, Artificial Sequence
  Synthetic
RASYSEW

SEQ ID NO: 15562 - protein, 7 aa, Artificial Sequence
  Synthetic
SIRMGST

SEQ ID NO: 15563 - protein, 7 aa, Artificial Sequence
  Synthetic
SWQGGSS

SEQ ID NO: 15564 - protein, 7 aa, Artificial Sequence
  Synthetic
SHAGYST

SEQ ID NO: 15565 - protein, 7 aa, Artificial Sequence
  Synthetic
HGFDLNR

SEQ ID NO: 15566 - protein, 7 aa, Artificial Sequence
  Synthetic
LLTGYAQ

SEQ ID NO: 15567 - protein, 7 aa, Artificial Sequence
  Synthetic
VRVGFSS

SEQ ID NO: 15568 - protein, 7 aa, Artificial Sequence
  Synthetic
TAKGWSS

SEQ ID NO: 15569 - protein, 7 aa, Artificial Sequence
  Synthetic
WELNEGW

SEQ ID NO: 15570 - protein, 7 aa, Artificial Sequence
  Synthetic
AWPGSAT

SEQ ID NO: 15571 - protein, 7 aa, Artificial Sequence
  Synthetic
EFRLGST

SEQ ID NO: 15572 - protein, 7 aa, Artificial Sequence
  Synthetic
ERERYSS

SEQ ID NO: 15573 - protein, 7 aa, Artificial Sequence
  Synthetic
EGPVRWD

SEQ ID NO: 15574 - protein, 7 aa, Artificial Sequence
  Synthetic
LVLRLAS

SEQ ID NO: 15575 - protein, 7 aa, Artificial Sequence
  Synthetic
LYPAMSS

SEQ ID NO: 15576 - protein, 7 aa, Artificial Sequence
  Synthetic
ERTGWSA

SEQ ID NO: 15577 - protein, 7 aa, Artificial Sequence
  Synthetic
LERGYST

SEQ ID NO: 15578 - protein, 7 aa, Artificial Sequence
  Synthetic
YASWMPV

SEQ ID NO: 15579 - protein, 7 aa, Artificial Sequence
  Synthetic
GYPGFST

SEQ ID NO: 15580 - protein, 7 aa, Artificial Sequence
  Synthetic
GSGSSLW

SEQ ID NO: 15581 - protein, 7 aa, Artificial Sequence
  Synthetic
LQYSYSS

SEQ ID NO: 15582 - protein, 7 aa, Artificial Sequence
  Synthetic
MRTGFSQ

SEQ ID NO: 15583 - protein, 7 aa, Artificial Sequence
  Synthetic
RYLGDTK

SEQ ID NO: 15584 - protein, 7 aa, Artificial Sequence
  Synthetic
KSPYAIP

SEQ ID NO: 15585 - protein, 7 aa, Artificial Sequence
  Synthetic
EVVNWAS

SEQ ID NO: 15586 - protein, 7 aa, Artificial Sequence
  Synthetic
ILVGREG

SEQ ID NO: 15587 - protein, 7 aa, Artificial Sequence
  Synthetic
WGVELGY

SEQ ID NO: 15588 - protein, 7 aa, Artificial Sequence
  Synthetic
SVLTGYG

SEQ ID NO: 15589 - protein, 7 aa, Artificial Sequence
  Synthetic
NPGEHRW

SEQ ID NO: 15590 - protein, 7 aa, Artificial Sequence
  Synthetic
WGLPNHS

SEQ ID NO: 15591 - protein, 7 aa, Artificial Sequence
  Synthetic
RGTWEGV

SEQ ID NO: 15592 - protein, 7 aa, Artificial Sequence
  Synthetic
EVRLMTY

SEQ ID NO: 15593 - protein, 7 aa, Artificial Sequence
  Synthetic
MWVGHSS

SEQ ID NO: 15594 - protein, 7 aa, Artificial Sequence
  Synthetic
IQLGFSS

SEQ ID NO: 15595 - protein, 7 aa, Artificial Sequence
  Synthetic
IARGYSV

SEQ ID NO: 15596 - protein, 7 aa, Artificial Sequence
  Synthetic
ALYRGSS

SEQ ID NO: 15597 - protein, 7 aa, Artificial Sequence
  Synthetic
MVSHGSA

SEQ ID NO: 15598 - protein, 7 aa, Artificial Sequence
  Synthetic
ELYYGSA

SEQ ID NO: 15599 - protein, 7 aa, Artificial Sequence
  Synthetic
SMPFGAS

SEQ ID NO: 15600 - protein, 7 aa, Artificial Sequence
  Synthetic
ALPWGSA

SEQ ID NO: 15601 - protein, 7 aa, Artificial Sequence
  Synthetic
EVVGLRW

SEQ ID NO: 15602 - protein, 7 aa, Artificial Sequence
  Synthetic
HAFQGSS

SEQ ID NO: 15603 - protein, 7 aa, Artificial Sequence
  Synthetic
QSGYSGW

SEQ ID NO: 15604 - protein, 7 aa, Artificial Sequence
  Synthetic
FRQYPEI

SEQ ID NO: 15605 - protein, 7 aa, Artificial Sequence
  Synthetic
RYQMDSA

SEQ ID NO: 15606 - protein, 7 aa, Artificial Sequence
  Synthetic
MPHRLPI

SEQ ID NO: 15607 - protein, 7 aa, Artificial Sequence
  Synthetic
VGSIPAL

SEQ ID NO: 15608 - protein, 7 aa, Artificial Sequence
  Synthetic
WVFGGAA

SEQ ID NO: 15609 - protein, 7 aa, Artificial Sequence
  Synthetic
GPEVGRW

SEQ ID NO: 15610 - protein, 7 aa, Artificial Sequence
  Synthetic
RYLPAPG

SEQ ID NO: 15611 - protein, 7 aa, Artificial Sequence
  Synthetic
YGSLAAM

SEQ ID NO: 15612 - protein, 7 aa, Artificial Sequence
  Synthetic
IFAGYVN

SEQ ID NO: 15613 - protein, 7 aa, Artificial Sequence
  Synthetic
LYHGGSS

SEQ ID NO: 15614 - protein, 7 aa, Artificial Sequence
  Synthetic
YGLLISN

SEQ ID NO: 15615 - protein, 7 aa, Artificial Sequence
  Synthetic
DIPGWSH

SEQ ID NO: 15616 - protein, 7 aa, Artificial Sequence
  Synthetic
GYVLQYG

SEQ ID NO: 15617 - protein, 7 aa, Artificial Sequence
  Synthetic
YRGTWDP

SEQ ID NO: 15618 - protein, 7 aa, Artificial Sequence
  Synthetic
LYAGWNE

SEQ ID NO: 15619 - protein, 7 aa, Artificial Sequence
  Synthetic
VLIGRAG

SEQ ID NO: 15620 - protein, 7 aa, Artificial Sequence
  Synthetic
WVTHGSS

SEQ ID NO: 15621 - protein, 7 aa, Artificial Sequence
  Synthetic
TIRGFSV

SEQ ID NO: 15622 - protein, 7 aa, Artificial Sequence
  Synthetic
FVFGAEV

SEQ ID NO: 15623 - protein, 7 aa, Artificial Sequence
  Synthetic
LLPPWHA

SEQ ID NO: 15624 - protein, 7 aa, Artificial Sequence
  Synthetic
LMVGYSV

SEQ ID NO: 15625 - protein, 7 aa, Artificial Sequence
  Synthetic
WPLLTPN

SEQ ID NO: 15626 - protein, 7 aa, Artificial Sequence
  Synthetic
LLQYGSQ

SEQ ID NO: 15627 - protein, 7 aa, Artificial Sequence
  Synthetic
PRTYGSS

SEQ ID NO: 15628 - protein, 7 aa, Artificial Sequence
  Synthetic
GQDLGRW

SEQ ID NO: 15629 - protein, 7 aa, Artificial Sequence
  Synthetic
GCTSVGA

SEQ ID NO: 15630 - protein, 7 aa, Artificial Sequence
  Synthetic
MRNLTFG

SEQ ID NO: 15631 - protein, 7 aa, Artificial Sequence
  Synthetic
TTHGYGY

SEQ ID NO: 15632 - protein, 7 aa, Artificial Sequence
  Synthetic
ERFHGYS

SEQ ID NO: 15633 - protein, 7 aa, Artificial Sequence
  Synthetic
SDCRGCW

SEQ ID NO: 15634 - protein, 7 aa, Artificial Sequence
  Synthetic
MNRPSER

SEQ ID NO: 15635 - protein, 7 aa, Artificial Sequence
  Synthetic
RYNGESQ

SEQ ID NO: 15636 - protein, 7 aa, Artificial Sequence
  Synthetic
RFSGDPS

SEQ ID NO: 15637 - protein, 7 aa, Artificial Sequence
  Synthetic
DNTSGRW

SEQ ID NO: 15638 - protein, 7 aa, Artificial Sequence
  Synthetic
ITTLIRQ

SEQ ID NO: 15639 - protein, 7 aa, Artificial Sequence
  Synthetic
PILKYGA

SEQ ID NO: 15640 - protein, 7 aa, Artificial Sequence
  Synthetic
WLAKGTV

SEQ ID NO: 15641 - protein, 7 aa, Artificial Sequence
  Synthetic
YFHSHSM

SEQ ID NO: 15642 - protein, 7 aa, Artificial Sequence
  Synthetic
RFSADSS

SEQ ID NO: 15643 - protein, 7 aa, Artificial Sequence
  Synthetic
TRTGYST

SEQ ID NO: 15644 - protein, 7 aa, Artificial Sequence
  Synthetic
GGNSRWD

SEQ ID NO: 15645 - protein, 7 aa, Artificial Sequence
  Synthetic
SYVGGAS

SEQ ID NO: 15646 - protein, 7 aa, Artificial Sequence
  Synthetic
AVGDGRW

SEQ ID NO: 15647 - protein, 7 aa, Artificial Sequence
  Synthetic
FVIGSPF

SEQ ID NO: 15648 - protein, 7 aa, Artificial Sequence
  Synthetic
MYGGYAQ

SEQ ID NO: 15649 - protein, 7 aa, Artificial Sequence
  Synthetic
LFPADRS

SEQ ID NO: 15650 - protein, 7 aa, Artificial Sequence
  Synthetic
LNYSGST

SEQ ID NO: 15651 - protein, 7 aa, Artificial Sequence
  Synthetic
LIYQHSS

SEQ ID NO: 15652 - protein, 7 aa, Artificial Sequence
  Synthetic
WHSYGSA

SEQ ID NO: 15653 - protein, 7 aa, Artificial Sequence
  Synthetic
DLRWDRA

SEQ ID NO: 15654 - protein, 7 aa, Artificial Sequence
  Synthetic
ERTYGSQ

SEQ ID NO: 15655 - protein, 7 aa, Artificial Sequence
  Synthetic
SHVGWSQ

SEQ ID NO: 15656 - protein, 7 aa, Artificial Sequence
  Synthetic
FLRGYEN

SEQ ID NO: 15657 - protein, 7 aa, Artificial Sequence
  Synthetic
AGDPGRW

SEQ ID NO: 15658 - protein, 7 aa, Artificial Sequence
  Synthetic
VEHSGRW

SEQ ID NO: 15659 - protein, 7 aa, Artificial Sequence
  Synthetic
TRTLTQY

SEQ ID NO: 15660 - protein, 7 aa, Artificial Sequence
  Synthetic
PQHSGMW

SEQ ID NO: 15661 - protein, 7 aa, Artificial Sequence
  Synthetic
DLPGWSS

SEQ ID NO: 15662 - protein, 7 aa, Artificial Sequence
  Synthetic
NPVRLHN

SEQ ID NO: 15663 - protein, 7 aa, Artificial Sequence
  Synthetic
DQTPGRW

SEQ ID NO: 15664 - protein, 7 aa, Artificial Sequence
  Synthetic
SVTWGSA

SEQ ID NO: 15665 - protein, 7 aa, Artificial Sequence
  Synthetic
PYPGLAA

SEQ ID NO: 15666 - protein, 7 aa, Artificial Sequence
  Synthetic
PRVSYAA

SEQ ID NO: 15667 - protein, 7 aa, Artificial Sequence
  Synthetic
HLVGYAV

SEQ ID NO: 15668 - protein, 7 aa, Artificial Sequence
  Synthetic
KREYDYS

SEQ ID NO: 15669 - protein, 7 aa, Artificial Sequence
  Synthetic
LEQGWST

SEQ ID NO: 15670 - protein, 7 aa, Artificial Sequence
  Synthetic
RDVGTVY

SEQ ID NO: 15671 - protein, 7 aa, Artificial Sequence
  Synthetic
KYTDSLW

SEQ ID NO: 15672 - protein, 7 aa, Artificial Sequence
  Synthetic
FGAPGMW

SEQ ID NO: 15673 - protein, 7 aa, Artificial Sequence
  Synthetic
WVVGVEY

SEQ ID NO: 15674 - protein, 7 aa, Artificial Sequence
  Synthetic
SVPAHQV

SEQ ID NO: 15675 - protein, 7 aa, Artificial Sequence
  Synthetic
LRYSVGL

SEQ ID NO: 15676 - protein, 7 aa, Artificial Sequence
  Synthetic
VNPGGWT

SEQ ID NO: 15677 - protein, 7 aa, Artificial Sequence
  Synthetic
WGSLASL

SEQ ID NO: 15678 - protein, 7 aa, Artificial Sequence
  Synthetic
TRPAMWE

SEQ ID NO: 15679 - protein, 7 aa, Artificial Sequence
  Synthetic
FGRLEQF

SEQ ID NO: 15680 - protein, 7 aa, Artificial Sequence
  Synthetic
IAQGYST

SEQ ID NO: 15681 - protein, 7 aa, Artificial Sequence
  Synthetic
LVGEGRW

SEQ ID NO: 15682 - protein, 7 aa, Artificial Sequence
  Synthetic
WSAGGAQ

SEQ ID NO: 15683 - protein, 7 aa, Artificial Sequence
  Synthetic
DKTGWSS

SEQ ID NO: 15684 - protein, 7 aa, Artificial Sequence
  Synthetic
VERFGSA

SEQ ID NO: 15685 - protein, 7 aa, Artificial Sequence
  Synthetic
WTEMRYG

SEQ ID NO: 15686 - protein, 7 aa, Artificial Sequence
  Synthetic
LREHGWA

SEQ ID NO: 15687 - protein, 7 aa, Artificial Sequence
  Synthetic
DLMPGRW

SEQ ID NO: 15688 - protein, 7 aa, Artificial Sequence
  Synthetic
KPYSLSP

SEQ ID NO: 15689 - protein, 7 aa, Artificial Sequence
  Synthetic
EAAGMRW

SEQ ID NO: 15690 - protein, 7 aa, Artificial Sequence
  Synthetic
YSVSGGW

SEQ ID NO: 15691 - protein, 7 aa, Artificial Sequence
  Synthetic
PQDMGIW

SEQ ID NO: 15692 - protein, 7 aa, Artificial Sequence
  Synthetic
YTGALSW

SEQ ID NO: 15693 - protein, 7 aa, Artificial Sequence
  Synthetic
SAGWGSS

SEQ ID NO: 15694 - protein, 7 aa, Artificial Sequence
  Synthetic
DKYHFPV

SEQ ID NO: 15695 - protein, 7 aa, Artificial Sequence
  Synthetic
LVGGYAW

SEQ ID NO: 15696 - protein, 7 aa, Artificial Sequence
  Synthetic
RVGDYSW

SEQ ID NO: 15697 - protein, 7 aa, Artificial Sequence
  Synthetic
AAEFGSS

SEQ ID NO: 15698 - protein, 7 aa, Artificial Sequence
  Synthetic
AGSPGPW

SEQ ID NO: 15699 - protein, 7 aa, Artificial Sequence
  Synthetic
MSHGAAQ

SEQ ID NO: 15700 - protein, 7 aa, Artificial Sequence
  Synthetic
ERAHGSS

SEQ ID NO: 15701 - protein, 7 aa, Artificial Sequence
  Synthetic
LVENWHK

SEQ ID NO: 15702 - protein, 7 aa, Artificial Sequence
  Synthetic
FDNIGRW

SEQ ID NO: 15703 - protein, 7 aa, Artificial Sequence
  Synthetic
DNYQGSA

SEQ ID NO: 15704 - protein, 7 aa, Artificial Sequence
  Synthetic
AGIVRFN

SEQ ID NO: 15705 - protein, 7 aa, Artificial Sequence
  Synthetic
VYVGQSS

SEQ ID NO: 15706 - protein, 7 aa, Artificial Sequence
  Synthetic
WTRQEGF

SEQ ID NO: 15707 - protein, 7 aa, Artificial Sequence
  Synthetic
WTAGSGY

SEQ ID NO: 15708 - protein, 7 aa, Artificial Sequence
  Synthetic
TTRAEFW

SEQ ID NO: 15709 - protein, 7 aa, Artificial Sequence
  Synthetic
SVETWHT

SEQ ID NO: 15710 - protein, 7 aa, Artificial Sequence
  Synthetic
QSYQGST

SEQ ID NO: 15711 - protein, 7 aa, Artificial Sequence
  Synthetic
PAFSVDK

SEQ ID NO: 15712 - protein, 7 aa, Artificial Sequence
  Synthetic
EQVFGSA

SEQ ID NO: 15713 - protein, 7 aa, Artificial Sequence
  Synthetic
PARPGPW

SEQ ID NO: 15714 - protein, 7 aa, Artificial Sequence
  Synthetic
PDHARTW

SEQ ID NO: 15715 - protein, 7 aa, Artificial Sequence
  Synthetic
GDTQGRW

SEQ ID NO: 15716 - protein, 7 aa, Artificial Sequence
  Synthetic
IPSCYSC

SEQ ID NO: 15717 - protein, 7 aa, Artificial Sequence
  Synthetic
IVYKGSA

SEQ ID NO: 15718 - protein, 7 aa, Artificial Sequence
  Synthetic
HFSGYST

SEQ ID NO: 15719 - protein, 7 aa, Artificial Sequence
  Synthetic
KRFDLNP

SEQ ID NO: 15720 - protein, 7 aa, Artificial Sequence
  Synthetic
GIWGLAQ

SEQ ID NO: 15721 - protein, 7 aa, Artificial Sequence
  Synthetic
VAPWDRT

SEQ ID NO: 15722 - protein, 7 aa, Artificial Sequence
  Synthetic
DHVSSRW

SEQ ID NO: 15723 - protein, 7 aa, Artificial Sequence
  Synthetic
VHAMQIY

SEQ ID NO: 15724 - protein, 7 aa, Artificial Sequence
  Synthetic
MIPYGAS

SEQ ID NO: 15725 - protein, 7 aa, Artificial Sequence
  Synthetic
KYQGFAS

SEQ ID NO: 15726 - protein, 7 aa, Artificial Sequence
  Synthetic
LLRLGST

SEQ ID NO: 15727 - protein, 7 aa, Artificial Sequence
  Synthetic
ERSYMAQ

SEQ ID NO: 15728 - protein, 7 aa, Artificial Sequence
  Synthetic
AMHMGSS

SEQ ID NO: 15729 - protein, 7 aa, Artificial Sequence
  Synthetic
EPHQARW

SEQ ID NO: 15730 - protein, 7 aa, Artificial Sequence
  Synthetic
SIYHGSS

SEQ ID NO: 15731 - protein, 7 aa, Artificial Sequence
  Synthetic
YVYHGSS

SEQ ID NO: 15732 - protein, 7 aa, Artificial Sequence
  Synthetic
LNSNFSS

SEQ ID NO: 15733 - protein, 7 aa, Artificial Sequence
  Synthetic
AAFHLPV

SEQ ID NO: 15734 - protein, 7 aa, Artificial Sequence
  Synthetic
LEVGWST

SEQ ID NO: 15735 - protein, 7 aa, Artificial Sequence
  Synthetic
PSYSLNV

SEQ ID NO: 15736 - protein, 7 aa, Artificial Sequence
  Synthetic
SFVYSSA

SEQ ID NO: 15737 - protein, 7 aa, Artificial Sequence
  Synthetic
GRLMGST

SEQ ID NO: 15738 - protein, 7 aa, Artificial Sequence
  Synthetic
LNYGGAS

SEQ ID NO: 15739 - protein, 7 aa, Artificial Sequence
  Synthetic
GLYREFH

SEQ ID NO: 15740 - protein, 7 aa, Artificial Sequence
  Synthetic
LNVGWAS

SEQ ID NO: 15741 - protein, 7 aa, Artificial Sequence
  Synthetic
EKWGSSQ

SEQ ID NO: 15742 - protein, 7 aa, Artificial Sequence
  Synthetic
GVSQGRF

SEQ ID NO: 15743 - protein, 7 aa, Artificial Sequence
  Synthetic
LRLLGSA

SEQ ID NO: 15744 - protein, 7 aa, Artificial Sequence
  Synthetic
VTLGTVY

SEQ ID NO: 15745 - protein, 7 aa, Artificial Sequence
  Synthetic
WVFGSDA

SEQ ID NO: 15746 - protein, 7 aa, Artificial Sequence
  Synthetic
AYPGRSQ

SEQ ID NO: 15747 - protein, 7 aa, Artificial Sequence
  Synthetic
RWQGEAS

SEQ ID NO: 15748 - protein, 7 aa, Artificial Sequence
  Synthetic
IGDVGRW

SEQ ID NO: 15749 - protein, 7 aa, Artificial Sequence
  Synthetic
GLVDGRW

SEQ ID NO: 15750 - protein, 7 aa, Artificial Sequence
  Synthetic
GENQGKW

SEQ ID NO: 15751 - protein, 7 aa, Artificial Sequence
  Synthetic
EYAFHSS

SEQ ID NO: 15752 - protein, 7 aa, Artificial Sequence
  Synthetic
LIPSFSS

SEQ ID NO: 15753 - protein, 7 aa, Artificial Sequence
  Synthetic
SHPGGWS

SEQ ID NO: 15754 - protein, 7 aa, Artificial Sequence
  Synthetic
MFHGAST

SEQ ID NO: 15755 - protein, 7 aa, Artificial Sequence
  Synthetic
GTYESRW

SEQ ID NO: 15756 - protein, 7 aa, Artificial Sequence
  Synthetic
SYFGSAS

SEQ ID NO: 15757 - protein, 7 aa, Artificial Sequence
  Synthetic
ISIGYGY

SEQ ID NO: 15758 - protein, 7 aa, Artificial Sequence
  Synthetic
GQDSARW

SEQ ID NO: 15759 - protein, 7 aa, Artificial Sequence
  Synthetic
DIRHGWA

SEQ ID NO: 15760 - protein, 7 aa, Artificial Sequence
  Synthetic
SYNTAYY

SEQ ID NO: 15761 - protein, 7 aa, Artificial Sequence
  Synthetic
DHRYGSA

SEQ ID NO: 15762 - protein, 7 aa, Artificial Sequence
  Synthetic
WGILDGL

SEQ ID NO: 15763 - protein, 7 aa, Artificial Sequence
  Synthetic
GRVPMGY

SEQ ID NO: 15764 - protein, 7 aa, Artificial Sequence
  Synthetic
LFHVGST

SEQ ID NO: 15765 - protein, 7 aa, Artificial Sequence
  Synthetic
LRVGYSM

SEQ ID NO: 15766 - protein, 7 aa, Artificial Sequence
  Synthetic
VGYSVGI

SEQ ID NO: 15767 - protein, 7 aa, Artificial Sequence
  Synthetic
ERSFGYA

SEQ ID NO: 15768 - protein, 7 aa, Artificial Sequence
  Synthetic
SVEYRFV

SEQ ID NO: 15769 - protein, 7 aa, Artificial Sequence
  Synthetic
ANWGLAS

SEQ ID NO: 15770 - protein, 7 aa, Artificial Sequence
  Synthetic
RILLTPI

SEQ ID NO: 15771 - protein, 7 aa, Artificial Sequence
  Synthetic
GIPREWN

SEQ ID NO: 15772 - protein, 7 aa, Artificial Sequence
  Synthetic
NRYDYNV

SEQ ID NO: 15773 - protein, 7 aa, Artificial Sequence
  Synthetic
ARVQLVA

SEQ ID NO: 15774 - protein, 7 aa, Artificial Sequence
  Synthetic
QALYGST

SEQ ID NO: 15775 - protein, 7 aa, Artificial Sequence
  Synthetic
VQSFTSL

SEQ ID NO: 15776 - protein, 7 aa, Artificial Sequence
  Synthetic
LRMGGSQ

SEQ ID NO: 15777 - protein, 7 aa, Artificial Sequence
  Synthetic
LRATYSM

SEQ ID NO: 15778 - protein, 7 aa, Artificial Sequence
  Synthetic
IVGGSLR

SEQ ID NO: 15779 - protein, 7 aa, Artificial Sequence
  Synthetic
GWPGGST

SEQ ID NO: 15780 - protein, 7 aa, Artificial Sequence
  Synthetic
SEKFGSS

SEQ ID NO: 15781 - protein, 7 aa, Artificial Sequence
  Synthetic
LYVPHAS

SEQ ID NO: 15782 - protein, 7 aa, Artificial Sequence
  Synthetic
RGAYEGW

SEQ ID NO: 15783 - protein, 7 aa, Artificial Sequence
  Synthetic
VVWGGSV

SEQ ID NO: 15784 - protein, 7 aa, Artificial Sequence
  Synthetic
LWAGTAT

SEQ ID NO: 15785 - protein, 7 aa, Artificial Sequence
  Synthetic
WKVNDGY

SEQ ID NO: 15786 - protein, 7 aa, Artificial Sequence
  Synthetic
NREWAIA

SEQ ID NO: 15787 - protein, 7 aa, Artificial Sequence
  Synthetic
GTHVGVW

SEQ ID NO: 15788 - protein, 7 aa, Artificial Sequence
  Synthetic
EVKWGSA

SEQ ID NO: 15789 - protein, 7 aa, Artificial Sequence
  Synthetic
MMIGWSA

SEQ ID NO: 15790 - protein, 7 aa, Artificial Sequence
  Synthetic
WGVDRGW

SEQ ID NO: 15791 - protein, 7 aa, Artificial Sequence
  Synthetic
VFTIRGI

SEQ ID NO: 15792 - protein, 7 aa, Artificial Sequence
  Synthetic
GDNVGYW

SEQ ID NO: 15793 - protein, 7 aa, Artificial Sequence
  Synthetic
RAPFQSA

SEQ ID NO: 15794 - protein, 7 aa, Artificial Sequence
  Synthetic
QLSWGSA

SEQ ID NO: 15795 - protein, 7 aa, Artificial Sequence
  Synthetic
PGDYARY

SEQ ID NO: 15796 - protein, 7 aa, Artificial Sequence
  Synthetic
LNSLWSG

SEQ ID NO: 15797 - protein, 7 aa, Artificial Sequence
  Synthetic
LGINWSS

SEQ ID NO: 15798 - protein, 7 aa, Artificial Sequence
  Synthetic
GRIMLTS

SEQ ID NO: 15799 - protein, 7 aa, Artificial Sequence
  Synthetic
GLRVGAW

SEQ ID NO: 15800 - protein, 7 aa, Artificial Sequence
  Synthetic
LVHGFSV

SEQ ID NO: 15801 - protein, 7 aa, Artificial Sequence
  Synthetic
NSPVWGS

SEQ ID NO: 15802 - protein, 7 aa, Artificial Sequence
  Synthetic
TYDIRSI

SEQ ID NO: 15803 - protein, 7 aa, Artificial Sequence
  Synthetic
HRRDPRE

SEQ ID NO: 15804 - protein, 7 aa, Artificial Sequence
  Synthetic
EGTVRWA

SEQ ID NO: 15805 - protein, 7 aa, Artificial Sequence
  Synthetic
EIPGYSQ

SEQ ID NO: 15806 - protein, 7 aa, Artificial Sequence
  Synthetic
AITRYYE

SEQ ID NO: 15807 - protein, 7 aa, Artificial Sequence
  Synthetic
KSPYVGF

SEQ ID NO: 15808 - protein, 7 aa, Artificial Sequence
  Synthetic
RNWSLND

SEQ ID NO: 15809 - protein, 7 aa, Artificial Sequence
  Synthetic
MQGEYRW

SEQ ID NO: 15810 - protein, 7 aa, Artificial Sequence
  Synthetic
RENDGRW

SEQ ID NO: 15811 - protein, 7 aa, Artificial Sequence
  Synthetic
MVNYGST

SEQ ID NO: 15812 - protein, 7 aa, Artificial Sequence
  Synthetic
LRLGEAQ

SEQ ID NO: 15813 - protein, 7 aa, Artificial Sequence
  Synthetic
FLNMYGQ

SEQ ID NO: 15814 - protein, 7 aa, Artificial Sequence
  Synthetic
DHWKGAS

SEQ ID NO: 15815 - protein, 7 aa, Artificial Sequence
  Synthetic
LLNSGIW

SEQ ID NO: 15816 - protein, 7 aa, Artificial Sequence
  Synthetic
AHPNWST

SEQ ID NO: 15817 - protein, 7 aa, Artificial Sequence
  Synthetic
LPTDTRW

SEQ ID NO: 15818 - protein, 7 aa, Artificial Sequence
  Synthetic
FGSLQLY

SEQ ID NO: 15819 - protein, 7 aa, Artificial Sequence
  Synthetic
YPRGLSS

SEQ ID NO: 15820 - protein, 7 aa, Artificial Sequence
  Synthetic
SAWAGSM

SEQ ID NO: 15821 - protein, 7 aa, Artificial Sequence
  Synthetic
RAVAQDW

SEQ ID NO: 15822 - protein, 7 aa, Artificial Sequence
  Synthetic
EAPGYSS

SEQ ID NO: 15823 - protein, 7 aa, Artificial Sequence
  Synthetic
RHVTDYA

SEQ ID NO: 15824 - protein, 7 aa, Artificial Sequence
  Synthetic
FGSLAGY

SEQ ID NO: 15825 - protein, 7 aa, Artificial Sequence
  Synthetic
LVQKGWS

SEQ ID NO: 15826 - protein, 7 aa, Artificial Sequence
  Synthetic
EEWKGAA

SEQ ID NO: 15827 - protein, 7 aa, Artificial Sequence
  Synthetic
MGVGFSS

SEQ ID NO: 15828 - protein, 7 aa, Artificial Sequence
  Synthetic
AVVGTIY

SEQ ID NO: 15829 - protein, 7 aa, Artificial Sequence
  Synthetic
WRNLGSA

SEQ ID NO: 15830 - protein, 7 aa, Artificial Sequence
  Synthetic
GGYNGMY

SEQ ID NO: 15831 - protein, 7 aa, Artificial Sequence
  Synthetic
DIGSSRW

SEQ ID NO: 15832 - protein, 7 aa, Artificial Sequence
  Synthetic
LPLRLVN

SEQ ID NO: 15833 - protein, 7 aa, Artificial Sequence
  Synthetic
FFHAGSS

SEQ ID NO: 15834 - protein, 7 aa, Artificial Sequence
  Synthetic
QVAGWSA

SEQ ID NO: 15835 - protein, 7 aa, Artificial Sequence
  Synthetic
LKPGFSS

SEQ ID NO: 15836 - protein, 7 aa, Artificial Sequence
  Synthetic
DLRLFSA

SEQ ID NO: 15837 - protein, 7 aa, Artificial Sequence
  Synthetic
SLTGGFR

SEQ ID NO: 15838 - protein, 7 aa, Artificial Sequence
  Synthetic
PFPGLAA

SEQ ID NO: 15839 - protein, 7 aa, Artificial Sequence
  Synthetic
HMNMYGT

SEQ ID NO: 15840 - protein, 7 aa, Artificial Sequence
  Synthetic
LERQSTT

SEQ ID NO: 15841 - protein, 7 aa, Artificial Sequence
  Synthetic
SAVRNGW

SEQ ID NO: 15842 - protein, 7 aa, Artificial Sequence
  Synthetic
VPSWDRA

SEQ ID NO: 15843 - protein, 7 aa, Artificial Sequence
  Synthetic
PSNPGFW

SEQ ID NO: 15844 - protein, 7 aa, Artificial Sequence
  Synthetic
ALYGTQW

SEQ ID NO: 15845 - protein, 7 aa, Artificial Sequence
  Synthetic
ARILGAA

SEQ ID NO: 15846 - protein, 7 aa, Artificial Sequence
  Synthetic
NQRLLPY

SEQ ID NO: 15847 - protein, 7 aa, Artificial Sequence
  Synthetic
DRSQWSQ

SEQ ID NO: 15848 - protein, 7 aa, Artificial Sequence
  Synthetic
GVWGLSG

SEQ ID NO: 15849 - protein, 7 aa, Artificial Sequence
  Synthetic
GADVGVW

SEQ ID NO: 15850 - protein, 7 aa, Artificial Sequence
  Synthetic
YQHERWN

SEQ ID NO: 15851 - protein, 7 aa, Artificial Sequence
  Synthetic
DPHTARW

SEQ ID NO: 15852 - protein, 7 aa, Artificial Sequence
  Synthetic
SFSMGSS

SEQ ID NO: 15853 - protein, 7 aa, Artificial Sequence
  Synthetic
THYEGST

SEQ ID NO: 15854 - protein, 7 aa, Artificial Sequence
  Synthetic
YVHLGSA

SEQ ID NO: 15855 - protein, 7 aa, Artificial Sequence
  Synthetic
EFLRGAA

SEQ ID NO: 15856 - protein, 7 aa, Artificial Sequence
  Synthetic
MLHAGTW

SEQ ID NO: 15857 - protein, 7 aa, Artificial Sequence
  Synthetic
VFLGSST

SEQ ID NO: 15858 - protein, 7 aa, Artificial Sequence
  Synthetic
GSSPGQW

SEQ ID NO: 15859 - protein, 7 aa, Artificial Sequence
  Synthetic
LWERGAQ

SEQ ID NO: 15860 - protein, 7 aa, Artificial Sequence
  Synthetic
CFVPAPA

SEQ ID NO: 15861 - protein, 7 aa, Artificial Sequence
  Synthetic
WEVSSGY

SEQ ID NO: 15862 - protein, 7 aa, Artificial Sequence
  Synthetic
MMSRFSA

SEQ ID NO: 15863 - protein, 7 aa, Artificial Sequence
  Synthetic
RAPGLSS

SEQ ID NO: 15864 - protein, 7 aa, Artificial Sequence
  Synthetic
GAIVGPW

SEQ ID NO: 15865 - protein, 7 aa, Artificial Sequence
  Synthetic
PLVSGRY

SEQ ID NO: 15866 - protein, 7 aa, Artificial Sequence
  Synthetic
PAAYAIG

SEQ ID NO: 15867 - protein, 7 aa, Artificial Sequence
  Synthetic
DVKLWSS

SEQ ID NO: 15868 - protein, 7 aa, Artificial Sequence
  Synthetic
IREWDRS

SEQ ID NO: 15869 - protein, 7 aa, Artificial Sequence
  Synthetic
LWPGSAS

SEQ ID NO: 15870 - protein, 7 aa, Artificial Sequence
  Synthetic
WNSLPHI

SEQ ID NO: 15871 - protein, 7 aa, Artificial Sequence
  Synthetic
AVFMGAA

SEQ ID NO: 15872 - protein, 7 aa, Artificial Sequence
  Synthetic
WRDRGSQ

SEQ ID NO: 15873 - protein, 7 aa, Artificial Sequence
  Synthetic
TLSYGSS

SEQ ID NO: 15874 - protein, 7 aa, Artificial Sequence
  Synthetic
DILSGYR

SEQ ID NO: 15875 - protein, 7 aa, Artificial Sequence
  Synthetic
NDHWKYG

SEQ ID NO: 15876 - protein, 7 aa, Artificial Sequence
  Synthetic
PGPGSSW

SEQ ID NO: 15877 - protein, 7 aa, Artificial Sequence
  Synthetic
LFAYGSV

SEQ ID NO: 15878 - protein, 7 aa, Artificial Sequence
  Synthetic
SPNSVRW

SEQ ID NO: 15879 - protein, 7 aa, Artificial Sequence
  Synthetic
TIWQGST

SEQ ID NO: 15880 - protein, 7 aa, Artificial Sequence
  Synthetic
ASLWHCI

SEQ ID NO: 15881 - protein, 7 aa, Artificial Sequence
  Synthetic
AVWAGSI

SEQ ID NO: 15882 - protein, 7 aa, Artificial Sequence
  Synthetic
AASFGSS

SEQ ID NO: 15883 - protein, 7 aa, Artificial Sequence
  Synthetic
GLGYDLR

SEQ ID NO: 15884 - protein, 7 aa, Artificial Sequence
  Synthetic
TYAAQAS

SEQ ID NO: 15885 - protein, 7 aa, Artificial Sequence
  Synthetic
HALHGSA

SEQ ID NO: 15886 - protein, 7 aa, Artificial Sequence
  Synthetic
RYAGDAV

SEQ ID NO: 15887 - protein, 7 aa, Artificial Sequence
  Synthetic
AFLGHSS

SEQ ID NO: 15888 - protein, 7 aa, Artificial Sequence
  Synthetic
NWPGTSS

SEQ ID NO: 15889 - protein, 7 aa, Artificial Sequence
  Synthetic
ETGRLTW

SEQ ID NO: 15890 - protein, 7 aa, Artificial Sequence
  Synthetic
MMYHGST

SEQ ID NO: 15891 - protein, 7 aa, Artificial Sequence
  Synthetic
SRQLGSS

SEQ ID NO: 15892 - protein, 7 aa, Artificial Sequence
  Synthetic
SERLYSA

SEQ ID NO: 15893 - protein, 7 aa, Artificial Sequence
  Synthetic
VANEARW

SEQ ID NO: 15894 - protein, 7 aa, Artificial Sequence
  Synthetic
RFGTPLA

SEQ ID NO: 15895 - protein, 7 aa, Artificial Sequence
  Synthetic
EASFGSS

SEQ ID NO: 15896 - protein, 7 aa, Artificial Sequence
  Synthetic
QPRYLGD

SEQ ID NO: 15897 - protein, 7 aa, Artificial Sequence
  Synthetic
DETPGRW

SEQ ID NO: 15898 - protein, 7 aa, Artificial Sequence
  Synthetic
SSPHGFY

SEQ ID NO: 15899 - protein, 7 aa, Artificial Sequence
  Synthetic
WMTNGSS

SEQ ID NO: 15900 - protein, 7 aa, Artificial Sequence
  Synthetic
LSGEGRW

SEQ ID NO: 15901 - protein, 7 aa, Artificial Sequence
  Synthetic
LQIGFST

SEQ ID NO: 15902 - protein, 7 aa, Artificial Sequence
  Synthetic
GHVYTSS

SEQ ID NO: 15903 - protein, 7 aa, Artificial Sequence
  Synthetic
LWHAAAS

SEQ ID NO: 15904 - protein, 7 aa, Artificial Sequence
  Synthetic
GVAFDLR

SEQ ID NO: 15905 - protein, 7 aa, Artificial Sequence
  Synthetic
REWAGST

SEQ ID NO: 15906 - protein, 7 aa, Artificial Sequence
  Synthetic
AHLSDFY

SEQ ID NO: 15907 - protein, 7 aa, Artificial Sequence
  Synthetic
KFFEGSS

SEQ ID NO: 15908 - protein, 7 aa, Artificial Sequence
  Synthetic
GVLDGFR

SEQ ID NO: 15909 - protein, 7 aa, Artificial Sequence
  Synthetic
SKLLYSA

SEQ ID NO: 15910 - protein, 7 aa, Artificial Sequence
  Synthetic
VYIGHSM

SEQ ID NO: 15911 - protein, 7 aa, Artificial Sequence
  Synthetic
EGPQWSS

SEQ ID NO: 15912 - protein, 7 aa, Artificial Sequence
  Synthetic
WAHSGST

SEQ ID NO: 15913 - protein, 7 aa, Artificial Sequence
  Synthetic
KSQPSYV

SEQ ID NO: 15914 - protein, 7 aa, Artificial Sequence
  Synthetic
SIYHRFD

SEQ ID NO: 15915 - protein, 7 aa, Artificial Sequence
  Synthetic
SFVGFSA

SEQ ID NO: 15916 - protein, 7 aa, Artificial Sequence
  Synthetic
HKALGST

SEQ ID NO: 15917 - protein, 7 aa, Artificial Sequence
  Synthetic
MMRMGSS

SEQ ID NO: 15918 - protein, 7 aa, Artificial Sequence
  Synthetic
RPYDLKN

SEQ ID NO: 15919 - protein, 7 aa, Artificial Sequence
  Synthetic
LYLGGAT

SEQ ID NO: 15920 - protein, 7 aa, Artificial Sequence
  Synthetic
RYSLGGE

SEQ ID NO: 15921 - protein, 7 aa, Artificial Sequence
  Synthetic
RTSMHDW

SEQ ID NO: 15922 - protein, 7 aa, Artificial Sequence
  Synthetic
TKVQWSS

SEQ ID NO: 15923 - protein, 7 aa, Artificial Sequence
  Synthetic
YRVLPQV

SEQ ID NO: 15924 - protein, 7 aa, Artificial Sequence
  Synthetic
GHTPNWN

SEQ ID NO: 15925 - protein, 7 aa, Artificial Sequence
  Synthetic
RPAIQER

SEQ ID NO: 15926 - protein, 7 aa, Artificial Sequence
  Synthetic
YSHGYSQ

SEQ ID NO: 15927 - protein, 7 aa, Artificial Sequence
  Synthetic
VMLGYSA

SEQ ID NO: 15928 - protein, 7 aa, Artificial Sequence
  Synthetic
LMTKFSS

SEQ ID NO: 15929 - protein, 7 aa, Artificial Sequence
  Synthetic
FSDYSTW

SEQ ID NO: 15930 - protein, 7 aa, Artificial Sequence
  Synthetic
QYENHRY

SEQ ID NO: 15931 - protein, 7 aa, Artificial Sequence
  Synthetic
WSAYREG

SEQ ID NO: 15932 - protein, 7 aa, Artificial Sequence
  Synthetic
MFPGLSS

SEQ ID NO: 15933 - protein, 7 aa, Artificial Sequence
  Synthetic
MAGSAYW

SEQ ID NO: 15934 - protein, 7 aa, Artificial Sequence
  Synthetic
CGKTCWE

SEQ ID NO: 15935 - protein, 7 aa, Artificial Sequence
  Synthetic
MAYLGSQ

SEQ ID NO: 15936 - protein, 7 aa, Artificial Sequence
  Synthetic
LLKGWAS

SEQ ID NO: 15937 - protein, 7 aa, Artificial Sequence
  Synthetic
YHIGYSA

SEQ ID NO: 15938 - protein, 7 aa, Artificial Sequence
  Synthetic
LVSGWAQ

SEQ ID NO: 15939 - protein, 7 aa, Artificial Sequence
  Synthetic
PSPGGFW

SEQ ID NO: 15940 - protein, 7 aa, Artificial Sequence
  Synthetic
EWRMGSS

SEQ ID NO: 15941 - protein, 7 aa, Artificial Sequence
  Synthetic
MIQRGSA

SEQ ID NO: 15942 - protein, 7 aa, Artificial Sequence
  Synthetic
TLTGGFR

SEQ ID NO: 15943 - protein, 7 aa, Artificial Sequence
  Synthetic
SLIGMAQ

SEQ ID NO: 15944 - protein, 7 aa, Artificial Sequence
  Synthetic
GDWSRPV

SEQ ID NO: 15945 - protein, 7 aa, Artificial Sequence
  Synthetic
VREHGSA

SEQ ID NO: 15946 - protein, 7 aa, Artificial Sequence
  Synthetic
LVRLGSA

SEQ ID NO: 15947 - protein, 7 aa, Artificial Sequence
  Synthetic
GFPGFST

SEQ ID NO: 15948 - protein, 7 aa, Artificial Sequence
  Synthetic
IGHGYAQ

SEQ ID NO: 15949 - protein, 7 aa, Artificial Sequence
  Synthetic
QYHNYSA

SEQ ID NO: 15950 - protein, 7 aa, Artificial Sequence
  Synthetic
EWFNGST

SEQ ID NO: 15951 - protein, 7 aa, Artificial Sequence
  Synthetic
AQWQGAA

SEQ ID NO: 15952 - protein, 7 aa, Artificial Sequence
  Synthetic
TTRGYAS

SEQ ID NO: 15953 - protein, 7 aa, Artificial Sequence
  Synthetic
AGVGGHW

SEQ ID NO: 15954 - protein, 7 aa, Artificial Sequence
  Synthetic
TYHLGAS

SEQ ID NO: 15955 - protein, 7 aa, Artificial Sequence
  Synthetic
DSFSARY

SEQ ID NO: 15956 - protein, 7 aa, Artificial Sequence
  Synthetic
SYVHGSS

SEQ ID NO: 15957 - protein, 7 aa, Artificial Sequence
  Synthetic
NVQYGYA

SEQ ID NO: 15958 - protein, 7 aa, Artificial Sequence
  Synthetic
IHNKSGH

SEQ ID NO: 15959 - protein, 7 aa, Artificial Sequence
  Synthetic
WGMVASH

SEQ ID NO: 15960 - protein, 7 aa, Artificial Sequence
  Synthetic
EMFRGST

SEQ ID NO: 15961 - protein, 7 aa, Artificial Sequence
  Synthetic
AFSLSGY

SEQ ID NO: 15962 - protein, 7 aa, Artificial Sequence
  Synthetic
YAQWQQH

SEQ ID NO: 15963 - protein, 7 aa, Artificial Sequence
  Synthetic
DHRLIGY

SEQ ID NO: 15964 - protein, 7 aa, Artificial Sequence
  Synthetic
DAWRGSV

SEQ ID NO: 15965 - protein, 7 aa, Artificial Sequence
  Synthetic
REYGSVY

SEQ ID NO: 15966 - protein, 7 aa, Artificial Sequence
  Synthetic
PRIGVSQ

SEQ ID NO: 15967 - protein, 7 aa, Artificial Sequence
  Synthetic
TKAGYGY

SEQ ID NO: 15968 - protein, 7 aa, Artificial Sequence
  Synthetic
WTATQGW

SEQ ID NO: 15969 - protein, 7 aa, Artificial Sequence
  Synthetic
WGLLTTA

SEQ ID NO: 15970 - protein, 7 aa, Artificial Sequence
  Synthetic
LTYSLAH

SEQ ID NO: 15971 - protein, 7 aa, Artificial Sequence
  Synthetic
LTYSNAL

SEQ ID NO: 15972 - protein, 7 aa, Artificial Sequence
  Synthetic
PDPWARQ

SEQ ID NO: 15973 - protein, 7 aa, Artificial Sequence
  Synthetic
SAYRLPN

SEQ ID NO: 15974 - protein, 7 aa, Artificial Sequence
  Synthetic
FHLPFPG

SEQ ID NO: 15975 - protein, 7 aa, Artificial Sequence
  Synthetic
LRVNYAS

SEQ ID NO: 15976 - protein, 7 aa, Artificial Sequence
  Synthetic
RFIAESA

SEQ ID NO: 15977 - protein, 7 aa, Artificial Sequence
  Synthetic
FELLKGY

SEQ ID NO: 15978 - protein, 7 aa, Artificial Sequence
  Synthetic
SRSGWSA

SEQ ID NO: 15979 - protein, 7 aa, Artificial Sequence
  Synthetic
HYVGSAS

SEQ ID NO: 15980 - protein, 7 aa, Artificial Sequence
  Synthetic
GFANPNR

SEQ ID NO: 15981 - protein, 7 aa, Artificial Sequence
  Synthetic
SNTFDLR

SEQ ID NO: 15982 - protein, 7 aa, Artificial Sequence
  Synthetic
GLAARWD

SEQ ID NO: 15983 - protein, 7 aa, Artificial Sequence
  Synthetic
ERYMGAA

SEQ ID NO: 15984 - protein, 7 aa, Artificial Sequence
  Synthetic
WHSLGTA

SEQ ID NO: 15985 - protein, 7 aa, Artificial Sequence
  Synthetic
HRPEGRS

SEQ ID NO: 15986 - protein, 7 aa, Artificial Sequence
  Synthetic
SPVYGYN

SEQ ID NO: 15987 - protein, 7 aa, Artificial Sequence
  Synthetic
SREGYST

SEQ ID NO: 15988 - protein, 7 aa, Artificial Sequence
  Synthetic
VATEVRW

SEQ ID NO: 15989 - protein, 7 aa, Artificial Sequence
  Synthetic
SPGLDLF

SEQ ID NO: 15990 - protein, 7 aa, Artificial Sequence
  Synthetic
KEVGHIY

SEQ ID NO: 15991 - protein, 7 aa, Artificial Sequence
  Synthetic
YSEWRYA

SEQ ID NO: 15992 - protein, 7 aa, Artificial Sequence
  Synthetic
NRMHGSS

SEQ ID NO: 15993 - protein, 7 aa, Artificial Sequence
  Synthetic
YGALSSW

SEQ ID NO: 15994 - protein, 7 aa, Artificial Sequence
  Synthetic
SGPNWSH

SEQ ID NO: 15995 - protein, 7 aa, Artificial Sequence
  Synthetic
LRIGLSS

SEQ ID NO: 15996 - protein, 7 aa, Artificial Sequence
  Synthetic
WRLNGST

SEQ ID NO: 15997 - protein, 7 aa, Artificial Sequence
  Synthetic
GATMAHY

SEQ ID NO: 15998 - protein, 7 aa, Artificial Sequence
  Synthetic
LEMGWAS

SEQ ID NO: 15999 - protein, 7 aa, Artificial Sequence
  Synthetic
KYPGYAA

SEQ ID NO: 16000 - protein, 7 aa, Artificial Sequence
  Synthetic
TVVYGSS

SEQ ID NO: 16001 - protein, 7 aa, Artificial Sequence
  Synthetic
WGAGGSQ

SEQ ID NO: 16002 - protein, 7 aa, Artificial Sequence
  Synthetic
TVQYMAS

SEQ ID NO: 16003 - protein, 7 aa, Artificial Sequence
  Synthetic
WSAGYNL

SEQ ID NO: 16004 - protein, 7 aa, Artificial Sequence
  Synthetic
FQHLGSS

SEQ ID NO: 16005 - protein, 7 aa, Artificial Sequence
  Synthetic
SQRWEAG

SEQ ID NO: 16006 - protein, 7 aa, Artificial Sequence
  Synthetic
PRMSFSA

SEQ ID NO: 16007 - protein, 7 aa, Artificial Sequence
  Synthetic
QISLTPI

SEQ ID NO: 16008 - protein, 7 aa, Artificial Sequence
  Synthetic
LKYNGSL

SEQ ID NO: 16009 - protein, 7 aa, Artificial Sequence
  Synthetic
LWHAGSQ

SEQ ID NO: 16010 - protein, 7 aa, Artificial Sequence
  Synthetic
SPLKGWS

SEQ ID NO: 16011 - protein, 7 aa, Artificial Sequence
  Synthetic
GIDRGVW

SEQ ID NO: 16012 - protein, 7 aa, Artificial Sequence
  Synthetic
PSNFAIH

SEQ ID NO: 16013 - protein, 7 aa, Artificial Sequence
  Synthetic
MDHPGVW

SEQ ID NO: 16014 - protein, 7 aa, Artificial Sequence
  Synthetic
FKPWVFE

SEQ ID NO: 16015 - protein, 7 aa, Artificial Sequence
  Synthetic
QRDTDYW

SEQ ID NO: 16016 - protein, 7 aa, Artificial Sequence
  Synthetic
NDRPVAR

SEQ ID NO: 16017 - protein, 7 aa, Artificial Sequence
  Synthetic
STYHGYA

SEQ ID NO: 16018 - protein, 7 aa, Artificial Sequence
  Synthetic
MVVHGSA

SEQ ID NO: 16019 - protein, 7 aa, Artificial Sequence
  Synthetic
RPFEIGL

SEQ ID NO: 16020 - protein, 7 aa, Artificial Sequence
  Synthetic
QVVGSLW

SEQ ID NO: 16021 - protein, 7 aa, Artificial Sequence
  Synthetic
HSTLGYS

SEQ ID NO: 16022 - protein, 7 aa, Artificial Sequence
  Synthetic
WSPYSVN

SEQ ID NO: 16023 - protein, 7 aa, Artificial Sequence
  Synthetic
WFISGSA

SEQ ID NO: 16024 - protein, 7 aa, Artificial Sequence
  Synthetic
DRTASRA

SEQ ID NO: 16025 - protein, 7 aa, Artificial Sequence
  Synthetic
SYPGGAA

SEQ ID NO: 16026 - protein, 7 aa, Artificial Sequence
  Synthetic
GEFNDYR

SEQ ID NO: 16027 - protein, 7 aa, Artificial Sequence
  Synthetic
GEPLGRW

SEQ ID NO: 16028 - protein, 7 aa, Artificial Sequence
  Synthetic
EYRGAAS

SEQ ID NO: 16029 - protein, 7 aa, Artificial Sequence
  Synthetic
RDRGTVY

SEQ ID NO: 16030 - protein, 7 aa, Artificial Sequence
  Synthetic
RYTGMSS

SEQ ID NO: 16031 - protein, 7 aa, Artificial Sequence
  Synthetic
AQPGWSS

SEQ ID NO: 16032 - protein, 7 aa, Artificial Sequence
  Synthetic
GQHGGVR

SEQ ID NO: 16033 - protein, 7 aa, Artificial Sequence
  Synthetic
ASWGNAQ

SEQ ID NO: 16034 - protein, 7 aa, Artificial Sequence
  Synthetic
IWVGGAA

SEQ ID NO: 16035 - protein, 7 aa, Artificial Sequence
  Synthetic
MFVHGST

SEQ ID NO: 16036 - protein, 7 aa, Artificial Sequence
  Synthetic
ERLLGSS

SEQ ID NO: 16037 - protein, 7 aa, Artificial Sequence
  Synthetic
AVWAGSS

SEQ ID NO: 16038 - protein, 7 aa, Artificial Sequence
  Synthetic
PFPSGSW

SEQ ID NO: 16039 - protein, 7 aa, Artificial Sequence
  Synthetic
YYLPEGG

SEQ ID NO: 16040 - protein, 7 aa, Artificial Sequence
  Synthetic
PAWGTTG

SEQ ID NO: 16041 - protein, 7 aa, Artificial Sequence
  Synthetic
LSFGMSQ

SEQ ID NO: 16042 - protein, 7 aa, Artificial Sequence
  Synthetic
RPVGTIY

SEQ ID NO: 16043 - protein, 7 aa, Artificial Sequence
  Synthetic
QSWGSAS

SEQ ID NO: 16044 - protein, 7 aa, Artificial Sequence
  Synthetic
DWARGAS

SEQ ID NO: 16045 - protein, 7 aa, Artificial Sequence
  Synthetic
FGTGLAQ

SEQ ID NO: 16046 - protein, 7 aa, Artificial Sequence
  Synthetic
PEKSHGW

SEQ ID NO: 16047 - protein, 7 aa, Artificial Sequence
  Synthetic
SKPGNWA

SEQ ID NO: 16048 - protein, 7 aa, Artificial Sequence
  Synthetic
SRQGYAV

SEQ ID NO: 16049 - protein, 7 aa, Artificial Sequence
  Synthetic
QMYMGSL

SEQ ID NO: 16050 - protein, 7 aa, Artificial Sequence
  Synthetic
ANDFSHW

SEQ ID NO: 16051 - protein, 7 aa, Artificial Sequence
  Synthetic
VGYSGYH

SEQ ID NO: 16052 - protein, 7 aa, Artificial Sequence
  Synthetic
ERALGSS

SEQ ID NO: 16053 - protein, 7 aa, Artificial Sequence
  Synthetic
APLRLVN

SEQ ID NO: 16054 - protein, 7 aa, Artificial Sequence
  Synthetic
REYDLRV

SEQ ID NO: 16055 - protein, 7 aa, Artificial Sequence
  Synthetic
IVKGYSA

SEQ ID NO: 16056 - protein, 7 aa, Artificial Sequence
  Synthetic
SETYRGW

SEQ ID NO: 16057 - protein, 7 aa, Artificial Sequence
  Synthetic
DRWIGSA

SEQ ID NO: 16058 - protein, 7 aa, Artificial Sequence
  Synthetic
DEMTNRW

SEQ ID NO: 16059 - protein, 7 aa, Artificial Sequence
  Synthetic
RSHGQAQ

SEQ ID NO: 16060 - protein, 7 aa, Artificial Sequence
  Synthetic
MKEGWAQ

SEQ ID NO: 16061 - protein, 7 aa, Artificial Sequence
  Synthetic
DTYDGRW

SEQ ID NO: 16062 - protein, 7 aa, Artificial Sequence
  Synthetic
NDSRFAY

SEQ ID NO: 16063 - protein, 7 aa, Artificial Sequence
  Synthetic
LHYNGAS

SEQ ID NO: 16064 - protein, 7 aa, Artificial Sequence
  Synthetic
ERAYDRA

SEQ ID NO: 16065 - protein, 7 aa, Artificial Sequence
  Synthetic
GPIRLVN

SEQ ID NO: 16066 - protein, 7 aa, Artificial Sequence
  Synthetic
LVYGGSV

SEQ ID NO: 16067 - protein, 7 aa, Artificial Sequence
  Synthetic
GLEISRW

SEQ ID NO: 16068 - protein, 7 aa, Artificial Sequence
  Synthetic
GLRMWSE

SEQ ID NO: 16069 - protein, 7 aa, Artificial Sequence
  Synthetic
WKSGGSS

SEQ ID NO: 16070 - protein, 7 aa, Artificial Sequence
  Synthetic
YVSLDRF

SEQ ID NO: 16071 - protein, 7 aa, Artificial Sequence
  Synthetic
PRVTGAW

SEQ ID NO: 16072 - protein, 7 aa, Artificial Sequence
  Synthetic
QYLLGSA

SEQ ID NO: 16073 - protein, 7 aa, Artificial Sequence
  Synthetic
WGSLESL

SEQ ID NO: 16074 - protein, 7 aa, Artificial Sequence
  Synthetic
PMAGGYY

SEQ ID NO: 16075 - protein, 7 aa, Artificial Sequence
  Synthetic
PNDRGPW

SEQ ID NO: 16076 - protein, 7 aa, Artificial Sequence
  Synthetic
LREQQVR

SEQ ID NO: 16077 - protein, 7 aa, Artificial Sequence
  Synthetic
AWPGLSS

SEQ ID NO: 16078 - protein, 7 aa, Artificial Sequence
  Synthetic
LSYSMGL

SEQ ID NO: 16079 - protein, 7 aa, Artificial Sequence
  Synthetic
VSTWRAD

SEQ ID NO: 16080 - protein, 7 aa, Artificial Sequence
  Synthetic
KAYDLRV

SEQ ID NO: 16081 - protein, 7 aa, Artificial Sequence
  Synthetic
ELIGNGW

SEQ ID NO: 16082 - protein, 7 aa, Artificial Sequence
  Synthetic
FSRYPEL

SEQ ID NO: 16083 - protein, 7 aa, Artificial Sequence
  Synthetic
VAAGWSQ

SEQ ID NO: 16084 - protein, 7 aa, Artificial Sequence
  Synthetic
ERYTEHW

SEQ ID NO: 16085 - protein, 7 aa, Artificial Sequence
  Synthetic
LFPGAAQ

SEQ ID NO: 16086 - protein, 7 aa, Artificial Sequence
  Synthetic
PYPGGTW

SEQ ID NO: 16087 - protein, 7 aa, Artificial Sequence
  Synthetic
WEPLPRI

SEQ ID NO: 16088 - protein, 7 aa, Artificial Sequence
  Synthetic
VMKGYSA

SEQ ID NO: 16089 - protein, 7 aa, Artificial Sequence
  Synthetic
EVHASRW

SEQ ID NO: 16090 - protein, 7 aa, Artificial Sequence
  Synthetic
LQPGMSQ

SEQ ID NO: 16091 - protein, 7 aa, Artificial Sequence
  Synthetic
KPYDLRG

SEQ ID NO: 16092 - protein, 7 aa, Artificial Sequence
  Synthetic
WVLPHMG

SEQ ID NO: 16093 - protein, 7 aa, Artificial Sequence
  Synthetic
SRSGMSQ

SEQ ID NO: 16094 - protein, 7 aa, Artificial Sequence
  Synthetic
GEDRARY

SEQ ID NO: 16095 - protein, 7 aa, Artificial Sequence
  Synthetic
VVSGWSS

SEQ ID NO: 16096 - protein, 7 aa, Artificial Sequence
  Synthetic
YVSLPVI

SEQ ID NO: 16097 - protein, 7 aa, Artificial Sequence
  Synthetic
LVLHRDI

SEQ ID NO: 16098 - protein, 7 aa, Artificial Sequence
  Synthetic
KPFSLER

SEQ ID NO: 16099 - protein, 7 aa, Artificial Sequence
  Synthetic
TDWGHAQ

SEQ ID NO: 16100 - protein, 7 aa, Artificial Sequence
  Synthetic
AYSGQSS

SEQ ID NO: 16101 - protein, 7 aa, Artificial Sequence
  Synthetic
VIWQGSV

SEQ ID NO: 16102 - protein, 7 aa, Artificial Sequence
  Synthetic
KSMGTVY

SEQ ID NO: 16103 - protein, 7 aa, Artificial Sequence
  Synthetic
VSYSYST

SEQ ID NO: 16104 - protein, 7 aa, Artificial Sequence
  Synthetic
PSLGWSS

SEQ ID NO: 16105 - protein, 7 aa, Artificial Sequence
  Synthetic
VVWGGGP

SEQ ID NO: 16106 - protein, 7 aa, Artificial Sequence
  Synthetic
AVRLGSA

SEQ ID NO: 16107 - protein, 7 aa, Artificial Sequence
  Synthetic
KPMSGAW

SEQ ID NO: 16108 - protein, 7 aa, Artificial Sequence
  Synthetic
WPELKRN

SEQ ID NO: 16109 - protein, 7 aa, Artificial Sequence
  Synthetic
LKYGLSS

SEQ ID NO: 16110 - protein, 7 aa, Artificial Sequence
  Synthetic
FRLNGHS

SEQ ID NO: 16111 - protein, 7 aa, Artificial Sequence
  Synthetic
LHFGGAM

SEQ ID NO: 16112 - protein, 7 aa, Artificial Sequence
  Synthetic
ENNNFRW

SEQ ID NO: 16113 - protein, 7 aa, Artificial Sequence
  Synthetic
AHAAGTR

SEQ ID NO: 16114 - protein, 7 aa, Artificial Sequence
  Synthetic
WGSLAAV

SEQ ID NO: 16115 - protein, 7 aa, Artificial Sequence
  Synthetic
LDSMFSS

SEQ ID NO: 16116 - protein, 7 aa, Artificial Sequence
  Synthetic
REHVGHW

SEQ ID NO: 16117 - protein, 7 aa, Artificial Sequence
  Synthetic
GWGLGLS

SEQ ID NO: 16118 - protein, 7 aa, Artificial Sequence
  Synthetic
LVNSGFW

SEQ ID NO: 16119 - protein, 7 aa, Artificial Sequence
  Synthetic
WSHGEGR

SEQ ID NO: 16120 - protein, 7 aa, Artificial Sequence
  Synthetic
KHPAAIY

SEQ ID NO: 16121 - protein, 7 aa, Artificial Sequence
  Synthetic
LYHAQST

SEQ ID NO: 16122 - protein, 7 aa, Artificial Sequence
  Synthetic
AGVTRWD

SEQ ID NO: 16123 - protein, 7 aa, Artificial Sequence
  Synthetic
YASWVSP

SEQ ID NO: 16124 - protein, 7 aa, Artificial Sequence
  Synthetic
VPSWSIN

SEQ ID NO: 16125 - protein, 7 aa, Artificial Sequence
  Synthetic
MLGDARW

SEQ ID NO: 16126 - protein, 7 aa, Artificial Sequence
  Synthetic
HVWGEIA

SEQ ID NO: 16127 - protein, 7 aa, Artificial Sequence
  Synthetic
VMAWDRV

SEQ ID NO: 16128 - protein, 7 aa, Artificial Sequence
  Synthetic
YHVGWSA

SEQ ID NO: 16129 - protein, 7 aa, Artificial Sequence
  Synthetic
DRYLGAS

SEQ ID NO: 16130 - protein, 7 aa, Artificial Sequence
  Synthetic
VEWRGSA

SEQ ID NO: 16131 - protein, 7 aa, Artificial Sequence
  Synthetic
LRQLTFG

SEQ ID NO: 16132 - protein, 7 aa, Artificial Sequence
  Synthetic
NQYLGSS

SEQ ID NO: 16133 - protein, 7 aa, Artificial Sequence
  Synthetic
LGSLFSS

SEQ ID NO: 16134 - protein, 7 aa, Artificial Sequence
  Synthetic
DAKYMAS

SEQ ID NO: 16135 - protein, 7 aa, Artificial Sequence
  Synthetic
TGEIGRW

SEQ ID NO: 16136 - protein, 7 aa, Artificial Sequence
  Synthetic
NEPYRGY

SEQ ID NO: 16137 - protein, 7 aa, Artificial Sequence
  Synthetic
LQSGWSV

SEQ ID NO: 16138 - protein, 7 aa, Artificial Sequence
  Synthetic
FENAGRW

SEQ ID NO: 16139 - protein, 7 aa, Artificial Sequence
  Synthetic
KSAGSIY

SEQ ID NO: 16140 - protein, 7 aa, Artificial Sequence
  Synthetic
GAYEGMW

SEQ ID NO: 16141 - protein, 7 aa, Artificial Sequence
  Synthetic
LRAYAHD

SEQ ID NO: 16142 - protein, 7 aa, Artificial Sequence
  Synthetic
AFYGAAA

SEQ ID NO: 16143 - protein, 7 aa, Artificial Sequence
  Synthetic
ASKGSIY

SEQ ID NO: 16144 - protein, 7 aa, Artificial Sequence
  Synthetic
VFALRGL

SEQ ID NO: 16145 - protein, 7 aa, Artificial Sequence
  Synthetic
TYEWMAS

SEQ ID NO: 16146 - protein, 7 aa, Artificial Sequence
  Synthetic
GLLEGFR

SEQ ID NO: 16147 - protein, 7 aa, Artificial Sequence
  Synthetic
RMGGSHG

SEQ ID NO: 16148 - protein, 7 aa, Artificial Sequence
  Synthetic
KTFYPAG

SEQ ID NO: 16149 - protein, 7 aa, Artificial Sequence
  Synthetic
LRVFESS

SEQ ID NO: 16150 - protein, 7 aa, Artificial Sequence
  Synthetic
ARSPGPW

SEQ ID NO: 16151 - protein, 7 aa, Artificial Sequence
  Synthetic
MTGHDYW

SEQ ID NO: 16152 - protein, 7 aa, Artificial Sequence
  Synthetic
PAGSAIW

SEQ ID NO: 16153 - protein, 7 aa, Artificial Sequence
  Synthetic
FHVTNTY

SEQ ID NO: 16154 - protein, 7 aa, Artificial Sequence
  Synthetic
GIYAGSW

SEQ ID NO: 16155 - protein, 7 aa, Artificial Sequence
  Synthetic
LQEGWSH

SEQ ID NO: 16156 - protein, 7 aa, Artificial Sequence
  Synthetic
GMTPGKW

SEQ ID NO: 16157 - protein, 7 aa, Artificial Sequence
  Synthetic
VAANWSS

SEQ ID NO: 16158 - protein, 7 aa, Artificial Sequence
  Synthetic
KAIGMSQ

SEQ ID NO: 16159 - protein, 7 aa, Artificial Sequence
  Synthetic
PDRLGPW

SEQ ID NO: 16160 - protein, 7 aa, Artificial Sequence
  Synthetic
RDVGTVY

SEQ ID NO: 16161 - protein, 7 aa, Artificial Sequence
  Synthetic
NEVTARY

SEQ ID NO: 16162 - protein, 7 aa, Artificial Sequence
  Synthetic
EMFKRLP

SEQ ID NO: 16163 - protein, 7 aa, Artificial Sequence
  Synthetic
LPGEVRW

SEQ ID NO: 16164 - protein, 7 aa, Artificial Sequence
  Synthetic
WGSLSSI

SEQ ID NO: 16165 - protein, 7 aa, Artificial Sequence
  Synthetic
KDGPPHR

SEQ ID NO: 16166 - protein, 7 aa, Artificial Sequence
  Synthetic
MQPGWAS

SEQ ID NO: 16167 - protein, 7 aa, Artificial Sequence
  Synthetic
VFHGGAA

SEQ ID NO: 16168 - protein, 7 aa, Artificial Sequence
  Synthetic
GSDHARY

SEQ ID NO: 16169 - protein, 7 aa, Artificial Sequence
  Synthetic
MQVGWSS

SEQ ID NO: 16170 - protein, 7 aa, Artificial Sequence
  Synthetic
DRSGFSW

SEQ ID NO: 16171 - protein, 7 aa, Artificial Sequence
  Synthetic
WSVESGW

SEQ ID NO: 16172 - protein, 7 aa, Artificial Sequence
  Synthetic
QYTLGSA

SEQ ID NO: 16173 - protein, 7 aa, Artificial Sequence
  Synthetic
GGSEGRW

SEQ ID NO: 16174 - protein, 7 aa, Artificial Sequence
  Synthetic
LWDNKLA

SEQ ID NO: 16175 - protein, 7 aa, Artificial Sequence
  Synthetic
VAAGWSS

SEQ ID NO: 16176 - protein, 7 aa, Artificial Sequence
  Synthetic
GGLFMAS

SEQ ID NO: 16177 - protein, 7 aa, Artificial Sequence
  Synthetic
FIEYART

SEQ ID NO: 16178 - protein, 7 aa, Artificial Sequence
  Synthetic
ERSYGSA

SEQ ID NO: 16179 - protein, 7 aa, Artificial Sequence
  Synthetic
RYVGSSS

SEQ ID NO: 16180 - protein, 7 aa, Artificial Sequence
  Synthetic
IIRASWD

SEQ ID NO: 16181 - protein, 7 aa, Artificial Sequence
  Synthetic
PEGVIRW

SEQ ID NO: 16182 - protein, 7 aa, Artificial Sequence
  Synthetic
GVPRELW

SEQ ID NO: 16183 - protein, 7 aa, Artificial Sequence
  Synthetic
DVTWMAS

SEQ ID NO: 16184 - protein, 7 aa, Artificial Sequence
  Synthetic
LYRGYEL

SEQ ID NO: 16185 - protein, 7 aa, Artificial Sequence
  Synthetic
ERYSGSQ

SEQ ID NO: 16186 - protein, 7 aa, Artificial Sequence
  Synthetic
MTTGWSS

SEQ ID NO: 16187 - protein, 7 aa, Artificial Sequence
  Synthetic
AIFMGSA

SEQ ID NO: 16188 - protein, 7 aa, Artificial Sequence
  Synthetic
EIPFFSA

SEQ ID NO: 16189 - protein, 7 aa, Artificial Sequence
  Synthetic
MNERPIR

SEQ ID NO: 16190 - protein, 7 aa, Artificial Sequence
  Synthetic
TGSPGKW

SEQ ID NO: 16191 - protein, 7 aa, Artificial Sequence
  Synthetic
SRLLMSS

SEQ ID NO: 16192 - protein, 7 aa, Artificial Sequence
  Synthetic
TSVGWAS

SEQ ID NO: 16193 - protein, 7 aa, Artificial Sequence
  Synthetic
KYPGDRA

SEQ ID NO: 16194 - protein, 7 aa, Artificial Sequence
  Synthetic
YDRPPYG

SEQ ID NO: 16195 - protein, 7 aa, Artificial Sequence
  Synthetic
ISWQGSS

SEQ ID NO: 16196 - protein, 7 aa, Artificial Sequence
  Synthetic
DWGRGSS

SEQ ID NO: 16197 - protein, 7 aa, Artificial Sequence
  Synthetic
GVWGIVE

SEQ ID NO: 16198 - protein, 7 aa, Artificial Sequence
  Synthetic
WGMPSHG

SEQ ID NO: 16199 - protein, 7 aa, Artificial Sequence
  Synthetic
GDWRGPG

SEQ ID NO: 16200 - protein, 7 aa, Artificial Sequence
  Synthetic
LFPGLST

SEQ ID NO: 16201 - protein, 7 aa, Artificial Sequence
  Synthetic
ITRLSAP

SEQ ID NO: 16202 - protein, 7 aa, Artificial Sequence
  Synthetic
GTDTGRW

SEQ ID NO: 16203 - protein, 7 aa, Artificial Sequence
  Synthetic
EPPGWSH

SEQ ID NO: 16204 - protein, 7 aa, Artificial Sequence
  Synthetic
GYLPRPG

SEQ ID NO: 16205 - protein, 7 aa, Artificial Sequence
  Synthetic
TIKTQYY

SEQ ID NO: 16206 - protein, 7 aa, Artificial Sequence
  Synthetic
EKTHFSA

SEQ ID NO: 16207 - protein, 7 aa, Artificial Sequence
  Synthetic
LLGRGFS

SEQ ID NO: 16208 - protein, 7 aa, Artificial Sequence
  Synthetic
LAGSGVW

SEQ ID NO: 16209 - protein, 7 aa, Artificial Sequence
  Synthetic
PPSSHLW

SEQ ID NO: 16210 - protein, 7 aa, Artificial Sequence
  Synthetic
ERILGAA

SEQ ID NO: 16211 - protein, 7 aa, Artificial Sequence
  Synthetic
EVRLGSA

SEQ ID NO: 16212 - protein, 7 aa, Artificial Sequence
  Synthetic
WGQPAHE

SEQ ID NO: 16213 - protein, 7 aa, Artificial Sequence
  Synthetic
LRSMGST

SEQ ID NO: 16214 - protein, 7 aa, Artificial Sequence
  Synthetic
GVGVWGA

SEQ ID NO: 16215 - protein, 7 aa, Artificial Sequence
  Synthetic
VHEWAIV

SEQ ID NO: 16216 - protein, 7 aa, Artificial Sequence
  Synthetic
VVGSGIW

SEQ ID NO: 16217 - protein, 7 aa, Artificial Sequence
  Synthetic
VRWEGAS

SEQ ID NO: 16218 - protein, 7 aa, Artificial Sequence
  Synthetic
LPFRDFH

SEQ ID NO: 16219 - protein, 7 aa, Artificial Sequence
  Synthetic
EPARGYW

SEQ ID NO: 16220 - protein, 7 aa, Artificial Sequence
  Synthetic
TGPFLSS

SEQ ID NO: 16221 - protein, 7 aa, Artificial Sequence
  Synthetic
AWPSGST

SEQ ID NO: 16222 - protein, 7 aa, Artificial Sequence
  Synthetic
EHRYLSS

SEQ ID NO: 16223 - protein, 7 aa, Artificial Sequence
  Synthetic
RFAGSSS

SEQ ID NO: 16224 - protein, 7 aa, Artificial Sequence
  Synthetic
YGVLAPH

SEQ ID NO: 16225 - protein, 7 aa, Artificial Sequence
  Synthetic
LRVLGSS

SEQ ID NO: 16226 - protein, 7 aa, Artificial Sequence
  Synthetic
PVMTSSW

SEQ ID NO: 16227 - protein, 7 aa, Artificial Sequence
  Synthetic
IRALGSA

SEQ ID NO: 16228 - protein, 7 aa, Artificial Sequence
  Synthetic
GSYDTRW

SEQ ID NO: 16229 - protein, 7 aa, Artificial Sequence
  Synthetic
ATSSSYW

SEQ ID NO: 16230 - protein, 7 aa, Artificial Sequence
  Synthetic
WVTHGFN

SEQ ID NO: 16231 - protein, 7 aa, Artificial Sequence
  Synthetic
GDSRFSY

SEQ ID NO: 16232 - protein, 7 aa, Artificial Sequence
  Synthetic
VENDHRW

SEQ ID NO: 16233 - protein, 7 aa, Artificial Sequence
  Synthetic
HDYGFSQ

SEQ ID NO: 16234 - protein, 7 aa, Artificial Sequence
  Synthetic
LMNSGIW

SEQ ID NO: 16235 - protein, 7 aa, Artificial Sequence
  Synthetic
VLVGRSG

SEQ ID NO: 16236 - protein, 7 aa, Artificial Sequence
  Synthetic
TRVGFSH

SEQ ID NO: 16237 - protein, 7 aa, Artificial Sequence
  Synthetic
GAFRDLL

SEQ ID NO: 16238 - protein, 7 aa, Artificial Sequence
  Synthetic
MGRGLST

SEQ ID NO: 16239 - protein, 7 aa, Artificial Sequence
  Synthetic
LYNVVHN

SEQ ID NO: 16240 - protein, 7 aa, Artificial Sequence
  Synthetic
RFHGDAS

SEQ ID NO: 16241 - protein, 7 aa, Artificial Sequence
  Synthetic
VVPASWS

SEQ ID NO: 16242 - protein, 7 aa, Artificial Sequence
  Synthetic
VGSLQRF

SEQ ID NO: 16243 - protein, 7 aa, Artificial Sequence
  Synthetic
PEYNAYR

SEQ ID NO: 16244 - protein, 7 aa, Artificial Sequence
  Synthetic
WHGLLGG

SEQ ID NO: 16245 - protein, 7 aa, Artificial Sequence
  Synthetic
VKWNLNP

SEQ ID NO: 16246 - protein, 7 aa, Artificial Sequence
  Synthetic
WPVLKPD

SEQ ID NO: 16247 - protein, 7 aa, Artificial Sequence
  Synthetic
HGDSGRW

SEQ ID NO: 16248 - protein, 7 aa, Artificial Sequence
  Synthetic
ERFKLDV

SEQ ID NO: 16249 - protein, 7 aa, Artificial Sequence
  Synthetic
LNVGWSS

SEQ ID NO: 16250 - protein, 7 aa, Artificial Sequence
  Synthetic
PGTAMIY

SEQ ID NO: 16251 - protein, 7 aa, Artificial Sequence
  Synthetic
MHKNSGG

SEQ ID NO: 16252 - protein, 7 aa, Artificial Sequence
  Synthetic
AEYTGSW

SEQ ID NO: 16253 - protein, 7 aa, Artificial Sequence
  Synthetic
QMDNWHT

SEQ ID NO: 16254 - protein, 7 aa, Artificial Sequence
  Synthetic
LRPGLAQ

SEQ ID NO: 16255 - protein, 7 aa, Artificial Sequence
  Synthetic
VDRGYSQ

SEQ ID NO: 16256 - protein, 7 aa, Artificial Sequence
  Synthetic
PGLHLSS

SEQ ID NO: 16257 - protein, 7 aa, Artificial Sequence
  Synthetic
WVSYGSA

SEQ ID NO: 16258 - protein, 7 aa, Artificial Sequence
  Synthetic
TSEYAHW

SEQ ID NO: 16259 - protein, 7 aa, Artificial Sequence
  Synthetic
ESEYNFH

SEQ ID NO: 16260 - protein, 7 aa, Artificial Sequence
  Synthetic
PQHDSRW

SEQ ID NO: 16261 - protein, 7 aa, Artificial Sequence
  Synthetic
FAIHGSA

SEQ ID NO: 16262 - protein, 7 aa, Artificial Sequence
  Synthetic
SQLHGSS

SEQ ID NO: 16263 - protein, 7 aa, Artificial Sequence
  Synthetic
EMKWAAS

SEQ ID NO: 16264 - protein, 7 aa, Artificial Sequence
  Synthetic
QYGSGSW

SEQ ID NO: 16265 - protein, 7 aa, Artificial Sequence
  Synthetic
EAHTVRW

SEQ ID NO: 16266 - protein, 7 aa, Artificial Sequence
  Synthetic
DYYGAAS

SEQ ID NO: 16267 - protein, 7 aa, Artificial Sequence
  Synthetic
VYAGYTM

SEQ ID NO: 16268 - protein, 7 aa, Artificial Sequence
  Synthetic
WNTLTGY

SEQ ID NO: 16269 - protein, 7 aa, Artificial Sequence
  Synthetic
GVWGSVP

SEQ ID NO: 16270 - protein, 7 aa, Artificial Sequence
  Synthetic
RTVDCCL

SEQ ID NO: 16271 - protein, 7 aa, Artificial Sequence
  Synthetic
VAWAGSS

SEQ ID NO: 16272 - protein, 7 aa, Artificial Sequence
  Synthetic
APEFVGW

SEQ ID NO: 16273 - protein, 7 aa, Artificial Sequence
  Synthetic
LLAGFST

SEQ ID NO: 16274 - protein, 7 aa, Artificial Sequence
  Synthetic
GNWNLAM

SEQ ID NO: 16275 - protein, 7 aa, Artificial Sequence
  Synthetic
TWVGGAT

SEQ ID NO: 16276 - protein, 7 aa, Artificial Sequence
  Synthetic
GAPGSRF

SEQ ID NO: 16277 - protein, 7 aa, Artificial Sequence
  Synthetic
KTDYTYY

SEQ ID NO: 16278 - protein, 7 aa, Artificial Sequence
  Synthetic
LNRWSSD

SEQ ID NO: 16279 - protein, 7 aa, Artificial Sequence
  Synthetic
PAMHSTW

SEQ ID NO: 16280 - protein, 7 aa, Artificial Sequence
  Synthetic
QRVMGST

SEQ ID NO: 16281 - protein, 7 aa, Artificial Sequence
  Synthetic
SREAWSS

SEQ ID NO: 16282 - protein, 7 aa, Artificial Sequence
  Synthetic
SRIVLLN

SEQ ID NO: 16283 - protein, 7 aa, Artificial Sequence
  Synthetic
STWGGSS

SEQ ID NO: 16284 - protein, 7 aa, Artificial Sequence
  Synthetic
QRPGYSA

SEQ ID NO: 16285 - protein, 7 aa, Artificial Sequence
  Synthetic
NANRSRD

SEQ ID NO: 16286 - protein, 7 aa, Artificial Sequence
  Synthetic
GAQFAGW

SEQ ID NO: 16287 - protein, 7 aa, Artificial Sequence
  Synthetic
LKSPGAW

SEQ ID NO: 16288 - protein, 7 aa, Artificial Sequence
  Synthetic
GWLGGSV

SEQ ID NO: 16289 - protein, 7 aa, Artificial Sequence
  Synthetic
GAFNWAA

SEQ ID NO: 16290 - protein, 7 aa, Artificial Sequence
  Synthetic
SYVPAKH

SEQ ID NO: 16291 - protein, 7 aa, Artificial Sequence
  Synthetic
YVQLPLV

SEQ ID NO: 16292 - protein, 7 aa, Artificial Sequence
  Synthetic
AYVGLSS

SEQ ID NO: 16293 - protein, 7 aa, Artificial Sequence
  Synthetic
RPVGSIY

SEQ ID NO: 16294 - protein, 7 aa, Artificial Sequence
  Synthetic
ELRGYSI

SEQ ID NO: 16295 - protein, 7 aa, Artificial Sequence
  Synthetic
WGVMNSL

SEQ ID NO: 16296 - protein, 7 aa, Artificial Sequence
  Synthetic
DWRGGAS

SEQ ID NO: 16297 - protein, 7 aa, Artificial Sequence
  Synthetic
SAQGYST

SEQ ID NO: 16298 - protein, 7 aa, Artificial Sequence
  Synthetic
ILRGYDV

SEQ ID NO: 16299 - protein, 7 aa, Artificial Sequence
  Synthetic
RVYDGFH

SEQ ID NO: 16300 - protein, 7 aa, Artificial Sequence
  Synthetic
RYPGENS

SEQ ID NO: 16301 - protein, 7 aa, Artificial Sequence
  Synthetic
LWSSGST

SEQ ID NO: 16302 - protein, 7 aa, Artificial Sequence
  Synthetic
NVYNKTW

SEQ ID NO: 16303 - protein, 7 aa, Artificial Sequence
  Synthetic
CARWPSE

SEQ ID NO: 16304 - protein, 7 aa, Artificial Sequence
  Synthetic
LIAQFSS

SEQ ID NO: 16305 - protein, 7 aa, Artificial Sequence
  Synthetic
NARNTWE

SEQ ID NO: 16306 - protein, 7 aa, Artificial Sequence
  Synthetic
AGWVGSS

SEQ ID NO: 16307 - protein, 7 aa, Artificial Sequence
  Synthetic
IRVGGWT

SEQ ID NO: 16308 - protein, 7 aa, Artificial Sequence
  Synthetic
PAIGSVY

SEQ ID NO: 16309 - protein, 7 aa, Artificial Sequence
  Synthetic
LKGGWSS

SEQ ID NO: 16310 - protein, 7 aa, Artificial Sequence
  Synthetic
LKLGFST

SEQ ID NO: 16311 - protein, 7 aa, Artificial Sequence
  Synthetic
PYVHLAS

SEQ ID NO: 16312 - protein, 7 aa, Artificial Sequence
  Synthetic
TYIGSAS

SEQ ID NO: 16313 - protein, 7 aa, Artificial Sequence
  Synthetic
GEDLGRW

SEQ ID NO: 16314 - protein, 7 aa, Artificial Sequence
  Synthetic
GSDVARY

SEQ ID NO: 16315 - protein, 7 aa, Artificial Sequence
  Synthetic
KPFDLRS

SEQ ID NO: 16316 - protein, 7 aa, Artificial Sequence
  Synthetic
EGPFMST

SEQ ID NO: 16317 - protein, 7 aa, Artificial Sequence
  Synthetic
GLADGRW

SEQ ID NO: 16318 - protein, 7 aa, Artificial Sequence
  Synthetic
WGSPIHV

SEQ ID NO: 16319 - protein, 7 aa, Artificial Sequence
  Synthetic
PSGYGSY

SEQ ID NO: 16320 - protein, 7 aa, Artificial Sequence
  Synthetic
MKQDNPK

SEQ ID NO: 16321 - protein, 7 aa, Artificial Sequence
  Synthetic
LRHAGST

SEQ ID NO: 16322 - protein, 7 aa, Artificial Sequence
  Synthetic
DHRYIAG

SEQ ID NO: 16323 - protein, 7 aa, Artificial Sequence
  Synthetic
GRLMLVA

SEQ ID NO: 16324 - protein, 7 aa, Artificial Sequence
  Synthetic
RFHADAA

SEQ ID NO: 16325 - protein, 7 aa, Artificial Sequence
  Synthetic
AIGSGFR

SEQ ID NO: 16326 - protein, 7 aa, Artificial Sequence
  Synthetic
ESGTARW

SEQ ID NO: 16327 - protein, 7 aa, Artificial Sequence
  Synthetic
MLERPQR

SEQ ID NO: 16328 - protein, 7 aa, Artificial Sequence
  Synthetic
ETFRGAA

SEQ ID NO: 16329 - protein, 7 aa, Artificial Sequence
  Synthetic
PYAEWAG

SEQ ID NO: 16330 - protein, 7 aa, Artificial Sequence
  Synthetic
TTYVRWE

SEQ ID NO: 16331 - protein, 7 aa, Artificial Sequence
  Synthetic
YGAVGPW

SEQ ID NO: 16332 - protein, 7 aa, Artificial Sequence
  Synthetic
EQRYTTY

SEQ ID NO: 16333 - protein, 7 aa, Artificial Sequence
  Synthetic
LDWGSAQ

SEQ ID NO: 16334 - protein, 7 aa, Artificial Sequence
  Synthetic
DAHPGPW

SEQ ID NO: 16335 - protein, 7 aa, Artificial Sequence
  Synthetic
SYLPASH

SEQ ID NO: 16336 - protein, 7 aa, Artificial Sequence
  Synthetic
DRWTDYT

SEQ ID NO: 16337 - protein, 7 aa, Artificial Sequence
  Synthetic
MHSGFSV

SEQ ID NO: 16338 - protein, 7 aa, Artificial Sequence
  Synthetic
SVVGWSA

SEQ ID NO: 16339 - protein, 7 aa, Artificial Sequence
  Synthetic
FSLDSRP

SEQ ID NO: 16340 - protein, 7 aa, Artificial Sequence
  Synthetic
SYLGDLR

SEQ ID NO: 16341 - protein, 7 aa, Artificial Sequence
  Synthetic
TERNQWT

SEQ ID NO: 16342 - protein, 7 aa, Artificial Sequence
  Synthetic
EIPVHRW

SEQ ID NO: 16343 - protein, 7 aa, Artificial Sequence
  Synthetic
WRLSGSS

SEQ ID NO: 16344 - protein, 7 aa, Artificial Sequence
  Synthetic
GGVAPRY

SEQ ID NO: 16345 - protein, 7 aa, Artificial Sequence
  Synthetic
VDGVVRW

SEQ ID NO: 16346 - protein, 7 aa, Artificial Sequence
  Synthetic
MRVGSVY

SEQ ID NO: 16347 - protein, 7 aa, Artificial Sequence
  Synthetic
KMAGDRW

SEQ ID NO: 16348 - protein, 7 aa, Artificial Sequence
  Synthetic
PFMPMSS

SEQ ID NO: 16349 - protein, 7 aa, Artificial Sequence
  Synthetic
LYVPSSQ

SEQ ID NO: 16350 - protein, 7 aa, Artificial Sequence
  Synthetic
KEPWDRS

SEQ ID NO: 16351 - protein, 7 aa, Artificial Sequence
  Synthetic
LPGTHNW

SEQ ID NO: 16352 - protein, 7 aa, Artificial Sequence
  Synthetic
WSPFASG

SEQ ID NO: 16353 - protein, 7 aa, Artificial Sequence
  Synthetic
VGTKSLW

SEQ ID NO: 16354 - protein, 7 aa, Artificial Sequence
  Synthetic
SMTLGSA

SEQ ID NO: 16355 - protein, 7 aa, Artificial Sequence
  Synthetic
LWSGAST

SEQ ID NO: 16356 - protein, 7 aa, Artificial Sequence
  Synthetic
PADGARW

SEQ ID NO: 16357 - protein, 7 aa, Artificial Sequence
  Synthetic
WSLNIGY

SEQ ID NO: 16358 - protein, 7 aa, Artificial Sequence
  Synthetic
AAYRFDG

SEQ ID NO: 16359 - protein, 7 aa, Artificial Sequence
  Synthetic
TEPFGST

SEQ ID NO: 16360 - protein, 7 aa, Artificial Sequence
  Synthetic
TFPRGAS

SEQ ID NO: 16361 - protein, 7 aa, Artificial Sequence
  Synthetic
PAYTNGW

SEQ ID NO: 16362 - protein, 7 aa, Artificial Sequence
  Synthetic
TRNLGSS

SEQ ID NO: 16363 - protein, 7 aa, Artificial Sequence
  Synthetic
VAVGWSA

SEQ ID NO: 16364 - protein, 7 aa, Artificial Sequence
  Synthetic
LTHYGSS

SEQ ID NO: 16365 - protein, 7 aa, Artificial Sequence
  Synthetic
VDRGFAQ

SEQ ID NO: 16366 - protein, 7 aa, Artificial Sequence
  Synthetic
VGSLSGW

SEQ ID NO: 16367 - protein, 7 aa, Artificial Sequence
  Synthetic
WSPYSVN

SEQ ID NO: 16368 - protein, 7 aa, Artificial Sequence
  Synthetic
GDQPGRW

SEQ ID NO: 16369 - protein, 7 aa, Artificial Sequence
  Synthetic
ERHGFSY

SEQ ID NO: 16370 - protein, 7 aa, Artificial Sequence
  Synthetic
RLYELPS

SEQ ID NO: 16371 - protein, 7 aa, Artificial Sequence
  Synthetic
FGVGFST

SEQ ID NO: 16372 - protein, 7 aa, Artificial Sequence
  Synthetic
KAAGMSW

SEQ ID NO: 16373 - protein, 7 aa, Artificial Sequence
  Synthetic
ELLRSFA

SEQ ID NO: 16374 - protein, 7 aa, Artificial Sequence
  Synthetic
LAPGWSV

SEQ ID NO: 16375 - protein, 7 aa, Artificial Sequence
  Synthetic
YLHGWND

SEQ ID NO: 16376 - protein, 7 aa, Artificial Sequence
  Synthetic
LVTYGST

SEQ ID NO: 16377 - protein, 7 aa, Artificial Sequence
  Synthetic
CGYSLSC

SEQ ID NO: 16378 - protein, 7 aa, Artificial Sequence
  Synthetic
KAPGIQW

SEQ ID NO: 16379 - protein, 7 aa, Artificial Sequence
  Synthetic
DLIGVRW

SEQ ID NO: 16380 - protein, 7 aa, Artificial Sequence
  Synthetic
FMKDAYP

SEQ ID NO: 16381 - protein, 7 aa, Artificial Sequence
  Synthetic
ASLGSVY

SEQ ID NO: 16382 - protein, 7 aa, Artificial Sequence
  Synthetic
RTTEQWW

SEQ ID NO: 16383 - protein, 7 aa, Artificial Sequence
  Synthetic
SWMEDFR

SEQ ID NO: 16384 - protein, 7 aa, Artificial Sequence
  Synthetic
LVPRMSS

SEQ ID NO: 16385 - protein, 7 aa, Artificial Sequence
  Synthetic
EHWGAAR

SEQ ID NO: 16386 - protein, 7 aa, Artificial Sequence
  Synthetic
FAVNLRP

SEQ ID NO: 16387 - protein, 7 aa, Artificial Sequence
  Synthetic
LRIMLSP

SEQ ID NO: 16388 - protein, 7 aa, Artificial Sequence
  Synthetic
PAIRVVN

SEQ ID NO: 16389 - protein, 7 aa, Artificial Sequence
  Synthetic
TRVYESS

SEQ ID NO: 16390 - protein, 7 aa, Artificial Sequence
  Synthetic
GVSLGKW

SEQ ID NO: 16391 - protein, 7 aa, Artificial Sequence
  Synthetic
FIAGWSS

SEQ ID NO: 16392 - protein, 7 aa, Artificial Sequence
  Synthetic
WVIGHVP

SEQ ID NO: 16393 - protein, 7 aa, Artificial Sequence
  Synthetic
PLVRSYG

SEQ ID NO: 16394 - protein, 7 aa, Artificial Sequence
  Synthetic
GEHRGSW

SEQ ID NO: 16395 - protein, 7 aa, Artificial Sequence
  Synthetic
EHNSARW

SEQ ID NO: 16396 - protein, 7 aa, Artificial Sequence
  Synthetic
VRLGSVY

SEQ ID NO: 16397 - protein, 7 aa, Artificial Sequence
  Synthetic
PYPGASA

SEQ ID NO: 16398 - protein, 7 aa, Artificial Sequence
  Synthetic
EASGARW

SEQ ID NO: 16399 - protein, 7 aa, Artificial Sequence
  Synthetic
EMYRGST

SEQ ID NO: 16400 - protein, 7 aa, Artificial Sequence
  Synthetic
SGGNWAY

SEQ ID NO: 16401 - protein, 7 aa, Artificial Sequence
  Synthetic
ALPVYGR

SEQ ID NO: 16402 - protein, 7 aa, Artificial Sequence
  Synthetic
KTDYGQW

SEQ ID NO: 16403 - protein, 7 aa, Artificial Sequence
  Synthetic
TRPMGSS

SEQ ID NO: 16404 - protein, 7 aa, Artificial Sequence
  Synthetic
VRVQLVA

SEQ ID NO: 16405 - protein, 7 aa, Artificial Sequence
  Synthetic
LMTHGST

SEQ ID NO: 16406 - protein, 7 aa, Artificial Sequence
  Synthetic
EVNQSRW

SEQ ID NO: 16407 - protein, 7 aa, Artificial Sequence
  Synthetic
NWPADSS

SEQ ID NO: 16408 - protein, 7 aa, Artificial Sequence
  Synthetic
DNYKLPI

SEQ ID NO: 16409 - protein, 7 aa, Artificial Sequence
  Synthetic
PHQNWSS

SEQ ID NO: 16410 - protein, 7 aa, Artificial Sequence
  Synthetic
SYLPATH

SEQ ID NO: 16411 - protein, 7 aa, Artificial Sequence
  Synthetic
LHYGAAS

SEQ ID NO: 16412 - protein, 7 aa, Artificial Sequence
  Synthetic
LQIGRAQ

SEQ ID NO: 16413 - protein, 7 aa, Artificial Sequence
  Synthetic
VHFRLDH

SEQ ID NO: 16414 - protein, 7 aa, Artificial Sequence
  Synthetic
YRGILIG

SEQ ID NO: 16415 - protein, 7 aa, Artificial Sequence
  Synthetic
GESVGRW

SEQ ID NO: 16416 - protein, 7 aa, Artificial Sequence
  Synthetic
RAESSYW

SEQ ID NO: 16417 - protein, 7 aa, Artificial Sequence
  Synthetic
HWKSEGH

SEQ ID NO: 16418 - protein, 7 aa, Artificial Sequence
  Synthetic
MNAGFSS

SEQ ID NO: 16419 - protein, 7 aa, Artificial Sequence
  Synthetic
QYTASHW

SEQ ID NO: 16420 - protein, 7 aa, Artificial Sequence
  Synthetic
ERTGGYW

SEQ ID NO: 16421 - protein, 7 aa, Artificial Sequence
  Synthetic
NNRWEAS

SEQ ID NO: 16422 - protein, 7 aa, Artificial Sequence
  Synthetic
YQSYGSS

SEQ ID NO: 16423 - protein, 7 aa, Artificial Sequence
  Synthetic
VCRAMLG

SEQ ID NO: 16424 - protein, 7 aa, Artificial Sequence
  Synthetic
EYIGHAQ

SEQ ID NO: 16425 - protein, 7 aa, Artificial Sequence
  Synthetic
GIDRSRW

SEQ ID NO: 16426 - protein, 7 aa, Artificial Sequence
  Synthetic
YRVMGSA

SEQ ID NO: 16427 - protein, 7 aa, Artificial Sequence
  Synthetic
EQWGRSQ

SEQ ID NO: 16428 - protein, 7 aa, Artificial Sequence
  Synthetic
QWKGDAT

SEQ ID NO: 16429 - protein, 7 aa, Artificial Sequence
  Synthetic
KLDHAYY

SEQ ID NO: 16430 - protein, 7 aa, Artificial Sequence
  Synthetic
AVGSGVW

SEQ ID NO: 16431 - protein, 7 aa, Artificial Sequence
  Synthetic
LFVHGSS

SEQ ID NO: 16432 - protein, 7 aa, Artificial Sequence
  Synthetic
KQGQAER

SEQ ID NO: 16433 - protein, 7 aa, Artificial Sequence
  Synthetic
KHVSDFS

SEQ ID NO: 16434 - protein, 7 aa, Artificial Sequence
  Synthetic
KPEWGYN

SEQ ID NO: 16435 - protein, 7 aa, Artificial Sequence
  Synthetic
DRIGYSY

SEQ ID NO: 16436 - protein, 7 aa, Artificial Sequence
  Synthetic
RFTLGPA

SEQ ID NO: 16437 - protein, 7 aa, Artificial Sequence
  Synthetic
RWSLGNE

SEQ ID NO: 16438 - protein, 7 aa, Artificial Sequence
  Synthetic
KLETSYW

SEQ ID NO: 16439 - protein, 7 aa, Artificial Sequence
  Synthetic
RASLAGA

SEQ ID NO: 16440 - protein, 7 aa, Artificial Sequence
  Synthetic
SSGYVGW

SEQ ID NO: 16441 - protein, 7 aa, Artificial Sequence
  Synthetic
IRPGWAM

SEQ ID NO: 16442 - protein, 7 aa, Artificial Sequence
  Synthetic
GQDVSRW

SEQ ID NO: 16443 - protein, 7 aa, Artificial Sequence
  Synthetic
VWGAIGP

SEQ ID NO: 16444 - protein, 7 aa, Artificial Sequence
  Synthetic
QKYNGST

SEQ ID NO: 16445 - protein, 7 aa, Artificial Sequence
  Synthetic
LMLRPDI

SEQ ID NO: 16446 - protein, 7 aa, Artificial Sequence
  Synthetic
SRNLGSA

SEQ ID NO: 16447 - protein, 7 aa, Artificial Sequence
  Synthetic
RWAADSS

SEQ ID NO: 16448 - protein, 7 aa, Artificial Sequence
  Synthetic
QRVVLSP

SEQ ID NO: 16449 - protein, 7 aa, Artificial Sequence
  Synthetic
HAHMGSM

SEQ ID NO: 16450 - protein, 7 aa, Artificial Sequence
  Synthetic
LFGYGNV

SEQ ID NO: 16451 - protein, 7 aa, Artificial Sequence
  Synthetic
FGTYSIL

SEQ ID NO: 16452 - protein, 7 aa, Artificial Sequence
  Synthetic
EPRWQSS

SEQ ID NO: 16453 - protein, 7 aa, Artificial Sequence
  Synthetic
SVRMGSS

SEQ ID NO: 16454 - protein, 7 aa, Artificial Sequence
  Synthetic
YKIETGW

SEQ ID NO: 16455 - protein, 7 aa, Artificial Sequence
  Synthetic
VKAGYSS

SEQ ID NO: 16456 - protein, 7 aa, Artificial Sequence
  Synthetic
DWSRGAS

SEQ ID NO: 16457 - protein, 7 aa, Artificial Sequence
  Synthetic
DKLGWSA

SEQ ID NO: 16458 - protein, 7 aa, Artificial Sequence
  Synthetic
SPTEARW

SEQ ID NO: 16459 - protein, 7 aa, Artificial Sequence
  Synthetic
VDPVRWS

SEQ ID NO: 16460 - protein, 7 aa, Artificial Sequence
  Synthetic
TYKIGYI

SEQ ID NO: 16461 - protein, 7 aa, Artificial Sequence
  Synthetic
DAVAGRW

SEQ ID NO: 16462 - protein, 7 aa, Artificial Sequence
  Synthetic
PTPGWAS

SEQ ID NO: 16463 - protein, 7 aa, Artificial Sequence
  Synthetic
GVERGPW

SEQ ID NO: 16464 - protein, 7 aa, Artificial Sequence
  Synthetic
GSDVARF

SEQ ID NO: 16465 - protein, 7 aa, Artificial Sequence
  Synthetic
LSKGTIY

SEQ ID NO: 16466 - protein, 7 aa, Artificial Sequence
  Synthetic
GPNTYNW

SEQ ID NO: 16467 - protein, 7 aa, Artificial Sequence
  Synthetic
IVIGFSS

SEQ ID NO: 16468 - protein, 7 aa, Artificial Sequence
  Synthetic
SRYGDFM

SEQ ID NO: 16469 - protein, 7 aa, Artificial Sequence
  Synthetic
PYVGSSA

SEQ ID NO: 16470 - protein, 7 aa, Artificial Sequence
  Synthetic
ERLILHP

SEQ ID NO: 16471 - protein, 7 aa, Artificial Sequence
  Synthetic
SFHGSAQ

SEQ ID NO: 16472 - protein, 7 aa, Artificial Sequence
  Synthetic
GEDMGRW

SEQ ID NO: 16473 - protein, 7 aa, Artificial Sequence
  Synthetic
SAGTFRT

SEQ ID NO: 16474 - protein, 7 aa, Artificial Sequence
  Synthetic
TVSYGSS

SEQ ID NO: 16475 - protein, 7 aa, Artificial Sequence
  Synthetic
SWHAGAS

SEQ ID NO: 16476 - protein, 7 aa, Artificial Sequence
  Synthetic
WASLGSA

SEQ ID NO: 16477 - protein, 7 aa, Artificial Sequence
  Synthetic
GGVSRWD

SEQ ID NO: 16478 - protein, 7 aa, Artificial Sequence
  Synthetic
HEYLGSS

SEQ ID NO: 16479 - protein, 7 aa, Artificial Sequence
  Synthetic
GYSNFHT

SEQ ID NO: 16480 - protein, 7 aa, Artificial Sequence
  Synthetic
RFVVDSA

SEQ ID NO: 16481 - protein, 7 aa, Artificial Sequence
  Synthetic
KIYSGSS

SEQ ID NO: 16482 - protein, 7 aa, Artificial Sequence
  Synthetic
GWRLDTP

SEQ ID NO: 16483 - protein, 7 aa, Artificial Sequence
  Synthetic
KMPGWSS

SEQ ID NO: 16484 - protein, 7 aa, Artificial Sequence
  Synthetic
PLTSTHW

SEQ ID NO: 16485 - protein, 7 aa, Artificial Sequence
  Synthetic
KHLGMAQ

SEQ ID NO: 16486 - protein, 7 aa, Artificial Sequence
  Synthetic
KADYSFH

SEQ ID NO: 16487 - protein, 7 aa, Artificial Sequence
  Synthetic
RFANDSS

SEQ ID NO: 16488 - protein, 7 aa, Artificial Sequence
  Synthetic
GGDTGRW

SEQ ID NO: 16489 - protein, 7 aa, Artificial Sequence
  Synthetic
TTWAGSS

SEQ ID NO: 16490 - protein, 7 aa, Artificial Sequence
  Synthetic
SVLRGFN

SEQ ID NO: 16491 - protein, 7 aa, Artificial Sequence
  Synthetic
GSSSSMW

SEQ ID NO: 16492 - protein, 7 aa, Artificial Sequence
  Synthetic
IRNGSIY

SEQ ID NO: 16493 - protein, 7 aa, Artificial Sequence
  Synthetic
THDGVWY

SEQ ID NO: 16494 - protein, 7 aa, Artificial Sequence
  Synthetic
PWPGASA

SEQ ID NO: 16495 - protein, 7 aa, Artificial Sequence
  Synthetic
WISLPDS

SEQ ID NO: 16496 - protein, 7 aa, Artificial Sequence
  Synthetic
TVRYAIS

SEQ ID NO: 16497 - protein, 7 aa, Artificial Sequence
  Synthetic
SGPYMAS

SEQ ID NO: 16498 - protein, 7 aa, Artificial Sequence
  Synthetic
RYSPDAA

SEQ ID NO: 16499 - protein, 7 aa, Artificial Sequence
  Synthetic
ARPNFSS

SEQ ID NO: 16500 - protein, 7 aa, Artificial Sequence
  Synthetic
WSAYSEG

SEQ ID NO: 16501 - protein, 7 aa, Artificial Sequence
  Synthetic
NQWEDYR

SEQ ID NO: 16502 - protein, 7 aa, Artificial Sequence
  Synthetic
SPSWTYG

SEQ ID NO: 16503 - protein, 7 aa, Artificial Sequence
  Synthetic
TRAGIYG

SEQ ID NO: 16504 - protein, 7 aa, Artificial Sequence
  Synthetic
RWSLGDA

SEQ ID NO: 16505 - protein, 7 aa, Artificial Sequence
  Synthetic
AVQMHGW

SEQ ID NO: 16506 - protein, 7 aa, Artificial Sequence
  Synthetic
YASWGAA

SEQ ID NO: 16507 - protein, 7 aa, Artificial Sequence
  Synthetic
GRIILKN

SEQ ID NO: 16508 - protein, 7 aa, Artificial Sequence
  Synthetic
LARGYSS

SEQ ID NO: 16509 - protein, 7 aa, Artificial Sequence
  Synthetic
WSEWSPG

SEQ ID NO: 16510 - protein, 7 aa, Artificial Sequence
  Synthetic
FYSLGDA

SEQ ID NO: 16511 - protein, 7 aa, Artificial Sequence
  Synthetic
EYYNSSS

SEQ ID NO: 16512 - protein, 7 aa, Artificial Sequence
  Synthetic
FVFGERV

SEQ ID NO: 16513 - protein, 7 aa, Artificial Sequence
  Synthetic
KYAMQSC

SEQ ID NO: 16514 - protein, 7 aa, Artificial Sequence
  Synthetic
EPGSNRW

SEQ ID NO: 16515 - protein, 7 aa, Artificial Sequence
  Synthetic
HAWGAIP

SEQ ID NO: 16516 - protein, 7 aa, Artificial Sequence
  Synthetic
YMYSGSM

SEQ ID NO: 16517 - protein, 7 aa, Artificial Sequence
  Synthetic
AQYTLPT

SEQ ID NO: 16518 - protein, 7 aa, Artificial Sequence
  Synthetic
LISHGSS

SEQ ID NO: 16519 - protein, 7 aa, Artificial Sequence
  Synthetic
VFSGFSS

SEQ ID NO: 16520 - protein, 7 aa, Artificial Sequence
  Synthetic
PSYGAIY

SEQ ID NO: 16521 - protein, 7 aa, Artificial Sequence
  Synthetic
MLETYGR

SEQ ID NO: 16522 - protein, 7 aa, Artificial Sequence
  Synthetic
YGSLSLV

SEQ ID NO: 16523 - protein, 7 aa, Artificial Sequence
  Synthetic
DWSRGAA

SEQ ID NO: 16524 - protein, 7 aa, Artificial Sequence
  Synthetic
ERIILSN

SEQ ID NO: 16525 - protein, 7 aa, Artificial Sequence
  Synthetic
EENRVRW

SEQ ID NO: 16526 - protein, 7 aa, Artificial Sequence
  Synthetic
PRIMLSP

SEQ ID NO: 16527 - protein, 7 aa, Artificial Sequence
  Synthetic
LFVGGST

SEQ ID NO: 16528 - protein, 7 aa, Artificial Sequence
  Synthetic
GVWGHLP

SEQ ID NO: 16529 - protein, 7 aa, Artificial Sequence
  Synthetic
GSRFDLS

SEQ ID NO: 16530 - protein, 7 aa, Artificial Sequence
  Synthetic
GLVHNWS

SEQ ID NO: 16531 - protein, 7 aa, Artificial Sequence
  Synthetic
WLPGFSQ

SEQ ID NO: 16532 - protein, 7 aa, Artificial Sequence
  Synthetic
ERWGAAS

SEQ ID NO: 16533 - protein, 7 aa, Artificial Sequence
  Synthetic
FNPLFSS

SEQ ID NO: 16534 - protein, 7 aa, Artificial Sequence
  Synthetic
LYVGFSS

SEQ ID NO: 16535 - protein, 7 aa, Artificial Sequence
  Synthetic
SRFGMST

SEQ ID NO: 16536 - protein, 7 aa, Artificial Sequence
  Synthetic
PANSGLW

SEQ ID NO: 16537 - protein, 7 aa, Artificial Sequence
  Synthetic
GQWQGSS

SEQ ID NO: 16538 - protein, 7 aa, Artificial Sequence
  Synthetic
SYLAGFS

SEQ ID NO: 16539 - protein, 7 aa, Artificial Sequence
  Synthetic
MHVGGAS

SEQ ID NO: 16540 - protein, 7 aa, Artificial Sequence
  Synthetic
ERHAGPW

SEQ ID NO: 16541 - protein, 7 aa, Artificial Sequence
  Synthetic
MIRQGSA

SEQ ID NO: 16542 - protein, 7 aa, Artificial Sequence
  Synthetic
MREWGSS

SEQ ID NO: 16543 - protein, 7 aa, Artificial Sequence
  Synthetic
ERLMGSS

SEQ ID NO: 16544 - protein, 7 aa, Artificial Sequence
  Synthetic
RSNASVY

SEQ ID NO: 16545 - protein, 7 aa, Artificial Sequence
  Synthetic
LSYGLAS

SEQ ID NO: 16546 - protein, 7 aa, Artificial Sequence
  Synthetic
CIGYVTA

SEQ ID NO: 16547 - protein, 7 aa, Artificial Sequence
  Synthetic
PMGSAHW

SEQ ID NO: 16548 - protein, 7 aa, Artificial Sequence
  Synthetic
GNDSARW

SEQ ID NO: 16549 - protein, 7 aa, Artificial Sequence
  Synthetic
ALHGYSI

SEQ ID NO: 16550 - protein, 7 aa, Artificial Sequence
  Synthetic
TTHDGRW

SEQ ID NO: 16551 - protein, 7 aa, Artificial Sequence
  Synthetic
RSLAEHW

SEQ ID NO: 16552 - protein, 7 aa, Artificial Sequence
  Synthetic
ERPFQAS

SEQ ID NO: 16553 - protein, 7 aa, Artificial Sequence
  Synthetic
PRFSLDA

SEQ ID NO: 16554 - protein, 7 aa, Artificial Sequence
  Synthetic
IAKFFSS

SEQ ID NO: 16555 - protein, 7 aa, Artificial Sequence
  Synthetic
LHVAWSS

SEQ ID NO: 16556 - protein, 7 aa, Artificial Sequence
  Synthetic
GVSQSMW

SEQ ID NO: 16557 - protein, 7 aa, Artificial Sequence
  Synthetic
GEPSGRW

SEQ ID NO: 16558 - protein, 7 aa, Artificial Sequence
  Synthetic
LTYSSAL

SEQ ID NO: 16559 - protein, 7 aa, Artificial Sequence
  Synthetic
DRGSGIW

SEQ ID NO: 16560 - protein, 7 aa, Artificial Sequence
  Synthetic
YKYEGST

SEQ ID NO: 16561 - protein, 7 aa, Artificial Sequence
  Synthetic
AHQFAYA

SEQ ID NO: 16562 - protein, 7 aa, Artificial Sequence
  Synthetic
AAWGGSS

SEQ ID NO: 16563 - protein, 7 aa, Artificial Sequence
  Synthetic
LGYSFSA

SEQ ID NO: 16564 - protein, 7 aa, Artificial Sequence
  Synthetic
HITLKYS

SEQ ID NO: 16565 - protein, 7 aa, Artificial Sequence
  Synthetic
RYVGDPS

SEQ ID NO: 16566 - protein, 7 aa, Artificial Sequence
  Synthetic
TLHGWSA

SEQ ID NO: 16567 - protein, 7 aa, Artificial Sequence
  Synthetic
YLMPFGD

SEQ ID NO: 16568 - protein, 7 aa, Artificial Sequence
  Synthetic
PATGAYW

SEQ ID NO: 16569 - protein, 7 aa, Artificial Sequence
  Synthetic
CFPIADC

SEQ ID NO: 16570 - protein, 7 aa, Artificial Sequence
  Synthetic
YGALAAM

SEQ ID NO: 16571 - protein, 7 aa, Artificial Sequence
  Synthetic
VFLGSST

SEQ ID NO: 16572 - protein, 7 aa, Artificial Sequence
  Synthetic
LVIRHAS

SEQ ID NO: 16573 - protein, 7 aa, Artificial Sequence
  Synthetic
SWHGASS

SEQ ID NO: 16574 - protein, 7 aa, Artificial Sequence
  Synthetic
MLAGYNV

SEQ ID NO: 16575 - protein, 7 aa, Artificial Sequence
  Synthetic
TPFTEHW

SEQ ID NO: 16576 - protein, 7 aa, Artificial Sequence
  Synthetic
FRLGYPA

SEQ ID NO: 16577 - protein, 7 aa, Artificial Sequence
  Synthetic
HHMHFEK

SEQ ID NO: 16578 - protein, 7 aa, Artificial Sequence
  Synthetic
WSNFGSA

SEQ ID NO: 16579 - protein, 7 aa, Artificial Sequence
  Synthetic
RYSMDSS

SEQ ID NO: 16580 - protein, 7 aa, Artificial Sequence
  Synthetic
ALARYGT

SEQ ID NO: 16581 - protein, 7 aa, Artificial Sequence
  Synthetic
HWKHDGP

SEQ ID NO: 16582 - protein, 7 aa, Artificial Sequence
  Synthetic
LDKGSVY

SEQ ID NO: 16583 - protein, 7 aa, Artificial Sequence
  Synthetic
ILAGYRD

SEQ ID NO: 16584 - protein, 7 aa, Artificial Sequence
  Synthetic
CFIGGAQ

SEQ ID NO: 16585 - protein, 7 aa, Artificial Sequence
  Synthetic
GLPYLSS

SEQ ID NO: 16586 - protein, 7 aa, Artificial Sequence
  Synthetic
WKSLPTL

SEQ ID NO: 16587 - protein, 7 aa, Artificial Sequence
  Synthetic
LTDRPAR

SEQ ID NO: 16588 - protein, 7 aa, Artificial Sequence
  Synthetic
SRIMGSV

SEQ ID NO: 16589 - protein, 7 aa, Artificial Sequence
  Synthetic
HLGGYGF

SEQ ID NO: 16590 - protein, 7 aa, Artificial Sequence
  Synthetic
IILGYST

SEQ ID NO: 16591 - protein, 7 aa, Artificial Sequence
  Synthetic
REHDGRW

SEQ ID NO: 16592 - protein, 7 aa, Artificial Sequence
  Synthetic
ARCGVGC

SEQ ID NO: 16593 - protein, 7 aa, Artificial Sequence
  Synthetic
PPHMLPI

SEQ ID NO: 16594 - protein, 7 aa, Artificial Sequence
  Synthetic
DNTSNRW

SEQ ID NO: 16595 - protein, 7 aa, Artificial Sequence
  Synthetic
GMVEGRW

SEQ ID NO: 16596 - protein, 7 aa, Artificial Sequence
  Synthetic
DRFQGYA

SEQ ID NO: 16597 - protein, 7 aa, Artificial Sequence
  Synthetic
SKTMGSV

SEQ ID NO: 16598 - protein, 7 aa, Artificial Sequence
  Synthetic
NLETAYW

SEQ ID NO: 16599 - protein, 7 aa, Artificial Sequence
  Synthetic
LLPNWSH

SEQ ID NO: 16600 - protein, 7 aa, Artificial Sequence
  Synthetic
WGISEGY

SEQ ID NO: 16601 - protein, 7 aa, Artificial Sequence
  Synthetic
GVDLGRY

SEQ ID NO: 16602 - protein, 7 aa, Artificial Sequence
  Synthetic
FLRGYND

SEQ ID NO: 16603 - protein, 7 aa, Artificial Sequence
  Synthetic
SHHSGIW

SEQ ID NO: 16604 - protein, 7 aa, Artificial Sequence
  Synthetic
WSLPDHG

SEQ ID NO: 16605 - protein, 7 aa, Artificial Sequence
  Synthetic
MGAPGQW

SEQ ID NO: 16606 - protein, 7 aa, Artificial Sequence
  Synthetic
GRFAGEW

SEQ ID NO: 16607 - protein, 7 aa, Artificial Sequence
  Synthetic
DGRFLAQ

SEQ ID NO: 16608 - protein, 7 aa, Artificial Sequence
  Synthetic
AGVSRWD

SEQ ID NO: 16609 - protein, 7 aa, Artificial Sequence
  Synthetic
KQFSFPV

SEQ ID NO: 16610 - protein, 7 aa, Artificial Sequence
  Synthetic
FMMRGSA

SEQ ID NO: 16611 - protein, 7 aa, Artificial Sequence
  Synthetic
DQPYRGF

SEQ ID NO: 16612 - protein, 7 aa, Artificial Sequence
  Synthetic
YDTIRGW

SEQ ID NO: 16613 - protein, 7 aa, Artificial Sequence
  Synthetic
GEVPRWA

SEQ ID NO: 16614 - protein, 7 aa, Artificial Sequence
  Synthetic
LMYLGSQ

SEQ ID NO: 16615 - protein, 7 aa, Artificial Sequence
  Synthetic
IAAFGSA

SEQ ID NO: 16616 - protein, 7 aa, Artificial Sequence
  Synthetic
PYHQYSA

SEQ ID NO: 16617 - protein, 7 aa, Artificial Sequence
  Synthetic
FEDRARY

SEQ ID NO: 16618 - protein, 7 aa, Artificial Sequence
  Synthetic
LWDHGSS

SEQ ID NO: 16619 - protein, 7 aa, Artificial Sequence
  Synthetic
PVALGPW

SEQ ID NO: 16620 - protein, 7 aa, Artificial Sequence
  Synthetic
QFVGHAA

SEQ ID NO: 16621 - protein, 7 aa, Artificial Sequence
  Synthetic
AVWMGSS

SEQ ID NO: 16622 - protein, 7 aa, Artificial Sequence
  Synthetic
EGTVGRW

SEQ ID NO: 16623 - protein, 7 aa, Artificial Sequence
  Synthetic
PVGSALW

SEQ ID NO: 16624 - protein, 7 aa, Artificial Sequence
  Synthetic
PLLHLSS

SEQ ID NO: 16625 - protein, 7 aa, Artificial Sequence
  Synthetic
TFTHGAS

SEQ ID NO: 16626 - protein, 7 aa, Artificial Sequence
  Synthetic
YGSLNSF

SEQ ID NO: 16627 - protein, 7 aa, Artificial Sequence
  Synthetic
WPYGRAE

SEQ ID NO: 16628 - protein, 7 aa, Artificial Sequence
  Synthetic
WGSLAGV

SEQ ID NO: 16629 - protein, 7 aa, Artificial Sequence
  Synthetic
IDGVVRW

SEQ ID NO: 16630 - protein, 7 aa, Artificial Sequence
  Synthetic
FHVAYSS

SEQ ID NO: 16631 - protein, 7 aa, Artificial Sequence
  Synthetic
MWPGTAQ

SEQ ID NO: 16632 - protein, 7 aa, Artificial Sequence
  Synthetic
NWEHSGW

SEQ ID NO: 16633 - protein, 7 aa, Artificial Sequence
  Synthetic
WVSHGSS

SEQ ID NO: 16634 - protein, 7 aa, Artificial Sequence
  Synthetic
RYSLDAA

SEQ ID NO: 16635 - protein, 7 aa, Artificial Sequence
  Synthetic
KTAWDNT

SEQ ID NO: 16636 - protein, 7 aa, Artificial Sequence
  Synthetic
LPPRHLF

SEQ ID NO: 16637 - protein, 7 aa, Artificial Sequence
  Synthetic
FGVQWSS

SEQ ID NO: 16638 - protein, 7 aa, Artificial Sequence
  Synthetic
GWKGDSS

SEQ ID NO: 16639 - protein, 7 aa, Artificial Sequence
  Synthetic
GATSSMW

SEQ ID NO: 16640 - protein, 7 aa, Artificial Sequence
  Synthetic
LYVGDAS

SEQ ID NO: 16641 - protein, 7 aa, Artificial Sequence
  Synthetic
CYPRAEC

SEQ ID NO: 16642 - protein, 7 aa, Artificial Sequence
  Synthetic
SRVGFST

SEQ ID NO: 16643 - protein, 7 aa, Artificial Sequence
  Synthetic
AMWGGAS

SEQ ID NO: 16644 - protein, 7 aa, Artificial Sequence
  Synthetic
TPYKMPT

SEQ ID NO: 16645 - protein, 7 aa, Artificial Sequence
  Synthetic
TPHFGLA

SEQ ID NO: 16646 - protein, 7 aa, Artificial Sequence
  Synthetic
RFSGDAS

SEQ ID NO: 16647 - protein, 7 aa, Artificial Sequence
  Synthetic
EMLGWAS

SEQ ID NO: 16648 - protein, 7 aa, Artificial Sequence
  Synthetic
VATGWSS

SEQ ID NO: 16649 - protein, 7 aa, Artificial Sequence
  Synthetic
RALGLSS

SEQ ID NO: 16650 - protein, 7 aa, Artificial Sequence
  Synthetic
SYPGAAW

SEQ ID NO: 16651 - protein, 7 aa, Artificial Sequence
  Synthetic
TLHTYHT

SEQ ID NO: 16652 - protein, 7 aa, Artificial Sequence
  Synthetic
CGVRTCG

SEQ ID NO: 16653 - protein, 7 aa, Artificial Sequence
  Synthetic
DAATSRW

SEQ ID NO: 16654 - protein, 7 aa, Artificial Sequence
  Synthetic
DMYVLPH

SEQ ID NO: 16655 - protein, 7 aa, Artificial Sequence
  Synthetic
LALNWAS

SEQ ID NO: 16656 - protein, 7 aa, Artificial Sequence
  Synthetic
PSDIARY

SEQ ID NO: 16657 - protein, 7 aa, Artificial Sequence
  Synthetic
RHVGESW

SEQ ID NO: 16658 - protein, 7 aa, Artificial Sequence
  Synthetic
DNWRGAQ

SEQ ID NO: 16659 - protein, 7 aa, Artificial Sequence
  Synthetic
AASTSYW

SEQ ID NO: 16660 - protein, 7 aa, Artificial Sequence
  Synthetic
PEPVWNS

SEQ ID NO: 16661 - protein, 7 aa, Artificial Sequence
  Synthetic
DVRFGAS

SEQ ID NO: 16662 - protein, 7 aa, Artificial Sequence
  Synthetic
EAHLGRW

SEQ ID NO: 16663 - protein, 7 aa, Artificial Sequence
  Synthetic
SPGFGVA

SEQ ID NO: 16664 - protein, 7 aa, Artificial Sequence
  Synthetic
WSLAGST

SEQ ID NO: 16665 - protein, 7 aa, Artificial Sequence
  Synthetic
AFPGGSA

SEQ ID NO: 16666 - protein, 7 aa, Artificial Sequence
  Synthetic
NNERSGK

SEQ ID NO: 16667 - protein, 7 aa, Artificial Sequence
  Synthetic
NTFEGRW

SEQ ID NO: 16668 - protein, 7 aa, Artificial Sequence
  Synthetic
DRGRTVN

SEQ ID NO: 16669 - protein, 7 aa, Artificial Sequence
  Synthetic
LHVPGAR

SEQ ID NO: 16670 - protein, 7 aa, Artificial Sequence
  Synthetic
WRLSGLP

SEQ ID NO: 16671 - protein, 7 aa, Artificial Sequence
  Synthetic
PYTSYSA

SEQ ID NO: 16672 - protein, 7 aa, Artificial Sequence
  Synthetic
YSYLLSP

SEQ ID NO: 16673 - protein, 7 aa, Artificial Sequence
  Synthetic
MVEFGSA

SEQ ID NO: 16674 - protein, 7 aa, Artificial Sequence
  Synthetic
DDFSARY

SEQ ID NO: 16675 - protein, 7 aa, Artificial Sequence
  Synthetic
NRALGSS

SEQ ID NO: 16676 - protein, 7 aa, Artificial Sequence
  Synthetic
WPGLGSS

SEQ ID NO: 16677 - protein, 7 aa, Artificial Sequence
  Synthetic
GVHAGYY

SEQ ID NO: 16678 - protein, 7 aa, Artificial Sequence
  Synthetic
WRVAGAA

SEQ ID NO: 16679 - protein, 7 aa, Artificial Sequence
  Synthetic
RFLGSST

SEQ ID NO: 16680 - protein, 7 aa, Artificial Sequence
  Synthetic
WAYEGSA

SEQ ID NO: 16681 - protein, 7 aa, Artificial Sequence
  Synthetic
DRQHGSS

SEQ ID NO: 16682 - protein, 7 aa, Artificial Sequence
  Synthetic
LVANYSS

SEQ ID NO: 16683 - protein, 7 aa, Artificial Sequence
  Synthetic
LRVGFSA

SEQ ID NO: 16684 - protein, 7 aa, Artificial Sequence
  Synthetic
GHPNWAA

SEQ ID NO: 16685 - protein, 7 aa, Artificial Sequence
  Synthetic
MFVGFSA

SEQ ID NO: 16686 - protein, 7 aa, Artificial Sequence
  Synthetic
YTLAGGF

SEQ ID NO: 16687 - protein, 7 aa, Artificial Sequence
  Synthetic
DFSRGAS

SEQ ID NO: 16688 - protein, 7 aa, Artificial Sequence
  Synthetic
IPGEAKW

SEQ ID NO: 16689 - protein, 7 aa, Artificial Sequence
  Synthetic
LRYGGSV

SEQ ID NO: 16690 - protein, 7 aa, Artificial Sequence
  Synthetic
LEWQGSS

SEQ ID NO: 16691 - protein, 7 aa, Artificial Sequence
  Synthetic
SPVWISS

SEQ ID NO: 16692 - protein, 7 aa, Artificial Sequence
  Synthetic
VFSLTPI

SEQ ID NO: 16693 - protein, 7 aa, Artificial Sequence
  Synthetic
VSVGHIY

SEQ ID NO: 16694 - protein, 7 aa, Artificial Sequence
  Synthetic
GIDLSRW

SEQ ID NO: 16695 - protein, 7 aa, Artificial Sequence
  Synthetic
MWPASAT

SEQ ID NO: 16696 - protein, 7 aa, Artificial Sequence
  Synthetic
REDYRGW

SEQ ID NO: 16697 - protein, 7 aa, Artificial Sequence
  Synthetic
WTLPLGG

SEQ ID NO: 16698 - protein, 7 aa, Artificial Sequence
  Synthetic
AAPWASS

SEQ ID NO: 16699 - protein, 7 aa, Artificial Sequence
  Synthetic
TSDRAIW

SEQ ID NO: 16700 - protein, 7 aa, Artificial Sequence
  Synthetic
EILPYRT

SEQ ID NO: 16701 - protein, 7 aa, Artificial Sequence
  Synthetic
TRSEWSS

SEQ ID NO: 16702 - protein, 7 aa, Artificial Sequence
  Synthetic
QVTHGSS

SEQ ID NO: 16703 - protein, 7 aa, Artificial Sequence
  Synthetic
TFVGYSS

SEQ ID NO: 16704 - protein, 7 aa, Artificial Sequence
  Synthetic
IMFHGSA

SEQ ID NO: 16705 - protein, 7 aa, Artificial Sequence
  Synthetic
GVGEVRW

SEQ ID NO: 16706 - protein, 7 aa, Artificial Sequence
  Synthetic
TNFGYAQ

SEQ ID NO: 16707 - protein, 7 aa, Artificial Sequence
  Synthetic
VHRYEIS

SEQ ID NO: 16708 - protein, 7 aa, Artificial Sequence
  Synthetic
GMWGAVV

SEQ ID NO: 16709 - protein, 7 aa, Artificial Sequence
  Synthetic
RYPHDSA

SEQ ID NO: 16710 - protein, 7 aa, Artificial Sequence
  Synthetic
SWPGGAT

SEQ ID NO: 16711 - protein, 7 aa, Artificial Sequence
  Synthetic
FDIGPRP

SEQ ID NO: 16712 - protein, 7 aa, Artificial Sequence
  Synthetic
DAVGNRW

SEQ ID NO: 16713 - protein, 7 aa, Artificial Sequence
  Synthetic
VIWNGAA

SEQ ID NO: 16714 - protein, 7 aa, Artificial Sequence
  Synthetic
EFIGGSS

SEQ ID NO: 16715 - protein, 7 aa, Artificial Sequence
  Synthetic
WVPMGSS

SEQ ID NO: 16716 - protein, 7 aa, Artificial Sequence
  Synthetic
WNYGGSA

SEQ ID NO: 16717 - protein, 7 aa, Artificial Sequence
  Synthetic
VRLNPDR

SEQ ID NO: 16718 - protein, 7 aa, Artificial Sequence
  Synthetic
WSRFTEG

SEQ ID NO: 16719 - protein, 7 aa, Artificial Sequence
  Synthetic
EFSMKGY

SEQ ID NO: 16720 - protein, 7 aa, Artificial Sequence
  Synthetic
EYYPQGS

SEQ ID NO: 16721 - protein, 7 aa, Artificial Sequence
  Synthetic
LWAGSSQ

SEQ ID NO: 16722 - protein, 7 aa, Artificial Sequence
  Synthetic
MQHMGST

SEQ ID NO: 16723 - protein, 7 aa, Artificial Sequence
  Synthetic
STYDGRW

SEQ ID NO: 16724 - protein, 7 aa, Artificial Sequence
  Synthetic
VFAQGAR

SEQ ID NO: 16725 - protein, 7 aa, Artificial Sequence
  Synthetic
RERIGPW

SEQ ID NO: 16726 - protein, 7 aa, Artificial Sequence
  Synthetic
SVRLGST

SEQ ID NO: 16727 - protein, 7 aa, Artificial Sequence
  Synthetic
IVHGMAQ

SEQ ID NO: 16728 - protein, 7 aa, Artificial Sequence
  Synthetic
KFAENRH

SEQ ID NO: 16729 - protein, 7 aa, Artificial Sequence
  Synthetic
AHATGYW

SEQ ID NO: 16730 - protein, 7 aa, Artificial Sequence
  Synthetic
GTDISRW

SEQ ID NO: 16731 - protein, 7 aa, Artificial Sequence
  Synthetic
QTHNPLK

SEQ ID NO: 16732 - protein, 7 aa, Artificial Sequence
  Synthetic
RAYDLSL

SEQ ID NO: 16733 - protein, 7 aa, Artificial Sequence
  Synthetic
RSVGQIY

SEQ ID NO: 16734 - protein, 7 aa, Artificial Sequence
  Synthetic
YLRLGSS

SEQ ID NO: 16735 - protein, 7 aa, Artificial Sequence
  Synthetic
TEQSRWA

SEQ ID NO: 16736 - protein, 7 aa, Artificial Sequence
  Synthetic
WSIYKES

SEQ ID NO: 16737 - protein, 7 aa, Artificial Sequence
  Synthetic
SENPGRW

SEQ ID NO: 16738 - protein, 7 aa, Artificial Sequence
  Synthetic
WATWHEA

SEQ ID NO: 16739 - protein, 7 aa, Artificial Sequence
  Synthetic
PPGGWSS

SEQ ID NO: 16740 - protein, 7 aa, Artificial Sequence
  Synthetic
PPDSALW

SEQ ID NO: 16741 - protein, 7 aa, Artificial Sequence
  Synthetic
GDPAARY

SEQ ID NO: 16742 - protein, 7 aa, Artificial Sequence
  Synthetic
LHSHGSS

SEQ ID NO: 16743 - protein, 7 aa, Artificial Sequence
  Synthetic
AVPLQAW

SEQ ID NO: 16744 - protein, 7 aa, Artificial Sequence
  Synthetic
VIRMGSA

SEQ ID NO: 16745 - protein, 7 aa, Artificial Sequence
  Synthetic
DGHDGRW

SEQ ID NO: 16746 - protein, 7 aa, Artificial Sequence
  Synthetic
FHMSVGL

SEQ ID NO: 16747 - protein, 7 aa, Artificial Sequence
  Synthetic
PYPGASH

SEQ ID NO: 16748 - protein, 7 aa, Artificial Sequence
  Synthetic
AAHEGRW

SEQ ID NO: 16749 - protein, 7 aa, Artificial Sequence
  Synthetic
DHGWGSS

SEQ ID NO: 16750 - protein, 7 aa, Artificial Sequence
  Synthetic
DLDSGRW

SEQ ID NO: 16751 - protein, 7 aa, Artificial Sequence
  Synthetic
DANSGRW

SEQ ID NO: 16752 - protein, 7 aa, Artificial Sequence
  Synthetic
NRALGSS

SEQ ID NO: 16753 - protein, 7 aa, Artificial Sequence
  Synthetic
LFPGESR

SEQ ID NO: 16754 - protein, 7 aa, Artificial Sequence
  Synthetic
GADTARW

SEQ ID NO: 16755 - protein, 7 aa, Artificial Sequence
  Synthetic
VNYSASI

SEQ ID NO: 16756 - protein, 7 aa, Artificial Sequence
  Synthetic
LWTGLSS

SEQ ID NO: 16757 - protein, 7 aa, Artificial Sequence
  Synthetic
HNIYDRA

SEQ ID NO: 16758 - protein, 7 aa, Artificial Sequence
  Synthetic
WTYGGSA

SEQ ID NO: 16759 - protein, 7 aa, Artificial Sequence
  Synthetic
TADLARW

SEQ ID NO: 16760 - protein, 7 aa, Artificial Sequence
  Synthetic
PAWDNRP

SEQ ID NO: 16761 - protein, 7 aa, Artificial Sequence
  Synthetic
WQIHGSS

SEQ ID NO: 16762 - protein, 7 aa, Artificial Sequence
  Synthetic
ENNSGRW

SEQ ID NO: 16763 - protein, 7 aa, Artificial Sequence
  Synthetic
VYFSGSL

SEQ ID NO: 16764 - protein, 7 aa, Artificial Sequence
  Synthetic
PRFGLSS

SEQ ID NO: 16765 - protein, 7 aa, Artificial Sequence
  Synthetic
QMYQLPN

SEQ ID NO: 16766 - protein, 7 aa, Artificial Sequence
  Synthetic
TRAPGIW

SEQ ID NO: 16767 - protein, 7 aa, Artificial Sequence
  Synthetic
PGKGYSS

SEQ ID NO: 16768 - protein, 7 aa, Artificial Sequence
  Synthetic
WKTAGAQ

SEQ ID NO: 16769 - protein, 7 aa, Artificial Sequence
  Synthetic
WAGLGSS

SEQ ID NO: 16770 - protein, 7 aa, Artificial Sequence
  Synthetic
SHIGFSA

SEQ ID NO: 16771 - protein, 7 aa, Artificial Sequence
  Synthetic
QTSHQSW

SEQ ID NO: 16772 - protein, 7 aa, Artificial Sequence
  Synthetic
RTSHDFY

SEQ ID NO: 16773 - protein, 7 aa, Artificial Sequence
  Synthetic
LVYGRDL

SEQ ID NO: 16774 - protein, 7 aa, Artificial Sequence
  Synthetic
HAPGWAS

SEQ ID NO: 16775 - protein, 7 aa, Artificial Sequence
  Synthetic
FKPWVNE

SEQ ID NO: 16776 - protein, 7 aa, Artificial Sequence
  Synthetic
ARALGSS

SEQ ID NO: 16777 - protein, 7 aa, Artificial Sequence
  Synthetic
EWPGGSA

SEQ ID NO: 16778 - protein, 7 aa, Artificial Sequence
  Synthetic
NWTQAIG

SEQ ID NO: 16779 - protein, 7 aa, Artificial Sequence
  Synthetic
LVYMGST

SEQ ID NO: 16780 - protein, 7 aa, Artificial Sequence
  Synthetic
MAYHGST

SEQ ID NO: 16781 - protein, 7 aa, Artificial Sequence
  Synthetic
SAYHGST

SEQ ID NO: 16782 - protein, 7 aa, Artificial Sequence
  Synthetic
GPDIARY

SEQ ID NO: 16783 - protein, 7 aa, Artificial Sequence
  Synthetic
PRAGFSM

SEQ ID NO: 16784 - protein, 7 aa, Artificial Sequence
  Synthetic
DRVRGST

SEQ ID NO: 16785 - protein, 7 aa, Artificial Sequence
  Synthetic
GVNAGAW

SEQ ID NO: 16786 - protein, 7 aa, Artificial Sequence
  Synthetic
SFSHGSQ

SEQ ID NO: 16787 - protein, 7 aa, Artificial Sequence
  Synthetic
DRQIPGR

SEQ ID NO: 16788 - protein, 7 aa, Artificial Sequence
  Synthetic
RVSPGDR

SEQ ID NO: 16789 - protein, 7 aa, Artificial Sequence
  Synthetic
YGTLAFM

SEQ ID NO: 16790 - protein, 7 aa, Artificial Sequence
  Synthetic
TRSGMAQ

SEQ ID NO: 16791 - protein, 7 aa, Artificial Sequence
  Synthetic
RFGGDST

SEQ ID NO: 16792 - protein, 7 aa, Artificial Sequence
  Synthetic
GGVNHVR

SEQ ID NO: 16793 - protein, 7 aa, Artificial Sequence
  Synthetic
FEYGGSQ

SEQ ID NO: 16794 - protein, 7 aa, Artificial Sequence
  Synthetic
WDHARGY

SEQ ID NO: 16795 - protein, 7 aa, Artificial Sequence
  Synthetic
MDHVARW

SEQ ID NO: 16796 - protein, 7 aa, Artificial Sequence
  Synthetic
KIGEGFR

SEQ ID NO: 16797 - protein, 7 aa, Artificial Sequence
  Synthetic
GYVDFGY

SEQ ID NO: 16798 - protein, 7 aa, Artificial Sequence
  Synthetic
LMYSTGL

SEQ ID NO: 16799 - protein, 7 aa, Artificial Sequence
  Synthetic
PYPAYSS

SEQ ID NO: 16800 - protein, 7 aa, Artificial Sequence
  Synthetic
AFYGGSA

SEQ ID NO: 16801 - protein, 7 aa, Artificial Sequence
  Synthetic
GYAEFKF

SEQ ID NO: 16802 - protein, 7 aa, Artificial Sequence
  Synthetic
PNDYGRY

SEQ ID NO: 16803 - protein, 7 aa, Artificial Sequence
  Synthetic
RFPGTSS

SEQ ID NO: 16804 - protein, 7 aa, Artificial Sequence
  Synthetic
FTMVDRP

SEQ ID NO: 16805 - protein, 7 aa, Artificial Sequence
  Synthetic
EAHQVRW

SEQ ID NO: 16806 - protein, 7 aa, Artificial Sequence
  Synthetic
YGVLDKV

SEQ ID NO: 16807 - protein, 7 aa, Artificial Sequence
  Synthetic
TISGYST

SEQ ID NO: 16808 - protein, 7 aa, Artificial Sequence
  Synthetic
CVYLGSA

SEQ ID NO: 16809 - protein, 7 aa, Artificial Sequence
  Synthetic
LRVGSVY

SEQ ID NO: 16810 - protein, 7 aa, Artificial Sequence
  Synthetic
PVPFYGA

SEQ ID NO: 16811 - protein, 7 aa, Artificial Sequence
  Synthetic
DSLSVRW

SEQ ID NO: 16812 - protein, 7 aa, Artificial Sequence
  Synthetic
WEREHPK

SEQ ID NO: 16813 - protein, 7 aa, Artificial Sequence
  Synthetic
RGLGMSS

SEQ ID NO: 16814 - protein, 7 aa, Artificial Sequence
  Synthetic
GITTSMW

SEQ ID NO: 16815 - protein, 7 aa, Artificial Sequence
  Synthetic
SMQRTWD

SEQ ID NO: 16816 - protein, 7 aa, Artificial Sequence
  Synthetic
AYKGYAT

SEQ ID NO: 16817 - protein, 7 aa, Artificial Sequence
  Synthetic
VLVGRSG

SEQ ID NO: 16818 - protein, 7 aa, Artificial Sequence
  Synthetic
HVRLMSA

SEQ ID NO: 16819 - protein, 7 aa, Artificial Sequence
  Synthetic
FRLGGSQ

SEQ ID NO: 16820 - protein, 7 aa, Artificial Sequence
  Synthetic
ERWGSAM

SEQ ID NO: 16821 - protein, 7 aa, Artificial Sequence
  Synthetic
KWAGSST

SEQ ID NO: 16822 - protein, 7 aa, Artificial Sequence
  Synthetic
AYAGYSL

SEQ ID NO: 16823 - protein, 7 aa, Artificial Sequence
  Synthetic
GPDVGRW

SEQ ID NO: 16824 - protein, 7 aa, Artificial Sequence
  Synthetic
LWISGSS

SEQ ID NO: 16825 - protein, 7 aa, Artificial Sequence
  Synthetic
PVYMTYN

SEQ ID NO: 16826 - protein, 7 aa, Artificial Sequence
  Synthetic
VNKGYST

SEQ ID NO: 16827 - protein, 7 aa, Artificial Sequence
  Synthetic
WGLNSGY

SEQ ID NO: 16828 - protein, 7 aa, Artificial Sequence
  Synthetic
LAYHMSS

SEQ ID NO: 16829 - protein, 7 aa, Artificial Sequence
  Synthetic
YGRLDPL

SEQ ID NO: 16830 - protein, 7 aa, Artificial Sequence
  Synthetic
LRVGLSQ

SEQ ID NO: 16831 - protein, 7 aa, Artificial Sequence
  Synthetic
TIATYHI

SEQ ID NO: 16832 - protein, 7 aa, Artificial Sequence
  Synthetic
EAPFLSS

SEQ ID NO: 16833 - protein, 7 aa, Artificial Sequence
  Synthetic
WAVENGY

SEQ ID NO: 16834 - protein, 7 aa, Artificial Sequence
  Synthetic
WSTFGSG

SEQ ID NO: 16835 - protein, 7 aa, Artificial Sequence
  Synthetic
VHHSYAL

SEQ ID NO: 16836 - protein, 7 aa, Artificial Sequence
  Synthetic
WRPLGAS

SEQ ID NO: 16837 - protein, 7 aa, Artificial Sequence
  Synthetic
GFGDSRW

SEQ ID NO: 16838 - protein, 7 aa, Artificial Sequence
  Synthetic
VRVAQWE

SEQ ID NO: 16839 - protein, 7 aa, Artificial Sequence
  Synthetic
GDVSGRW

SEQ ID NO: 16840 - protein, 7 aa, Artificial Sequence
  Synthetic
MGWQGSS

SEQ ID NO: 16841 - protein, 7 aa, Artificial Sequence
  Synthetic
LYPGFSA

SEQ ID NO: 16842 - protein, 7 aa, Artificial Sequence
  Synthetic
SVPYGAS

SEQ ID NO: 16843 - protein, 7 aa, Artificial Sequence
  Synthetic
GDAPGAW

SEQ ID NO: 16844 - protein, 7 aa, Artificial Sequence
  Synthetic
GNDPGVW

SEQ ID NO: 16845 - protein, 7 aa, Artificial Sequence
  Synthetic
SSSNWHV

SEQ ID NO: 16846 - protein, 7 aa, Artificial Sequence
  Synthetic
EWRKGEW

SEQ ID NO: 16847 - protein, 7 aa, Artificial Sequence
  Synthetic
VSMGYSS

SEQ ID NO: 16848 - protein, 7 aa, Artificial Sequence
  Synthetic
LWPSASS

SEQ ID NO: 16849 - protein, 7 aa, Artificial Sequence
  Synthetic
LRLGGST

SEQ ID NO: 16850 - protein, 7 aa, Artificial Sequence
  Synthetic
GSSTSMW

SEQ ID NO: 16851 - protein, 7 aa, Artificial Sequence
  Synthetic
LFPASST

SEQ ID NO: 16852 - protein, 7 aa, Artificial Sequence
  Synthetic
PAGGFSV

SEQ ID NO: 16853 - protein, 7 aa, Artificial Sequence
  Synthetic
GISPGVW

SEQ ID NO: 16854 - protein, 7 aa, Artificial Sequence
  Synthetic
TFAHGAA

SEQ ID NO: 16855 - protein, 7 aa, Artificial Sequence
  Synthetic
VVRGYSA

SEQ ID NO: 16856 - protein, 7 aa, Artificial Sequence
  Synthetic
PGPGFSS

SEQ ID NO: 16857 - protein, 7 aa, Artificial Sequence
  Synthetic
MWTNGAQ

SEQ ID NO: 16858 - protein, 7 aa, Artificial Sequence
  Synthetic
NSSPGPW

SEQ ID NO: 16859 - protein, 7 aa, Artificial Sequence
  Synthetic
WSPSGGF

SEQ ID NO: 16860 - protein, 7 aa, Artificial Sequence
  Synthetic
MRLNGHT

SEQ ID NO: 16861 - protein, 7 aa, Artificial Sequence
  Synthetic
GVWGFAQ

SEQ ID NO: 16862 - protein, 7 aa, Artificial Sequence
  Synthetic
WELGSGF

SEQ ID NO: 16863 - protein, 7 aa, Artificial Sequence
  Synthetic
RWEGSST

SEQ ID NO: 16864 - protein, 7 aa, Artificial Sequence
  Synthetic
GRLDAHR

SEQ ID NO: 16865 - protein, 7 aa, Artificial Sequence
  Synthetic
DWSQGSS

SEQ ID NO: 16866 - protein, 7 aa, Artificial Sequence
  Synthetic
RDVGWAQ

SEQ ID NO: 16867 - protein, 7 aa, Artificial Sequence
  Synthetic
VIHRWHE

SEQ ID NO: 16868 - protein, 7 aa, Artificial Sequence
  Synthetic
PPMHAAW

SEQ ID NO: 16869 - protein, 7 aa, Artificial Sequence
  Synthetic
VYDGFAY

SEQ ID NO: 16870 - protein, 7 aa, Artificial Sequence
  Synthetic
VLLREAL

SEQ ID NO: 16871 - protein, 7 aa, Artificial Sequence
  Synthetic
MTWGSSQ

SEQ ID NO: 16872 - protein, 7 aa, Artificial Sequence
  Synthetic
ASYGYSS

SEQ ID NO: 16873 - protein, 7 aa, Artificial Sequence
  Synthetic
NKQANPW

SEQ ID NO: 16874 - protein, 7 aa, Artificial Sequence
  Synthetic
WKTIGSA

SEQ ID NO: 16875 - protein, 7 aa, Artificial Sequence
  Synthetic
SQPYSYA

SEQ ID NO: 16876 - protein, 7 aa, Artificial Sequence
  Synthetic
LYHASAS

SEQ ID NO: 16877 - protein, 7 aa, Artificial Sequence
  Synthetic
EWNETRW

SEQ ID NO: 16878 - protein, 7 aa, Artificial Sequence
  Synthetic
IAIGYST

SEQ ID NO: 16879 - protein, 7 aa, Artificial Sequence
  Synthetic
AVIYGSS

SEQ ID NO: 16880 - protein, 7 aa, Artificial Sequence
  Synthetic
WGVSNGY

SEQ ID NO: 16881 - protein, 7 aa, Artificial Sequence
  Synthetic
DGGSRWS

SEQ ID NO: 16882 - protein, 7 aa, Artificial Sequence
  Synthetic
FKFEGSA

SEQ ID NO: 16883 - protein, 7 aa, Artificial Sequence
  Synthetic
DFRGYSV

SEQ ID NO: 16884 - protein, 7 aa, Artificial Sequence
  Synthetic
TDYKGWV

SEQ ID NO: 16885 - protein, 7 aa, Artificial Sequence
  Synthetic
RNNPGPH

SEQ ID NO: 16886 - protein, 7 aa, Artificial Sequence
  Synthetic
WVHPTGE

SEQ ID NO: 16887 - protein, 7 aa, Artificial Sequence
  Synthetic
HITGGFR

SEQ ID NO: 16888 - protein, 7 aa, Artificial Sequence
  Synthetic
LWHGGAS

SEQ ID NO: 16889 - protein, 7 aa, Artificial Sequence
  Synthetic
VGHMGPW

SEQ ID NO: 16890 - protein, 7 aa, Artificial Sequence
  Synthetic
GPTWGVM

SEQ ID NO: 16891 - protein, 7 aa, Artificial Sequence
  Synthetic
LWIGGAS

SEQ ID NO: 16892 - protein, 7 aa, Artificial Sequence
  Synthetic
LFFAGSI

SEQ ID NO: 16893 - protein, 7 aa, Artificial Sequence
  Synthetic
DRSWGAA

SEQ ID NO: 16894 - protein, 7 aa, Artificial Sequence
  Synthetic
WMAGFTN

SEQ ID NO: 16895 - protein, 7 aa, Artificial Sequence
  Synthetic
IGMWYKD

SEQ ID NO: 16896 - protein, 7 aa, Artificial Sequence
  Synthetic
GLWHGSS

SEQ ID NO: 16897 - protein, 7 aa, Artificial Sequence
  Synthetic
TTIGYGY

SEQ ID NO: 16898 - protein, 7 aa, Artificial Sequence
  Synthetic
QKIGYSA

SEQ ID NO: 16899 - protein, 7 aa, Artificial Sequence
  Synthetic
TSFPGPW

SEQ ID NO: 16900 - protein, 7 aa, Artificial Sequence
  Synthetic
SLVGYSY

SEQ ID NO: 16901 - protein, 7 aa, Artificial Sequence
  Synthetic
WSDGARP

SEQ ID NO: 16902 - protein, 7 aa, Artificial Sequence
  Synthetic
GIGDSRW

SEQ ID NO: 16903 - protein, 7 aa, Artificial Sequence
  Synthetic
LVSLGSS

SEQ ID NO: 16904 - protein, 7 aa, Artificial Sequence
  Synthetic
QAYTRFD

SEQ ID NO: 16905 - protein, 7 aa, Artificial Sequence
  Synthetic
SHFHGST

SEQ ID NO: 16906 - protein, 7 aa, Artificial Sequence
  Synthetic
YERSSWS

SEQ ID NO: 16907 - protein, 7 aa, Artificial Sequence
  Synthetic
TMFKGSA

SEQ ID NO: 16908 - protein, 7 aa, Artificial Sequence
  Synthetic
VHRLGSA

SEQ ID NO: 16909 - protein, 7 aa, Artificial Sequence
  Synthetic
ERKYEAS

SEQ ID NO: 16910 - protein, 7 aa, Artificial Sequence
  Synthetic
IPSWSYD

SEQ ID NO: 16911 - protein, 7 aa, Artificial Sequence
  Synthetic
SSRDTFW

SEQ ID NO: 16912 - protein, 7 aa, Artificial Sequence
  Synthetic
PFEYAIA

SEQ ID NO: 16913 - protein, 7 aa, Artificial Sequence
  Synthetic
FGTLEMY

SEQ ID NO: 16914 - protein, 7 aa, Artificial Sequence
  Synthetic
STLPYSF

SEQ ID NO: 16915 - protein, 7 aa, Artificial Sequence
  Synthetic
PWPGTST

SEQ ID NO: 16916 - protein, 7 aa, Artificial Sequence
  Synthetic
LTYGTAQ

SEQ ID NO: 16917 - protein, 7 aa, Artificial Sequence
  Synthetic
LFIRDAS

SEQ ID NO: 16918 - protein, 7 aa, Artificial Sequence
  Synthetic
PRVVLKE

SEQ ID NO: 16919 - protein, 7 aa, Artificial Sequence
  Synthetic
DNSSARW

SEQ ID NO: 16920 - protein, 7 aa, Artificial Sequence
  Synthetic
DRHGYSS

SEQ ID NO: 16921 - protein, 7 aa, Artificial Sequence
  Synthetic
QPSDSRW

SEQ ID NO: 16922 - protein, 7 aa, Artificial Sequence
  Synthetic
GPSVVWN

SEQ ID NO: 16923 - protein, 7 aa, Artificial Sequence
  Synthetic
GYPMYSA

SEQ ID NO: 16924 - protein, 7 aa, Artificial Sequence
  Synthetic
QVPGMSQ

SEQ ID NO: 16925 - protein, 7 aa, Artificial Sequence
  Synthetic
WSVDRGF

SEQ ID NO: 16926 - protein, 7 aa, Artificial Sequence
  Synthetic
WGSVAFV

SEQ ID NO: 16927 - protein, 7 aa, Artificial Sequence
  Synthetic
PEIMLRP

SEQ ID NO: 16928 - protein, 7 aa, Artificial Sequence
  Synthetic
SVSLRYV

SEQ ID NO: 16929 - protein, 7 aa, Artificial Sequence
  Synthetic
EVHAVWN

SEQ ID NO: 16930 - protein, 7 aa, Artificial Sequence
  Synthetic
RPDWDRV

SEQ ID NO: 16931 - protein, 7 aa, Artificial Sequence
  Synthetic
IREHGSS

SEQ ID NO: 16932 - protein, 7 aa, Artificial Sequence
  Synthetic
GMKVHQH

SEQ ID NO: 16933 - protein, 7 aa, Artificial Sequence
  Synthetic
PAWAHSA

SEQ ID NO: 16934 - protein, 7 aa, Artificial Sequence
  Synthetic
TIHTGQW

SEQ ID NO: 16935 - protein, 7 aa, Artificial Sequence
  Synthetic
DQRWPGA

SEQ ID NO: 16936 - protein, 7 aa, Artificial Sequence
  Synthetic
GMPRAPF

SEQ ID NO: 16937 - protein, 7 aa, Artificial Sequence
  Synthetic
QAYHGST

SEQ ID NO: 16938 - protein, 7 aa, Artificial Sequence
  Synthetic
SSDMARF

SEQ ID NO: 16939 - protein, 7 aa, Artificial Sequence
  Synthetic
WGASTGY

SEQ ID NO: 16940 - protein, 7 aa, Artificial Sequence
  Synthetic
SYLHGAS

SEQ ID NO: 16941 - protein, 7 aa, Artificial Sequence
  Synthetic
GITRSIF

SEQ ID NO: 16942 - protein, 7 aa, Artificial Sequence
  Synthetic
AYRLGSA

SEQ ID NO: 16943 - protein, 7 aa, Artificial Sequence
  Synthetic
GAAWDRA

SEQ ID NO: 16944 - protein, 7 aa, Artificial Sequence
  Synthetic
PHTQAYG

SEQ ID NO: 16945 - protein, 7 aa, Artificial Sequence
  Synthetic
MPFLVSG

SEQ ID NO: 16946 - protein, 7 aa, Artificial Sequence
  Synthetic
DREAWAS

SEQ ID NO: 16947 - protein, 7 aa, Artificial Sequence
  Synthetic
LATWLPE

SEQ ID NO: 16948 - protein, 7 aa, Artificial Sequence
  Synthetic
VKANWSH

SEQ ID NO: 16949 - protein, 7 aa, Artificial Sequence
  Synthetic
TERWAYS

SEQ ID NO: 16950 - protein, 7 aa, Artificial Sequence
  Synthetic
YLNGYSI

SEQ ID NO: 16951 - protein, 7 aa, Artificial Sequence
  Synthetic
KYVGGST

SEQ ID NO: 16952 - protein, 7 aa, Artificial Sequence
  Synthetic
THAGYSV

SEQ ID NO: 16953 - protein, 7 aa, Artificial Sequence
  Synthetic
EVSGYRW

SEQ ID NO: 16954 - protein, 7 aa, Artificial Sequence
  Synthetic
PWEHMSS

SEQ ID NO: 16955 - protein, 7 aa, Artificial Sequence
  Synthetic
HWSVGSS

SEQ ID NO: 16956 - protein, 7 aa, Artificial Sequence
  Synthetic
VSPAEYW

SEQ ID NO: 16957 - protein, 7 aa, Artificial Sequence
  Synthetic
LYVAGST

SEQ ID NO: 16958 - protein, 7 aa, Artificial Sequence
  Synthetic
ERYNTSQ

SEQ ID NO: 16959 - protein, 7 aa, Artificial Sequence
  Synthetic
QERPKPH

SEQ ID NO: 16960 - protein, 7 aa, Artificial Sequence
  Synthetic
EITHGAA

SEQ ID NO: 16961 - protein, 7 aa, Artificial Sequence
  Synthetic
FSSLFSA

SEQ ID NO: 16962 - protein, 7 aa, Artificial Sequence
  Synthetic
SHPGYSM

SEQ ID NO: 16963 - protein, 7 aa, Artificial Sequence
  Synthetic
HVLYGAS

SEQ ID NO: 16964 - protein, 7 aa, Artificial Sequence
  Synthetic
AWIPAAS

SEQ ID NO: 16965 - protein, 7 aa, Artificial Sequence
  Synthetic
WDRNIYM

SEQ ID NO: 16966 - protein, 7 aa, Artificial Sequence
  Synthetic
ERPFGSS

SEQ ID NO: 16967 - protein, 7 aa, Artificial Sequence
  Synthetic
YGSLGLY

SEQ ID NO: 16968 - protein, 7 aa, Artificial Sequence
  Synthetic
APVHNGW

SEQ ID NO: 16969 - protein, 7 aa, Artificial Sequence
  Synthetic
IVHGFST

SEQ ID NO: 16970 - protein, 7 aa, Artificial Sequence
  Synthetic
LVERSYW

SEQ ID NO: 16971 - protein, 7 aa, Artificial Sequence
  Synthetic
GPKWALD

SEQ ID NO: 16972 - protein, 7 aa, Artificial Sequence
  Synthetic
LLYGHAQ

SEQ ID NO: 16973 - protein, 7 aa, Artificial Sequence
  Synthetic
PLHGRWE

SEQ ID NO: 16974 - protein, 7 aa, Artificial Sequence
  Synthetic
KQNYEHW

SEQ ID NO: 16975 - protein, 7 aa, Artificial Sequence
  Synthetic
MWEGGHR

SEQ ID NO: 16976 - protein, 7 aa, Artificial Sequence
  Synthetic
APEWRSD

SEQ ID NO: 16977 - protein, 7 aa, Artificial Sequence
  Synthetic
WKHGGAS

SEQ ID NO: 16978 - protein, 7 aa, Artificial Sequence
  Synthetic
SYDLRFI

SEQ ID NO: 16979 - protein, 7 aa, Artificial Sequence
  Synthetic
LGPTRGW

SEQ ID NO: 16980 - protein, 7 aa, Artificial Sequence
  Synthetic
LHYGSSS

SEQ ID NO: 16981 - protein, 7 aa, Artificial Sequence
  Synthetic
LPHAQRL

SEQ ID NO: 16982 - protein, 7 aa, Artificial Sequence
  Synthetic
QKWELPS

SEQ ID NO: 16983 - protein, 7 aa, Artificial Sequence
  Synthetic
DLRFLAS

SEQ ID NO: 16984 - protein, 7 aa, Artificial Sequence
  Synthetic
DDNTHRW

SEQ ID NO: 16985 - protein, 7 aa, Artificial Sequence
  Synthetic
CQVGFSS

SEQ ID NO: 16986 - protein, 7 aa, Artificial Sequence
  Synthetic
WKLNEGY

SEQ ID NO: 16987 - protein, 7 aa, Artificial Sequence
  Synthetic
IWYDGAT

SEQ ID NO: 16988 - protein, 7 aa, Artificial Sequence
  Synthetic
EQWQRLP

SEQ ID NO: 16989 - protein, 7 aa, Artificial Sequence
  Synthetic
ISQWHTH

SEQ ID NO: 16990 - protein, 7 aa, Artificial Sequence
  Synthetic
RWASDAS

SEQ ID NO: 16991 - protein, 7 aa, Artificial Sequence
  Synthetic
TFPAQSS

SEQ ID NO: 16992 - protein, 7 aa, Artificial Sequence
  Synthetic
EAPGRWS

SEQ ID NO: 16993 - protein, 7 aa, Artificial Sequence
  Synthetic
GHWAEVR

SEQ ID NO: 16994 - protein, 7 aa, Artificial Sequence
  Synthetic
SFHGGST

SEQ ID NO: 16995 - protein, 7 aa, Artificial Sequence
  Synthetic
FGSLQHL

SEQ ID NO: 16996 - protein, 7 aa, Artificial Sequence
  Synthetic
REVNWST

SEQ ID NO: 16997 - protein, 7 aa, Artificial Sequence
  Synthetic
PEYRVNY

SEQ ID NO: 16998 - protein, 7 aa, Artificial Sequence
  Synthetic
EMPAARY

SEQ ID NO: 16999 - protein, 7 aa, Artificial Sequence
  Synthetic
CYPLGQC

SEQ ID NO: 17000 - protein, 7 aa, Artificial Sequence
  Synthetic
WGMLSEF

SEQ ID NO: 17001 - protein, 7 aa, Artificial Sequence
  Synthetic
SGVGWSS

SEQ ID NO: 17002 - protein, 7 aa, Artificial Sequence
  Synthetic
HVHNGNR

SEQ ID NO: 17003 - protein, 7 aa, Artificial Sequence
  Synthetic
GEHKGSW

SEQ ID NO: 17004 - protein, 7 aa, Artificial Sequence
  Synthetic
LNAGLAM

SEQ ID NO: 17005 - protein, 7 aa, Artificial Sequence
  Synthetic
TPLYDSW

SEQ ID NO: 17006 - protein, 7 aa, Artificial Sequence
  Synthetic
REFDLRV

SEQ ID NO: 17007 - protein, 7 aa, Artificial Sequence
  Synthetic
YGSLSVV

SEQ ID NO: 17008 - protein, 7 aa, Artificial Sequence
  Synthetic
RLHSGPN

SEQ ID NO: 17009 - protein, 7 aa, Artificial Sequence
  Synthetic
FAQGFSS

SEQ ID NO: 17010 - protein, 7 aa, Artificial Sequence
  Synthetic
GVVAGAW

SEQ ID NO: 17011 - protein, 7 aa, Artificial Sequence
  Synthetic
WKTNGSQ

SEQ ID NO: 17012 - protein, 7 aa, Artificial Sequence
  Synthetic
NLTGSLW

SEQ ID NO: 17013 - protein, 7 aa, Artificial Sequence
  Synthetic
RYVAELT

SEQ ID NO: 17014 - protein, 7 aa, Artificial Sequence
  Synthetic
RWGDDLF

SEQ ID NO: 17015 - protein, 7 aa, Artificial Sequence
  Synthetic
HQQLAHK

SEQ ID NO: 17016 - protein, 7 aa, Artificial Sequence
  Synthetic
SPGWRSD

SEQ ID NO: 17017 - protein, 7 aa, Artificial Sequence
  Synthetic
EEPNSWK

SEQ ID NO: 17018 - protein, 7 aa, Artificial Sequence
  Synthetic
GSKWDMA

SEQ ID NO: 17019 - protein, 7 aa, Artificial Sequence
  Synthetic
RYLGETS

SEQ ID NO: 17020 - protein, 7 aa, Artificial Sequence
  Synthetic
WKNLGSV

SEQ ID NO: 17021 - protein, 7 aa, Artificial Sequence
  Synthetic
ELHSPRW

SEQ ID NO: 17022 - protein, 7 aa, Artificial Sequence
  Synthetic
EYEGWSS

SEQ ID NO: 17023 - protein, 7 aa, Artificial Sequence
  Synthetic
NTDHQHW

SEQ ID NO: 17024 - protein, 7 aa, Artificial Sequence
  Synthetic
LRTMGST

SEQ ID NO: 17025 - protein, 7 aa, Artificial Sequence
  Synthetic
WDTRSWV

SEQ ID NO: 17026 - protein, 7 aa, Artificial Sequence
  Synthetic
VSYNGTW

SEQ ID NO: 17027 - protein, 7 aa, Artificial Sequence
  Synthetic
SDLSARY

SEQ ID NO: 17028 - protein, 7 aa, Artificial Sequence
  Synthetic
PWSLGSA

SEQ ID NO: 17029 - protein, 7 aa, Artificial Sequence
  Synthetic
VPRWALE

SEQ ID NO: 17030 - protein, 7 aa, Artificial Sequence
  Synthetic
GHPLSTY

SEQ ID NO: 17031 - protein, 7 aa, Artificial Sequence
  Synthetic
SHWEGAA

SEQ ID NO: 17032 - protein, 7 aa, Artificial Sequence
  Synthetic
SGPWMAT

SEQ ID NO: 17033 - protein, 7 aa, Artificial Sequence
  Synthetic
PWPGNSA

SEQ ID NO: 17034 - protein, 7 aa, Artificial Sequence
  Synthetic
YVAWPDA

SEQ ID NO: 17035 - protein, 7 aa, Artificial Sequence
  Synthetic
FVSLPEV

SEQ ID NO: 17036 - protein, 7 aa, Artificial Sequence
  Synthetic
TWSLSTP

SEQ ID NO: 17037 - protein, 7 aa, Artificial Sequence
  Synthetic
VGEYGRW

SEQ ID NO: 17038 - protein, 7 aa, Artificial Sequence
  Synthetic
LWAGSSM

SEQ ID NO: 17039 - protein, 7 aa, Artificial Sequence
  Synthetic
DLHTGRW

SEQ ID NO: 17040 - protein, 7 aa, Artificial Sequence
  Synthetic
REGSYVW

SEQ ID NO: 17041 - protein, 7 aa, Artificial Sequence
  Synthetic
LAYQLGH

SEQ ID NO: 17042 - protein, 7 aa, Artificial Sequence
  Synthetic
GYNGNLR

SEQ ID NO: 17043 - protein, 7 aa, Artificial Sequence
  Synthetic
NRLGYSS

SEQ ID NO: 17044 - protein, 7 aa, Artificial Sequence
  Synthetic
LIPGSSM

SEQ ID NO: 17045 - protein, 7 aa, Artificial Sequence
  Synthetic
SVYRGST

SEQ ID NO: 17046 - protein, 7 aa, Artificial Sequence
  Synthetic
VSKGYSS

SEQ ID NO: 17047 - protein, 7 aa, Artificial Sequence
  Synthetic
GDLPGRW

SEQ ID NO: 17048 - protein, 7 aa, Artificial Sequence
  Synthetic
ILPGWST

SEQ ID NO: 17049 - protein, 7 aa, Artificial Sequence
  Synthetic
YVELPGV

SEQ ID NO: 17050 - protein, 7 aa, Artificial Sequence
  Synthetic
LYIGSAS

SEQ ID NO: 17051 - protein, 7 aa, Artificial Sequence
  Synthetic
WVTLPSL

SEQ ID NO: 17052 - protein, 7 aa, Artificial Sequence
  Synthetic
DKWNLNI

SEQ ID NO: 17053 - protein, 7 aa, Artificial Sequence
  Synthetic
GSSLGVW

SEQ ID NO: 17054 - protein, 7 aa, Artificial Sequence
  Synthetic
WVAGVPR

SEQ ID NO: 17055 - protein, 7 aa, Artificial Sequence
  Synthetic
NVGREWT

SEQ ID NO: 17056 - protein, 7 aa, Artificial Sequence
  Synthetic
EAGFALE

SEQ ID NO: 17057 - protein, 7 aa, Artificial Sequence
  Synthetic
TFVHGAA

SEQ ID NO: 17058 - protein, 7 aa, Artificial Sequence
  Synthetic
EHSGARW

SEQ ID NO: 17059 - protein, 7 aa, Artificial Sequence
  Synthetic
THAGWAT

SEQ ID NO: 17060 - protein, 7 aa, Artificial Sequence
  Synthetic
VARGYAQ

SEQ ID NO: 17061 - protein, 7 aa, Artificial Sequence
  Synthetic
DGYPGKW

SEQ ID NO: 17062 - protein, 7 aa, Artificial Sequence
  Synthetic
VDPTLRY

SEQ ID NO: 17063 - protein, 7 aa, Artificial Sequence
  Synthetic
GQVWERV

SEQ ID NO: 17064 - protein, 7 aa, Artificial Sequence
  Synthetic
SVENSWK

SEQ ID NO: 17065 - protein, 7 aa, Artificial Sequence
  Synthetic
HPPTTSR

SEQ ID NO: 17066 - protein, 7 aa, Artificial Sequence
  Synthetic
MSATQHW

SEQ ID NO: 17067 - protein, 7 aa, Artificial Sequence
  Synthetic
GIDAARW

SEQ ID NO: 17068 - protein, 7 aa, Artificial Sequence
  Synthetic
IEHSGRW

SEQ ID NO: 17069 - protein, 7 aa, Artificial Sequence
  Synthetic
MHRFAID

SEQ ID NO: 17070 - protein, 7 aa, Artificial Sequence
  Synthetic
PQYVTGW

SEQ ID NO: 17071 - protein, 7 aa, Artificial Sequence
  Synthetic
WIGGGFN

SEQ ID NO: 17072 - protein, 7 aa, Artificial Sequence
  Synthetic
RGAGMAQ

SEQ ID NO: 17073 - protein, 7 aa, Artificial Sequence
  Synthetic
RMQALHN

SEQ ID NO: 17074 - protein, 7 aa, Artificial Sequence
  Synthetic
WVHGYSS

SEQ ID NO: 17075 - protein, 7 aa, Artificial Sequence
  Synthetic
GIGEGRW

SEQ ID NO: 17076 - protein, 7 aa, Artificial Sequence
  Synthetic
WMIGGSV

SEQ ID NO: 17077 - protein, 7 aa, Artificial Sequence
  Synthetic
WSVVEGF

SEQ ID NO: 17078 - protein, 7 aa, Artificial Sequence
  Synthetic
NHSSQHW

SEQ ID NO: 17079 - protein, 7 aa, Artificial Sequence
  Synthetic
LLLREVL

SEQ ID NO: 17080 - protein, 7 aa, Artificial Sequence
  Synthetic
YASYSYG

SEQ ID NO: 17081 - protein, 7 aa, Artificial Sequence
  Synthetic
ISSHSHW

SEQ ID NO: 17082 - protein, 7 aa, Artificial Sequence
  Synthetic
PEMSNRW

SEQ ID NO: 17083 - protein, 7 aa, Artificial Sequence
  Synthetic
DRNSGIW

SEQ ID NO: 17084 - protein, 7 aa, Artificial Sequence
  Synthetic
PRVAYAA

SEQ ID NO: 17085 - protein, 7 aa, Artificial Sequence
  Synthetic
GVYENRW

SEQ ID NO: 17086 - protein, 7 aa, Artificial Sequence
  Synthetic
DRTAWAA

SEQ ID NO: 17087 - protein, 7 aa, Artificial Sequence
  Synthetic
VAHEARW

SEQ ID NO: 17088 - protein, 7 aa, Artificial Sequence
  Synthetic
GDSPGPW

SEQ ID NO: 17089 - protein, 7 aa, Artificial Sequence
  Synthetic
GHVATPR

SEQ ID NO: 17090 - protein, 7 aa, Artificial Sequence
  Synthetic
KYEFGSS

SEQ ID NO: 17091 - protein, 7 aa, Artificial Sequence
  Synthetic
YGLLVTR

SEQ ID NO: 17092 - protein, 7 aa, Artificial Sequence
  Synthetic
ELPGWAT

SEQ ID NO: 17093 - protein, 7 aa, Artificial Sequence
  Synthetic
RNAELMR

SEQ ID NO: 17094 - protein, 7 aa, Artificial Sequence
  Synthetic
SYQGFSS

SEQ ID NO: 17095 - protein, 7 aa, Artificial Sequence
  Synthetic
SRPGYSA

SEQ ID NO: 17096 - protein, 7 aa, Artificial Sequence
  Synthetic
MFVGMSS

SEQ ID NO: 17097 - protein, 7 aa, Artificial Sequence
  Synthetic
HSSPGAW

SEQ ID NO: 17098 - protein, 7 aa, Artificial Sequence
  Synthetic
LLNTGHW

SEQ ID NO: 17099 - protein, 7 aa, Artificial Sequence
  Synthetic
SAYLGSA

SEQ ID NO: 17100 - protein, 7 aa, Artificial Sequence
  Synthetic
GDDKARF

SEQ ID NO: 17101 - protein, 7 aa, Artificial Sequence
  Synthetic
WGTLERY

SEQ ID NO: 17102 - protein, 7 aa, Artificial Sequence
  Synthetic
GTDGARW

SEQ ID NO: 17103 - protein, 7 aa, Artificial Sequence
  Synthetic
LNQQMHR

SEQ ID NO: 17104 - protein, 7 aa, Artificial Sequence
  Synthetic
PSGAAYW

SEQ ID NO: 17105 - protein, 7 aa, Artificial Sequence
  Synthetic
YGSLQSL

SEQ ID NO: 17106 - protein, 7 aa, Artificial Sequence
  Synthetic
TAAWTAS

SEQ ID NO: 17107 - protein, 7 aa, Artificial Sequence
  Synthetic
YEDWYRP

SEQ ID NO: 17108 - protein, 7 aa, Artificial Sequence
  Synthetic
DGRPGVW

SEQ ID NO: 17109 - protein, 7 aa, Artificial Sequence
  Synthetic
WMLMGSA

SEQ ID NO: 17110 - protein, 7 aa, Artificial Sequence
  Synthetic
YPSYLSS

SEQ ID NO: 17111 - protein, 7 aa, Artificial Sequence
  Synthetic
AYPGHAS

SEQ ID NO: 17112 - protein, 7 aa, Artificial Sequence
  Synthetic
PPALLHM

SEQ ID NO: 17113 - protein, 7 aa, Artificial Sequence
  Synthetic
LRVAESS

SEQ ID NO: 17114 - protein, 7 aa, Artificial Sequence
  Synthetic
WGWPGRE

SEQ ID NO: 17115 - protein, 7 aa, Artificial Sequence
  Synthetic
SKNWPGS

SEQ ID NO: 17116 - protein, 7 aa, Artificial Sequence
  Synthetic
MHHPWRE

SEQ ID NO: 17117 - protein, 7 aa, Artificial Sequence
  Synthetic
LLSHGSS

SEQ ID NO: 17118 - protein, 7 aa, Artificial Sequence
  Synthetic
GAAKNAW

SEQ ID NO: 17119 - protein, 7 aa, Artificial Sequence
  Synthetic
LKGIPIV

SEQ ID NO: 17120 - protein, 7 aa, Artificial Sequence
  Synthetic
TFLHGSV

SEQ ID NO: 17121 - protein, 7 aa, Artificial Sequence
  Synthetic
EARYGST

SEQ ID NO: 17122 - protein, 7 aa, Artificial Sequence
  Synthetic
NLAWDRA

SEQ ID NO: 17123 - protein, 7 aa, Artificial Sequence
  Synthetic
ETWGGSS

SEQ ID NO: 17124 - protein, 7 aa, Artificial Sequence
  Synthetic
APLWKAG

SEQ ID NO: 17125 - protein, 7 aa, Artificial Sequence
  Synthetic
WRSGGAQ

SEQ ID NO: 17126 - protein, 7 aa, Artificial Sequence
  Synthetic
DGTTGRW

SEQ ID NO: 17127 - protein, 7 aa, Artificial Sequence
  Synthetic
MLPMGSS

SEQ ID NO: 17128 - protein, 7 aa, Artificial Sequence
  Synthetic
NRVGYSS

SEQ ID NO: 17129 - protein, 7 aa, Artificial Sequence
  Synthetic
WGVLETL

SEQ ID NO: 17130 - protein, 7 aa, Artificial Sequence
  Synthetic
WKQPSGV

SEQ ID NO: 17131 - protein, 7 aa, Artificial Sequence
  Synthetic
DHRVLNY

SEQ ID NO: 17132 - protein, 7 aa, Artificial Sequence
  Synthetic
PTAVGIW

SEQ ID NO: 17133 - protein, 7 aa, Artificial Sequence
  Synthetic
EQKWASS

SEQ ID NO: 17134 - protein, 7 aa, Artificial Sequence
  Synthetic
GHEITRW

SEQ ID NO: 17135 - protein, 7 aa, Artificial Sequence
  Synthetic
MPHSGVW

SEQ ID NO: 17136 - protein, 7 aa, Artificial Sequence
  Synthetic
NHPRELW

SEQ ID NO: 17137 - protein, 7 aa, Artificial Sequence
  Synthetic
RFVSDFA

SEQ ID NO: 17138 - protein, 7 aa, Artificial Sequence
  Synthetic
PRSLYSA

SEQ ID NO: 17139 - protein, 7 aa, Artificial Sequence
  Synthetic
SYDLRFV

SEQ ID NO: 17140 - protein, 7 aa, Artificial Sequence
  Synthetic
GEPNGRW

SEQ ID NO: 17141 - protein, 7 aa, Artificial Sequence
  Synthetic
MRLGAAQ

SEQ ID NO: 17142 - protein, 7 aa, Artificial Sequence
  Synthetic
MIRLGAS

SEQ ID NO: 17143 - protein, 7 aa, Artificial Sequence
  Synthetic
TSGTAYW

SEQ ID NO: 17144 - protein, 7 aa, Artificial Sequence
  Synthetic
VPSIRSI

SEQ ID NO: 17145 - protein, 7 aa, Artificial Sequence
  Synthetic
VLTGWSA

SEQ ID NO: 17146 - protein, 7 aa, Artificial Sequence
  Synthetic
WRPGGSM

SEQ ID NO: 17147 - protein, 7 aa, Artificial Sequence
  Synthetic
HGEVGRW

SEQ ID NO: 17148 - protein, 7 aa, Artificial Sequence
  Synthetic
GVDSARY

SEQ ID NO: 17149 - protein, 7 aa, Artificial Sequence
  Synthetic
TIYHLPT

SEQ ID NO: 17150 - protein, 7 aa, Artificial Sequence
  Synthetic
EKWGMAA

SEQ ID NO: 17151 - protein, 7 aa, Artificial Sequence
  Synthetic
FGSLNAW

SEQ ID NO: 17152 - protein, 7 aa, Artificial Sequence
  Synthetic
NETTRWS

SEQ ID NO: 17153 - protein, 7 aa, Artificial Sequence
  Synthetic
ANPGWST

SEQ ID NO: 17154 - protein, 7 aa, Artificial Sequence
  Synthetic
PYVPAAQ

SEQ ID NO: 17155 - protein, 7 aa, Artificial Sequence
  Synthetic
ALRLMSA

SEQ ID NO: 17156 - protein, 7 aa, Artificial Sequence
  Synthetic
WVLDGSK

SEQ ID NO: 17157 - protein, 7 aa, Artificial Sequence
  Synthetic
DFRHGAS

SEQ ID NO: 17158 - protein, 7 aa, Artificial Sequence
  Synthetic
FWQHGSS

SEQ ID NO: 17159 - protein, 7 aa, Artificial Sequence
  Synthetic
ERHLYSS

SEQ ID NO: 17160 - protein, 7 aa, Artificial Sequence
  Synthetic
LYVGLAQ

SEQ ID NO: 17161 - protein, 7 aa, Artificial Sequence
  Synthetic
ARTYGAA

SEQ ID NO: 17162 - protein, 7 aa, Artificial Sequence
  Synthetic
WPEASWK

SEQ ID NO: 17163 - protein, 7 aa, Artificial Sequence
  Synthetic
LRLGLSS

SEQ ID NO: 17164 - protein, 7 aa, Artificial Sequence
  Synthetic
PKFDLRS

SEQ ID NO: 17165 - protein, 7 aa, Artificial Sequence
  Synthetic
WPMLSKD

SEQ ID NO: 17166 - protein, 7 aa, Artificial Sequence
  Synthetic
MTASRWD

SEQ ID NO: 17167 - protein, 7 aa, Artificial Sequence
  Synthetic
ALSGYRV

SEQ ID NO: 17168 - protein, 7 aa, Artificial Sequence
  Synthetic
WVVHGSQ

SEQ ID NO: 17169 - protein, 7 aa, Artificial Sequence
  Synthetic
PINPGAW

SEQ ID NO: 17170 - protein, 7 aa, Artificial Sequence
  Synthetic
EIFLGAA

SEQ ID NO: 17171 - protein, 7 aa, Artificial Sequence
  Synthetic
GYDTAKW

SEQ ID NO: 17172 - protein, 7 aa, Artificial Sequence
  Synthetic
EYHGGAS

SEQ ID NO: 17173 - protein, 7 aa, Artificial Sequence
  Synthetic
RSVVDRA

SEQ ID NO: 17174 - protein, 7 aa, Artificial Sequence
  Synthetic
WKGHHES

SEQ ID NO: 17175 - protein, 7 aa, Artificial Sequence
  Synthetic
RQTSAEK

SEQ ID NO: 17176 - protein, 7 aa, Artificial Sequence
  Synthetic
WSQFVEG

SEQ ID NO: 17177 - protein, 7 aa, Artificial Sequence
  Synthetic
PEGSARY

SEQ ID NO: 17178 - protein, 7 aa, Artificial Sequence
  Synthetic
GSSVGAW

SEQ ID NO: 17179 - protein, 7 aa, Artificial Sequence
  Synthetic
GSRTFER

SEQ ID NO: 17180 - protein, 7 aa, Artificial Sequence
  Synthetic
WTAGGST

SEQ ID NO: 17181 - protein, 7 aa, Artificial Sequence
  Synthetic
DVKWTTF

SEQ ID NO: 17182 - protein, 7 aa, Artificial Sequence
  Synthetic
PRLQAER

SEQ ID NO: 17183 - protein, 7 aa, Artificial Sequence
  Synthetic
ASDFSSW

SEQ ID NO: 17184 - protein, 7 aa, Artificial Sequence
  Synthetic
LQTYGST

SEQ ID NO: 17185 - protein, 7 aa, Artificial Sequence
  Synthetic
DNWKLPN

SEQ ID NO: 17186 - protein, 7 aa, Artificial Sequence
  Synthetic
EKAGWSV

SEQ ID NO: 17187 - protein, 7 aa, Artificial Sequence
  Synthetic
LSYQGSQ

SEQ ID NO: 17188 - protein, 7 aa, Artificial Sequence
  Synthetic
PAFHLSS

SEQ ID NO: 17189 - protein, 7 aa, Artificial Sequence
  Synthetic
TPTWSSS

SEQ ID NO: 17190 - protein, 7 aa, Artificial Sequence
  Synthetic
PWLGAAS

SEQ ID NO: 17191 - protein, 7 aa, Artificial Sequence
  Synthetic
VDVSLRY

SEQ ID NO: 17192 - protein, 7 aa, Artificial Sequence
  Synthetic
AQHPHGW

SEQ ID NO: 17193 - protein, 7 aa, Artificial Sequence
  Synthetic
VSGEARW

SEQ ID NO: 17194 - protein, 7 aa, Artificial Sequence
  Synthetic
NVLYGSA

SEQ ID NO: 17195 - protein, 7 aa, Artificial Sequence
  Synthetic
EAFMGSA

SEQ ID NO: 17196 - protein, 7 aa, Artificial Sequence
  Synthetic
LVYGSSM

SEQ ID NO: 17197 - protein, 7 aa, Artificial Sequence
  Synthetic
LMEFGST

SEQ ID NO: 17198 - protein, 7 aa, Artificial Sequence
  Synthetic
MKSYDLR

SEQ ID NO: 17199 - protein, 7 aa, Artificial Sequence
  Synthetic
YVQLPDV

SEQ ID NO: 17200 - protein, 7 aa, Artificial Sequence
  Synthetic
WAHATWD

SEQ ID NO: 17201 - protein, 7 aa, Artificial Sequence
  Synthetic
DHYLGST

SEQ ID NO: 17202 - protein, 7 aa, Artificial Sequence
  Synthetic
EKYGTSQ

SEQ ID NO: 17203 - protein, 7 aa, Artificial Sequence
  Synthetic
AHVYGST

SEQ ID NO: 17204 - protein, 7 aa, Artificial Sequence
  Synthetic
MWEGDSS

SEQ ID NO: 17205 - protein, 7 aa, Artificial Sequence
  Synthetic
EFHQGSA

SEQ ID NO: 17206 - protein, 7 aa, Artificial Sequence
  Synthetic
DRPVGVW

SEQ ID NO: 17207 - protein, 7 aa, Artificial Sequence
  Synthetic
YLHGYTN

SEQ ID NO: 17208 - protein, 7 aa, Artificial Sequence
  Synthetic
DIVGNRW

SEQ ID NO: 17209 - protein, 7 aa, Artificial Sequence
  Synthetic
DVSGYRW

SEQ ID NO: 17210 - protein, 7 aa, Artificial Sequence
  Synthetic
PYYGAAS

SEQ ID NO: 17211 - protein, 7 aa, Artificial Sequence
  Synthetic
VRAGDWA

SEQ ID NO: 17212 - protein, 7 aa, Artificial Sequence
  Synthetic
MMKLGSA

SEQ ID NO: 17213 - protein, 7 aa, Artificial Sequence
  Synthetic
YGALNYM

SEQ ID NO: 17214 - protein, 7 aa, Artificial Sequence
  Synthetic
WDVKGGY

SEQ ID NO: 17215 - protein, 7 aa, Artificial Sequence
  Synthetic
HYHGGSQ

SEQ ID NO: 17216 - protein, 7 aa, Artificial Sequence
  Synthetic
EPWHLAY

SEQ ID NO: 17217 - protein, 7 aa, Artificial Sequence
  Synthetic
LLAGYAI

SEQ ID NO: 17218 - protein, 7 aa, Artificial Sequence
  Synthetic
YHFSQAM

SEQ ID NO: 17219 - protein, 7 aa, Artificial Sequence
  Synthetic
ILSGYTL

SEQ ID NO: 17220 - protein, 7 aa, Artificial Sequence
  Synthetic
EYVPASS

SEQ ID NO: 17221 - protein, 7 aa, Artificial Sequence
  Synthetic
DYRLTGF

SEQ ID NO: 17222 - protein, 7 aa, Artificial Sequence
  Synthetic
WGEPSHS

SEQ ID NO: 17223 - protein, 7 aa, Artificial Sequence
  Synthetic
PLGGNFR

SEQ ID NO: 17224 - protein, 7 aa, Artificial Sequence
  Synthetic
KANVGPW

SEQ ID NO: 17225 - protein, 7 aa, Artificial Sequence
  Synthetic
CRSFGSA

SEQ ID NO: 17226 - protein, 7 aa, Artificial Sequence
  Synthetic
EHHGFSM

SEQ ID NO: 17227 - protein, 7 aa, Artificial Sequence
  Synthetic
QVASQVW

SEQ ID NO: 17228 - protein, 7 aa, Artificial Sequence
  Synthetic
MDLMPRG

SEQ ID NO: 17229 - protein, 7 aa, Artificial Sequence
  Synthetic
FMIGGAQ

SEQ ID NO: 17230 - protein, 7 aa, Artificial Sequence
  Synthetic
PAGGFSA

SEQ ID NO: 17231 - protein, 7 aa, Artificial Sequence
  Synthetic
EGGGARW

SEQ ID NO: 17232 - protein, 7 aa, Artificial Sequence
  Synthetic
SLTDRLW

SEQ ID NO: 17233 - protein, 7 aa, Artificial Sequence
  Synthetic
KEQWNDW

SEQ ID NO: 17234 - protein, 7 aa, Artificial Sequence
  Synthetic
LRPNWAM

SEQ ID NO: 17235 - protein, 7 aa, Artificial Sequence
  Synthetic
VDKDNYR

SEQ ID NO: 17236 - protein, 7 aa, Artificial Sequence
  Synthetic
TFAGWSA

SEQ ID NO: 17237 - protein, 7 aa, Artificial Sequence
  Synthetic
PYPKFAA

SEQ ID NO: 17238 - protein, 7 aa, Artificial Sequence
  Synthetic
CYPQLTC

SEQ ID NO: 17239 - protein, 7 aa, Artificial Sequence
  Synthetic
SNLYDLR

SEQ ID NO: 17240 - protein, 7 aa, Artificial Sequence
  Synthetic
DEFSNRW

SEQ ID NO: 17241 - protein, 7 aa, Artificial Sequence
  Synthetic
AVVGGWS

SEQ ID NO: 17242 - protein, 7 aa, Artificial Sequence
  Synthetic
SFSMGSA

SEQ ID NO: 17243 - protein, 7 aa, Artificial Sequence
  Synthetic
LWSGSST

SEQ ID NO: 17244 - protein, 7 aa, Artificial Sequence
  Synthetic
DYRPQAS

SEQ ID NO: 17245 - protein, 7 aa, Artificial Sequence
  Synthetic
VMLGYSS

SEQ ID NO: 17246 - protein, 7 aa, Artificial Sequence
  Synthetic
SVTTAYW

SEQ ID NO: 17247 - protein, 7 aa, Artificial Sequence
  Synthetic
LGAPGLW

SEQ ID NO: 17248 - protein, 7 aa, Artificial Sequence
  Synthetic
ERNPGRW

SEQ ID NO: 17249 - protein, 7 aa, Artificial Sequence
  Synthetic
LLLGYSA

SEQ ID NO: 17250 - protein, 7 aa, Artificial Sequence
  Synthetic
GTSLGPW

SEQ ID NO: 17251 - protein, 7 aa, Artificial Sequence
  Synthetic
VGVVGAW

SEQ ID NO: 17252 - protein, 7 aa, Artificial Sequence
  Synthetic
AHFGGST

SEQ ID NO: 17253 - protein, 7 aa, Artificial Sequence
  Synthetic
GGSPGMW

SEQ ID NO: 17254 - protein, 7 aa, Artificial Sequence
  Synthetic
EVHTRWV

SEQ ID NO: 17255 - protein, 7 aa, Artificial Sequence
  Synthetic
SREFDYR

SEQ ID NO: 17256 - protein, 7 aa, Artificial Sequence
  Synthetic
PRNVGIY

SEQ ID NO: 17257 - protein, 7 aa, Artificial Sequence
  Synthetic
PEDSARY

SEQ ID NO: 17258 - protein, 7 aa, Artificial Sequence
  Synthetic
EFNGARW

SEQ ID NO: 17259 - protein, 7 aa, Artificial Sequence
  Synthetic
MREGWSS

SEQ ID NO: 17260 - protein, 7 aa, Artificial Sequence
  Synthetic
AGAPGAW

SEQ ID NO: 17261 - protein, 7 aa, Artificial Sequence
  Synthetic
PYAHGSS

SEQ ID NO: 17262 - protein, 7 aa, Artificial Sequence
  Synthetic
WRLELGW

SEQ ID NO: 17263 - protein, 7 aa, Artificial Sequence
  Synthetic
SRPHMGM

SEQ ID NO: 17264 - protein, 7 aa, Artificial Sequence
  Synthetic
WREHGAA

SEQ ID NO: 17265 - protein, 7 aa, Artificial Sequence
  Synthetic
LKMSFSS

SEQ ID NO: 17266 - protein, 7 aa, Artificial Sequence
  Synthetic
GFGSYGG

SEQ ID NO: 17267 - protein, 7 aa, Artificial Sequence
  Synthetic
GQWRLDV

SEQ ID NO: 17268 - protein, 7 aa, Artificial Sequence
  Synthetic
TFARGAA

SEQ ID NO: 17269 - protein, 7 aa, Artificial Sequence
  Synthetic
SLHGFAQ

SEQ ID NO: 17270 - protein, 7 aa, Artificial Sequence
  Synthetic
KDVNWSS

SEQ ID NO: 17271 - protein, 7 aa, Artificial Sequence
  Synthetic
GSTIGPW

SEQ ID NO: 17272 - protein, 7 aa, Artificial Sequence
  Synthetic
GSNMGQW

SEQ ID NO: 17273 - protein, 7 aa, Artificial Sequence
  Synthetic
SKPVGIW

SEQ ID NO: 17274 - protein, 7 aa, Artificial Sequence
  Synthetic
YGSWSSI

SEQ ID NO: 17275 - protein, 7 aa, Artificial Sequence
  Synthetic
EWRGSAT

SEQ ID NO: 17276 - protein, 7 aa, Artificial Sequence
  Synthetic
WNVYGSQ

SEQ ID NO: 17277 - protein, 7 aa, Artificial Sequence
  Synthetic
LRLGDYS

SEQ ID NO: 17278 - protein, 7 aa, Artificial Sequence
  Synthetic
DQSSRWA

SEQ ID NO: 17279 - protein, 7 aa, Artificial Sequence
  Synthetic
GNRTAER

SEQ ID NO: 17280 - protein, 7 aa, Artificial Sequence
  Synthetic
SFLGGSS

SEQ ID NO: 17281 - protein, 7 aa, Artificial Sequence
  Synthetic
PDPWNRA

SEQ ID NO: 17282 - protein, 7 aa, Artificial Sequence
  Synthetic
DSRLLAY

SEQ ID NO: 17283 - protein, 7 aa, Artificial Sequence
  Synthetic
LVRVMER

SEQ ID NO: 17284 - protein, 7 aa, Artificial Sequence
  Synthetic
FHQMVGK

SEQ ID NO: 17285 - protein, 7 aa, Artificial Sequence
  Synthetic
FKNLPEI

SEQ ID NO: 17286 - protein, 7 aa, Artificial Sequence
  Synthetic
QEPWHVR

SEQ ID NO: 17287 - protein, 7 aa, Artificial Sequence
  Synthetic
CRNERVH

SEQ ID NO: 17288 - protein, 7 aa, Artificial Sequence
  Synthetic
PEYRLPH

SEQ ID NO: 17289 - protein, 7 aa, Artificial Sequence
  Synthetic
ERTGFSA

SEQ ID NO: 17290 - protein, 7 aa, Artificial Sequence
  Synthetic
EARLYSS

SEQ ID NO: 17291 - protein, 7 aa, Artificial Sequence
  Synthetic
WDRSGSM

SEQ ID NO: 17292 - protein, 7 aa, Artificial Sequence
  Synthetic
PPNRLRE

SEQ ID NO: 17293 - protein, 7 aa, Artificial Sequence
  Synthetic
KHTIAQI

SEQ ID NO: 17294 - protein, 7 aa, Artificial Sequence
  Synthetic
SDSPGRW

SEQ ID NO: 17295 - protein, 7 aa, Artificial Sequence
  Synthetic
RLEYNNW

SEQ ID NO: 17296 - protein, 7 aa, Artificial Sequence
  Synthetic
QKNGAMW

SEQ ID NO: 17297 - protein, 7 aa, Artificial Sequence
  Synthetic
ERWGGAT

SEQ ID NO: 17298 - protein, 7 aa, Artificial Sequence
  Synthetic
WGSLGVH

SEQ ID NO: 17299 - protein, 7 aa, Artificial Sequence
  Synthetic
GENLSRW

SEQ ID NO: 17300 - protein, 7 aa, Artificial Sequence
  Synthetic
PKVILHN

SEQ ID NO: 17301 - protein, 7 aa, Artificial Sequence
  Synthetic
RAGSMRD

SEQ ID NO: 17302 - protein, 7 aa, Artificial Sequence
  Synthetic
LRIALSN

SEQ ID NO: 17303 - protein, 7 aa, Artificial Sequence
  Synthetic
EHSGGRW

SEQ ID NO: 17304 - protein, 7 aa, Artificial Sequence
  Synthetic
AGLNWSH

SEQ ID NO: 17305 - protein, 7 aa, Artificial Sequence
  Synthetic
DVFRGST

SEQ ID NO: 17306 - protein, 7 aa, Artificial Sequence
  Synthetic
WKTGYSS

SEQ ID NO: 17307 - protein, 7 aa, Artificial Sequence
  Synthetic
WSAFIEG

SEQ ID NO: 17308 - protein, 7 aa, Artificial Sequence
  Synthetic
PTYGVIP

SEQ ID NO: 17309 - protein, 7 aa, Artificial Sequence
  Synthetic
ESYLAYM

SEQ ID NO: 17310 - protein, 7 aa, Artificial Sequence
  Synthetic
SLKWEAS

SEQ ID NO: 17311 - protein, 7 aa, Artificial Sequence
  Synthetic
PAANWAA

SEQ ID NO: 17312 - protein, 7 aa, Artificial Sequence
  Synthetic
LFQLGSS

SEQ ID NO: 17313 - protein, 7 aa, Artificial Sequence
  Synthetic
LSEFSYY

SEQ ID NO: 17314 - protein, 7 aa, Artificial Sequence
  Synthetic
LRDSQIR

SEQ ID NO: 17315 - protein, 7 aa, Artificial Sequence
  Synthetic
AARDFHW

SEQ ID NO: 17316 - protein, 7 aa, Artificial Sequence
  Synthetic
LWSPQAS

SEQ ID NO: 17317 - protein, 7 aa, Artificial Sequence
  Synthetic
DMFREPW

SEQ ID NO: 17318 - protein, 7 aa, Artificial Sequence
  Synthetic
SWQGRNP

SEQ ID NO: 17319 - protein, 7 aa, Artificial Sequence
  Synthetic
GPADSKR

SEQ ID NO: 17320 - protein, 7 aa, Artificial Sequence
  Synthetic
LRVGFSM

SEQ ID NO: 17321 - protein, 7 aa, Artificial Sequence
  Synthetic
VLLYRVG

SEQ ID NO: 17322 - protein, 7 aa, Artificial Sequence
  Synthetic
FNFGMAQ

SEQ ID NO: 17323 - protein, 7 aa, Artificial Sequence
  Synthetic
EGYRGSS

SEQ ID NO: 17324 - protein, 7 aa, Artificial Sequence
  Synthetic
SLLSGFR

SEQ ID NO: 17325 - protein, 7 aa, Artificial Sequence
  Synthetic
VNSLFSY

SEQ ID NO: 17326 - protein, 7 aa, Artificial Sequence
  Synthetic
QVATQIW

SEQ ID NO: 17327 - protein, 7 aa, Artificial Sequence
  Synthetic
TESWRRD

SEQ ID NO: 17328 - protein, 7 aa, Artificial Sequence
  Synthetic
AYERGSS

SEQ ID NO: 17329 - protein, 7 aa, Artificial Sequence
  Synthetic
VERGWSA

SEQ ID NO: 17330 - protein, 7 aa, Artificial Sequence
  Synthetic
RFAGGST

SEQ ID NO: 17331 - protein, 7 aa, Artificial Sequence
  Synthetic
ARVGAAQ

SEQ ID NO: 17332 - protein, 7 aa, Artificial Sequence
  Synthetic
MRGGHLS

SEQ ID NO: 17333 - protein, 7 aa, Artificial Sequence
  Synthetic
LFHMGST

SEQ ID NO: 17334 - protein, 7 aa, Artificial Sequence
  Synthetic
DVLARPW

SEQ ID NO: 17335 - protein, 7 aa, Artificial Sequence
  Synthetic
WLTPIER

SEQ ID NO: 17336 - protein, 7 aa, Artificial Sequence
  Synthetic
IYNPYGE

SEQ ID NO: 17337 - protein, 7 aa, Artificial Sequence
  Synthetic
HAHLGSA

SEQ ID NO: 17338 - protein, 7 aa, Artificial Sequence
  Synthetic
LPADHRW

SEQ ID NO: 17339 - protein, 7 aa, Artificial Sequence
  Synthetic
ARVTDYW

SEQ ID NO: 17340 - protein, 7 aa, Artificial Sequence
  Synthetic
RYPGDSV

SEQ ID NO: 17341 - protein, 7 aa, Artificial Sequence
  Synthetic
GRAEGAW

SEQ ID NO: 17342 - protein, 7 aa, Artificial Sequence
  Synthetic
RDDIARW

SEQ ID NO: 17343 - protein, 7 aa, Artificial Sequence
  Synthetic
WTMAEGW

SEQ ID NO: 17344 - protein, 7 aa, Artificial Sequence
  Synthetic
VWKMGST

SEQ ID NO: 17345 - protein, 7 aa, Artificial Sequence
  Synthetic
SRPGWSV

SEQ ID NO: 17346 - protein, 7 aa, Artificial Sequence
  Synthetic
GVWGLSG

SEQ ID NO: 17347 - protein, 7 aa, Artificial Sequence
  Synthetic
WHTLALT

SEQ ID NO: 17348 - protein, 7 aa, Artificial Sequence
  Synthetic
HQANPSK

SEQ ID NO: 17349 - protein, 7 aa, Artificial Sequence
  Synthetic
IIAGYSA

SEQ ID NO: 17350 - protein, 7 aa, Artificial Sequence
  Synthetic
EYPFSSS

SEQ ID NO: 17351 - protein, 7 aa, Artificial Sequence
  Synthetic
PGYNSAF

SEQ ID NO: 17352 - protein, 7 aa, Artificial Sequence
  Synthetic
YGSLSVT

SEQ ID NO: 17353 - protein, 7 aa, Artificial Sequence
  Synthetic
YVLPGPH

SEQ ID NO: 17354 - protein, 7 aa, Artificial Sequence
  Synthetic
EYRFAAS

SEQ ID NO: 17355 - protein, 7 aa, Artificial Sequence
  Synthetic
LVHQGWS

SEQ ID NO: 17356 - protein, 7 aa, Artificial Sequence
  Synthetic
KVGGSMW

SEQ ID NO: 17357 - protein, 7 aa, Artificial Sequence
  Synthetic
KAPGANW

SEQ ID NO: 17358 - protein, 7 aa, Artificial Sequence
  Synthetic
EHGGVRW

SEQ ID NO: 17359 - protein, 7 aa, Artificial Sequence
  Synthetic
SWSGMSQ

SEQ ID NO: 17360 - protein, 7 aa, Artificial Sequence
  Synthetic
TYHGGAA

SEQ ID NO: 17361 - protein, 7 aa, Artificial Sequence
  Synthetic
ERWQSAA

SEQ ID NO: 17362 - protein, 7 aa, Artificial Sequence
  Synthetic
PIPAQGW

SEQ ID NO: 17363 - protein, 7 aa, Artificial Sequence
  Synthetic
LWPAHSQ

SEQ ID NO: 17364 - protein, 7 aa, Artificial Sequence
  Synthetic
VDFDAHR

SEQ ID NO: 17365 - protein, 7 aa, Artificial Sequence
  Synthetic
VVYGGSQ

SEQ ID NO: 17366 - protein, 7 aa, Artificial Sequence
  Synthetic
FYSLGAE

SEQ ID NO: 17367 - protein, 7 aa, Artificial Sequence
  Synthetic
RFIRDQA

SEQ ID NO: 17368 - protein, 7 aa, Artificial Sequence
  Synthetic
ILVGYSV

SEQ ID NO: 17369 - protein, 7 aa, Artificial Sequence
  Synthetic
WKLGGAT

SEQ ID NO: 17370 - protein, 7 aa, Artificial Sequence
  Synthetic
WVLQGAS

SEQ ID NO: 17371 - protein, 7 aa, Artificial Sequence
  Synthetic
PRERGPW

SEQ ID NO: 17372 - protein, 7 aa, Artificial Sequence
  Synthetic
MSYHGST

SEQ ID NO: 17373 - protein, 7 aa, Artificial Sequence
  Synthetic
SVTTQHW

SEQ ID NO: 17374 - protein, 7 aa, Artificial Sequence
  Synthetic
VHRIVNQ

SEQ ID NO: 17375 - protein, 7 aa, Artificial Sequence
  Synthetic
LIGWGSA

SEQ ID NO: 17376 - protein, 7 aa, Artificial Sequence
  Synthetic
VGYGDYR

SEQ ID NO: 17377 - protein, 7 aa, Artificial Sequence
  Synthetic
WSQFAAG

SEQ ID NO: 17378 - protein, 7 aa, Artificial Sequence
  Synthetic
LLVGMAQ

SEQ ID NO: 17379 - protein, 7 aa, Artificial Sequence
  Synthetic
DASWSAA

SEQ ID NO: 17380 - protein, 7 aa, Artificial Sequence
  Synthetic
DYPSNRW

SEQ ID NO: 17381 - protein, 7 aa, Artificial Sequence
  Synthetic
GHDRGPW

SEQ ID NO: 17382 - protein, 7 aa, Artificial Sequence
  Synthetic
RDDRAVR

SEQ ID NO: 17383 - protein, 7 aa, Artificial Sequence
  Synthetic
DDVSRWA

SEQ ID NO: 17384 - protein, 7 aa, Artificial Sequence
  Synthetic
ERHNYAA

SEQ ID NO: 17385 - protein, 7 aa, Artificial Sequence
  Synthetic
GRSQGHV

SEQ ID NO: 17386 - protein, 7 aa, Artificial Sequence
  Synthetic
LFIGQAS

SEQ ID NO: 17387 - protein, 7 aa, Artificial Sequence
  Synthetic
FVTYGSS

SEQ ID NO: 17388 - protein, 7 aa, Artificial Sequence
  Synthetic
EVEWSYS

SEQ ID NO: 17389 - protein, 7 aa, Artificial Sequence
  Synthetic
NTTTQYW

SEQ ID NO: 17390 - protein, 7 aa, Artificial Sequence
  Synthetic
TYIGLSS

SEQ ID NO: 17391 - protein, 7 aa, Artificial Sequence
  Synthetic
KYDIRSI

SEQ ID NO: 17392 - protein, 7 aa, Artificial Sequence
  Synthetic
WMHGGAA

SEQ ID NO: 17393 - protein, 7 aa, Artificial Sequence
  Synthetic
WHSLATT

SEQ ID NO: 17394 - protein, 7 aa, Artificial Sequence
  Synthetic
IRPAGWS

SEQ ID NO: 17395 - protein, 7 aa, Artificial Sequence
  Synthetic
LDKGTVY

SEQ ID NO: 17396 - protein, 7 aa, Artificial Sequence
  Synthetic
DVMYRGF

SEQ ID NO: 17397 - protein, 7 aa, Artificial Sequence
  Synthetic
PRDGWAS

SEQ ID NO: 17398 - protein, 7 aa, Artificial Sequence
  Synthetic
ARSPNGW

SEQ ID NO: 17399 - protein, 7 aa, Artificial Sequence
  Synthetic
HWTNGSS

SEQ ID NO: 17400 - protein, 7 aa, Artificial Sequence
  Synthetic
TAAWAAS

SEQ ID NO: 17401 - protein, 7 aa, Artificial Sequence
  Synthetic
GSGTSLW

SEQ ID NO: 17402 - protein, 7 aa, Artificial Sequence
  Synthetic
KEVYANW

SEQ ID NO: 17403 - protein, 7 aa, Artificial Sequence
  Synthetic
TQRPPDR

SEQ ID NO: 17404 - protein, 7 aa, Artificial Sequence
  Synthetic
MSTEYWR

SEQ ID NO: 17405 - protein, 7 aa, Artificial Sequence
  Synthetic
SVYEGFR

SEQ ID NO: 17406 - protein, 7 aa, Artificial Sequence
  Synthetic
TYVGSAS

SEQ ID NO: 17407 - protein, 7 aa, Artificial Sequence
  Synthetic
REFESRW

SEQ ID NO: 17408 - protein, 7 aa, Artificial Sequence
  Synthetic
QVVRLVN

SEQ ID NO: 17409 - protein, 7 aa, Artificial Sequence
  Synthetic
PARGMAQ

SEQ ID NO: 17410 - protein, 7 aa, Artificial Sequence
  Synthetic
VSDYASW

SEQ ID NO: 17411 - protein, 7 aa, Artificial Sequence
  Synthetic
RVLPNLI

SEQ ID NO: 17412 - protein, 7 aa, Artificial Sequence
  Synthetic
RWERDAV

SEQ ID NO: 17413 - protein, 7 aa, Artificial Sequence
  Synthetic
TDSRFSY

SEQ ID NO: 17414 - protein, 7 aa, Artificial Sequence
  Synthetic
VANAYGW

SEQ ID NO: 17415 - protein, 7 aa, Artificial Sequence
  Synthetic
SVRLGYA

SEQ ID NO: 17416 - protein, 7 aa, Artificial Sequence
  Synthetic
LAYSQAM

SEQ ID NO: 17417 - protein, 7 aa, Artificial Sequence
  Synthetic
GREGWAY

SEQ ID NO: 17418 - protein, 7 aa, Artificial Sequence
  Synthetic
QVWAGSQ

SEQ ID NO: 17419 - protein, 7 aa, Artificial Sequence
  Synthetic
LSYSQTL

SEQ ID NO: 17420 - protein, 7 aa, Artificial Sequence
  Synthetic
LYLGQST

SEQ ID NO: 17421 - protein, 7 aa, Artificial Sequence
  Synthetic
LRNLGST

SEQ ID NO: 17422 - protein, 7 aa, Artificial Sequence
  Synthetic
SREWSAA

SEQ ID NO: 17423 - protein, 7 aa, Artificial Sequence
  Synthetic
SSPGYSS

SEQ ID NO: 17424 - protein, 7 aa, Artificial Sequence
  Synthetic
MWNSGAS

SEQ ID NO: 17425 - protein, 7 aa, Artificial Sequence
  Synthetic
WSVGGSQ

SEQ ID NO: 17426 - protein, 7 aa, Artificial Sequence
  Synthetic
SDKRSDR

SEQ ID NO: 17427 - protein, 7 aa, Artificial Sequence
  Synthetic
DFRGGAV

SEQ ID NO: 17428 - protein, 7 aa, Artificial Sequence
  Synthetic
VWSGMSQ

SEQ ID NO: 17429 - protein, 7 aa, Artificial Sequence
  Synthetic
TVPNWSS

SEQ ID NO: 17430 - protein, 7 aa, Artificial Sequence
  Synthetic
GGDTGRW

SEQ ID NO: 17431 - protein, 7 aa, Artificial Sequence
  Synthetic
EWMGQAS

SEQ ID NO: 17432 - protein, 7 aa, Artificial Sequence
  Synthetic
HEHVGRW

SEQ ID NO: 17433 - protein, 7 aa, Artificial Sequence
  Synthetic
SAGDNRW

SEQ ID NO: 17434 - protein, 7 aa, Artificial Sequence
  Synthetic
VLIGTVY

SEQ ID NO: 17435 - protein, 7 aa, Artificial Sequence
  Synthetic
SVERQWS

SEQ ID NO: 17436 - protein, 7 aa, Artificial Sequence
  Synthetic
HERGQWN

SEQ ID NO: 17437 - protein, 7 aa, Artificial Sequence
  Synthetic
YGALMGL

SEQ ID NO: 17438 - protein, 7 aa, Artificial Sequence
  Synthetic
RLPVGPW

SEQ ID NO: 17439 - protein, 7 aa, Artificial Sequence
  Synthetic
LAFMFRD

SEQ ID NO: 17440 - protein, 7 aa, Artificial Sequence
  Synthetic
GINNWHT

SEQ ID NO: 17441 - protein, 7 aa, Artificial Sequence
  Synthetic
VMKLFSA

SEQ ID NO: 17442 - protein, 7 aa, Artificial Sequence
  Synthetic
AWGGPPL

SEQ ID NO: 17443 - protein, 7 aa, Artificial Sequence
  Synthetic
EPTWGSS

SEQ ID NO: 17444 - protein, 7 aa, Artificial Sequence
  Synthetic
GGNVGKW

SEQ ID NO: 17445 - protein, 7 aa, Artificial Sequence
  Synthetic
AAVGWST

SEQ ID NO: 17446 - protein, 7 aa, Artificial Sequence
  Synthetic
AEYSRHW

SEQ ID NO: 17447 - protein, 7 aa, Artificial Sequence
  Synthetic
RAEGWSS

SEQ ID NO: 17448 - protein, 7 aa, Artificial Sequence
  Synthetic
KADSYVW

SEQ ID NO: 17449 - protein, 7 aa, Artificial Sequence
  Synthetic
WVLPSMG

SEQ ID NO: 17450 - protein, 7 aa, Artificial Sequence
  Synthetic
LWREGST

SEQ ID NO: 17451 - protein, 7 aa, Artificial Sequence
  Synthetic
LPYDLRL

SEQ ID NO: 17452 - protein, 7 aa, Artificial Sequence
  Synthetic
WGSIAWN

SEQ ID NO: 17453 - protein, 7 aa, Artificial Sequence
  Synthetic
WGGYGST

SEQ ID NO: 17454 - protein, 7 aa, Artificial Sequence
  Synthetic
WFQSGSS

SEQ ID NO: 17455 - protein, 7 aa, Artificial Sequence
  Synthetic
HEFLGSA

SEQ ID NO: 17456 - protein, 7 aa, Artificial Sequence
  Synthetic
IGVLAPY

SEQ ID NO: 17457 - protein, 7 aa, Artificial Sequence
  Synthetic
VGWKLGE

SEQ ID NO: 17458 - protein, 7 aa, Artificial Sequence
  Synthetic
PLHLQYA

SEQ ID NO: 17459 - protein, 7 aa, Artificial Sequence
  Synthetic
KYLGDIM

SEQ ID NO: 17460 - protein, 7 aa, Artificial Sequence
  Synthetic
RHVNHAG

SEQ ID NO: 17461 - protein, 7 aa, Artificial Sequence
  Synthetic
TRVGQSQ

SEQ ID NO: 17462 - protein, 7 aa, Artificial Sequence
  Synthetic
ERYNGSM

SEQ ID NO: 17463 - protein, 7 aa, Artificial Sequence
  Synthetic
ETNVGRW

SEQ ID NO: 17464 - protein, 7 aa, Artificial Sequence
  Synthetic
WKLLGST

SEQ ID NO: 17465 - protein, 7 aa, Artificial Sequence
  Synthetic
WHTLGAS

SEQ ID NO: 17466 - protein, 7 aa, Artificial Sequence
  Synthetic
WGSLNPL

SEQ ID NO: 17467 - protein, 7 aa, Artificial Sequence
  Synthetic
WGPASGY

SEQ ID NO: 17468 - protein, 7 aa, Artificial Sequence
  Synthetic
HARHDGT

SEQ ID NO: 17469 - protein, 7 aa, Artificial Sequence
  Synthetic
GQVLTSR

SEQ ID NO: 17470 - protein, 7 aa, Artificial Sequence
  Synthetic
MYIPHPS

SEQ ID NO: 17471 - protein, 7 aa, Artificial Sequence
  Synthetic
SRFQGST

SEQ ID NO: 17472 - protein, 7 aa, Artificial Sequence
  Synthetic
GVYRDGW

SEQ ID NO: 17473 - protein, 7 aa, Artificial Sequence
  Synthetic
FDLSARY

SEQ ID NO: 17474 - protein, 7 aa, Artificial Sequence
  Synthetic
LTSGMHW

SEQ ID NO: 17475 - protein, 7 aa, Artificial Sequence
  Synthetic
EHVKNLW

SEQ ID NO: 17476 - protein, 7 aa, Artificial Sequence
  Synthetic
VGYSLGL

SEQ ID NO: 17477 - protein, 7 aa, Artificial Sequence
  Synthetic
ERAPWSH

SEQ ID NO: 17478 - protein, 7 aa, Artificial Sequence
  Synthetic
TFFSGAS

SEQ ID NO: 17479 - protein, 7 aa, Artificial Sequence
  Synthetic
SWRLDIP

SEQ ID NO: 17480 - protein, 7 aa, Artificial Sequence
  Synthetic
WGVAAGY

SEQ ID NO: 17481 - protein, 7 aa, Artificial Sequence
  Synthetic
RSLGLSQ

SEQ ID NO: 17482 - protein, 7 aa, Artificial Sequence
  Synthetic
FTHYGSA

SEQ ID NO: 17483 - protein, 7 aa, Artificial Sequence
  Synthetic
EIDRVRW

SEQ ID NO: 17484 - protein, 7 aa, Artificial Sequence
  Synthetic
LWTAGAT

SEQ ID NO: 17485 - protein, 7 aa, Artificial Sequence
  Synthetic
ERFFGAA

SEQ ID NO: 17486 - protein, 7 aa, Artificial Sequence
  Synthetic
KEAWEVR

SEQ ID NO: 17487 - protein, 7 aa, Artificial Sequence
  Synthetic
WGLFLSE

SEQ ID NO: 17488 - protein, 7 aa, Artificial Sequence
  Synthetic
LHAGFGF

SEQ ID NO: 17489 - protein, 7 aa, Artificial Sequence
  Synthetic
ELWSGST

SEQ ID NO: 17490 - protein, 7 aa, Artificial Sequence
  Synthetic
QAHGIPK

SEQ ID NO: 17491 - protein, 7 aa, Artificial Sequence
  Synthetic
PIRGFST

SEQ ID NO: 17492 - protein, 7 aa, Artificial Sequence
  Synthetic
PIPTAYY

SEQ ID NO: 17493 - protein, 7 aa, Artificial Sequence
  Synthetic
RVEPSLR

SEQ ID NO: 17494 - protein, 7 aa, Artificial Sequence
  Synthetic
VKTYGSS

SEQ ID NO: 17495 - protein, 7 aa, Artificial Sequence
  Synthetic
SLPGWSA

SEQ ID NO: 17496 - protein, 7 aa, Artificial Sequence
  Synthetic
GRFMGSV

SEQ ID NO: 17497 - protein, 7 aa, Artificial Sequence
  Synthetic
DSPRAIY

SEQ ID NO: 17498 - protein, 7 aa, Artificial Sequence
  Synthetic
WGVYVSK

SEQ ID NO: 17499 - protein, 7 aa, Artificial Sequence
  Synthetic
RVHGWGD

SEQ ID NO: 17500 - protein, 7 aa, Artificial Sequence
  Synthetic
VYQNPLR

SEQ ID NO: 17501 - protein, 7 aa, Artificial Sequence
  Synthetic
YGFLAAV

SEQ ID NO: 17502 - protein, 7 aa, Artificial Sequence
  Synthetic
GGDRWAY

SEQ ID NO: 17503 - protein, 7 aa, Artificial Sequence
  Synthetic
GRADLSR

SEQ ID NO: 17504 - protein, 7 aa, Artificial Sequence
  Synthetic
LSYGYSV

SEQ ID NO: 17505 - protein, 7 aa, Artificial Sequence
  Synthetic
SERLLPY

SEQ ID NO: 17506 - protein, 7 aa, Artificial Sequence
  Synthetic
MYHGLSF

SEQ ID NO: 17507 - protein, 7 aa, Artificial Sequence
  Synthetic
MFTGFSS

SEQ ID NO: 17508 - protein, 7 aa, Artificial Sequence
  Synthetic
LWDNRAA

SEQ ID NO: 17509 - protein, 7 aa, Artificial Sequence
  Synthetic
LVTHGSS

SEQ ID NO: 17510 - protein, 7 aa, Artificial Sequence
  Synthetic
AREPASR

SEQ ID NO: 17511 - protein, 7 aa, Artificial Sequence
  Synthetic
KIAYSDW

SEQ ID NO: 17512 - protein, 7 aa, Artificial Sequence
  Synthetic
YPNWRSD

SEQ ID NO: 17513 - protein, 7 aa, Artificial Sequence
  Synthetic
GGPYDLR

SEQ ID NO: 17514 - protein, 7 aa, Artificial Sequence
  Synthetic
ILYSQAI

SEQ ID NO: 17515 - protein, 7 aa, Artificial Sequence
  Synthetic
LVPHFSS

SEQ ID NO: 17516 - protein, 7 aa, Artificial Sequence
  Synthetic
WPIMTSD

SEQ ID NO: 17517 - protein, 7 aa, Artificial Sequence
  Synthetic
YSVSHGY

SEQ ID NO: 17518 - protein, 7 aa, Artificial Sequence
  Synthetic
KYETNHW

SEQ ID NO: 17519 - protein, 7 aa, Artificial Sequence
  Synthetic
YHFAGST

SEQ ID NO: 17520 - protein, 7 aa, Artificial Sequence
  Synthetic
QSAGWST

SEQ ID NO: 17521 - protein, 7 aa, Artificial Sequence
  Synthetic
WGSLDVL

SEQ ID NO: 17522 - protein, 7 aa, Artificial Sequence
  Synthetic
WSLEGSR

SEQ ID NO: 17523 - protein, 7 aa, Artificial Sequence
  Synthetic
TTVHAYV

SEQ ID NO: 17524 - protein, 7 aa, Artificial Sequence
  Synthetic
MRGVYAG

SEQ ID NO: 17525 - protein, 7 aa, Artificial Sequence
  Synthetic
PQYSLAI

SEQ ID NO: 17526 - protein, 7 aa, Artificial Sequence
  Synthetic
FVYGTTH

SEQ ID NO: 17527 - protein, 7 aa, Artificial Sequence
  Synthetic
LVIGQSS

SEQ ID NO: 17528 - protein, 7 aa, Artificial Sequence
  Synthetic
VATGGFW

SEQ ID NO: 17529 - protein, 7 aa, Artificial Sequence
  Synthetic
LGYTYKA

SEQ ID NO: 17530 - protein, 7 aa, Artificial Sequence
  Synthetic
RSSHMDW

SEQ ID NO: 17531 - protein, 7 aa, Artificial Sequence
  Synthetic
SPIWKLD

SEQ ID NO: 17532 - protein, 7 aa, Artificial Sequence
  Synthetic
SFVGMSQ

SEQ ID NO: 17533 - protein, 7 aa, Artificial Sequence
  Synthetic
PNLVGGW

SEQ ID NO: 17534 - protein, 7 aa, Artificial Sequence
  Synthetic
WTVGGST

SEQ ID NO: 17535 - protein, 7 aa, Artificial Sequence
  Synthetic
EVMSSRW

SEQ ID NO: 17536 - protein, 7 aa, Artificial Sequence
  Synthetic
SFYGGSH

SEQ ID NO: 17537 - protein, 7 aa, Artificial Sequence
  Synthetic
KPGYTGW

SEQ ID NO: 17538 - protein, 7 aa, Artificial Sequence
  Synthetic
KVDYNGW

SEQ ID NO: 17539 - protein, 7 aa, Artificial Sequence
  Synthetic
AGVGFSM

SEQ ID NO: 17540 - protein, 7 aa, Artificial Sequence
  Synthetic
WGALGPI

SEQ ID NO: 17541 - protein, 7 aa, Artificial Sequence
  Synthetic
WSTNSGW

SEQ ID NO: 17542 - protein, 7 aa, Artificial Sequence
  Synthetic
WIEGGSQ

SEQ ID NO: 17543 - protein, 7 aa, Artificial Sequence
  Synthetic
MHGFGST

SEQ ID NO: 17544 - protein, 7 aa, Artificial Sequence
  Synthetic
CGAHTPW

SEQ ID NO: 17545 - protein, 7 aa, Artificial Sequence
  Synthetic
LKYHLEH

SEQ ID NO: 17546 - protein, 7 aa, Artificial Sequence
  Synthetic
LWVPGAA

SEQ ID NO: 17547 - protein, 7 aa, Artificial Sequence
  Synthetic
EYYRGSV

SEQ ID NO: 17548 - protein, 7 aa, Artificial Sequence
  Synthetic
ARFTEYH

SEQ ID NO: 17549 - protein, 7 aa, Artificial Sequence
  Synthetic
RAPFLAS

SEQ ID NO: 17550 - protein, 7 aa, Artificial Sequence
  Synthetic
VRAGYSS

SEQ ID NO: 17551 - protein, 7 aa, Artificial Sequence
  Synthetic
SIYMGAA

SEQ ID NO: 17552 - protein, 7 aa, Artificial Sequence
  Synthetic
WANGMLK

SEQ ID NO: 17553 - protein, 7 aa, Artificial Sequence
  Synthetic
SKLPYSY

SEQ ID NO: 17554 - protein, 7 aa, Artificial Sequence
  Synthetic
HPAREGR

SEQ ID NO: 17555 - protein, 7 aa, Artificial Sequence
  Synthetic
YSSWQRD

SEQ ID NO: 17556 - protein, 7 aa, Artificial Sequence
  Synthetic
SALPFAF

SEQ ID NO: 17557 - protein, 7 aa, Artificial Sequence
  Synthetic
GGEPGRW

SEQ ID NO: 17558 - protein, 7 aa, Artificial Sequence
  Synthetic
HVNWRAD

SEQ ID NO: 17559 - protein, 7 aa, Artificial Sequence
  Synthetic
PYGAGVW

SEQ ID NO: 17560 - protein, 7 aa, Artificial Sequence
  Synthetic
EHKLFSA

SEQ ID NO: 17561 - protein, 7 aa, Artificial Sequence
  Synthetic
LLLRESL

SEQ ID NO: 17562 - protein, 7 aa, Artificial Sequence
  Synthetic
VRMGQSQ

SEQ ID NO: 17563 - protein, 7 aa, Artificial Sequence
  Synthetic
RGGQGIS

SEQ ID NO: 17564 - protein, 7 aa, Artificial Sequence
  Synthetic
DLSSSRW

SEQ ID NO: 17565 - protein, 7 aa, Artificial Sequence
  Synthetic
RHVADRT

SEQ ID NO: 17566 - protein, 7 aa, Artificial Sequence
  Synthetic
RTYGTSQ

SEQ ID NO: 17567 - protein, 7 aa, Artificial Sequence
  Synthetic
QGPNWST

SEQ ID NO: 17568 - protein, 7 aa, Artificial Sequence
  Synthetic
ERNGWST

SEQ ID NO: 17569 - protein, 7 aa, Artificial Sequence
  Synthetic
PGHLYSA

SEQ ID NO: 17570 - protein, 7 aa, Artificial Sequence
  Synthetic
NGYEGRY

SEQ ID NO: 17571 - protein, 7 aa, Artificial Sequence
  Synthetic
VWGGFSE

SEQ ID NO: 17572 - protein, 7 aa, Artificial Sequence
  Synthetic
RGLGVNH

SEQ ID NO: 17573 - protein, 7 aa, Artificial Sequence
  Synthetic
LVTHGAS

SEQ ID NO: 17574 - protein, 7 aa, Artificial Sequence
  Synthetic
QGGPALR

SEQ ID NO: 17575 - protein, 7 aa, Artificial Sequence
  Synthetic
WVALPTV

SEQ ID NO: 17576 - protein, 7 aa, Artificial Sequence
  Synthetic
WSPGNGY

SEQ ID NO: 17577 - protein, 7 aa, Artificial Sequence
  Synthetic
AEYRGSS

SEQ ID NO: 17578 - protein, 7 aa, Artificial Sequence
  Synthetic
PFPGPLH

SEQ ID NO: 17579 - protein, 7 aa, Artificial Sequence
  Synthetic
SGAPGAW

SEQ ID NO: 17580 - protein, 7 aa, Artificial Sequence
  Synthetic
WSTGQGY

SEQ ID NO: 17581 - protein, 7 aa, Artificial Sequence
  Synthetic
GVDRGKW

SEQ ID NO: 17582 - protein, 7 aa, Artificial Sequence
  Synthetic
ARPSIGY

SEQ ID NO: 17583 - protein, 7 aa, Artificial Sequence
  Synthetic
DSVPGRW

SEQ ID NO: 17584 - protein, 7 aa, Artificial Sequence
  Synthetic
GMVGNGW

SEQ ID NO: 17585 - protein, 7 aa, Artificial Sequence
  Synthetic
SGHGQWA

SEQ ID NO: 17586 - protein, 7 aa, Artificial Sequence
  Synthetic
AMRYGSA

SEQ ID NO: 17587 - protein, 7 aa, Artificial Sequence
  Synthetic
PHPLGYG

SEQ ID NO: 17588 - protein, 7 aa, Artificial Sequence
  Synthetic
ADYDTRW

SEQ ID NO: 17589 - protein, 7 aa, Artificial Sequence
  Synthetic
PVSDGRW

SEQ ID NO: 17590 - protein, 7 aa, Artificial Sequence
  Synthetic
EPSGGRW

SEQ ID NO: 17591 - protein, 7 aa, Artificial Sequence
  Synthetic
SHYGQSS

SEQ ID NO: 17592 - protein, 7 aa, Artificial Sequence
  Synthetic
DVFYSSS

SEQ ID NO: 17593 - protein, 7 aa, Artificial Sequence
  Synthetic
SHPGWAA

SEQ ID NO: 17594 - protein, 7 aa, Artificial Sequence
  Synthetic
AGDIARW

SEQ ID NO: 17595 - protein, 7 aa, Artificial Sequence
  Synthetic
INSWRAD

SEQ ID NO: 17596 - protein, 7 aa, Artificial Sequence
  Synthetic
SYFSQSI

SEQ ID NO: 17597 - protein, 7 aa, Artificial Sequence
  Synthetic
HMMRNNI

SEQ ID NO: 17598 - protein, 7 aa, Artificial Sequence
  Synthetic
EEYMGSS

SEQ ID NO: 17599 - protein, 7 aa, Artificial Sequence
  Synthetic
RTVAEWW

SEQ ID NO: 17600 - protein, 7 aa, Artificial Sequence
  Synthetic
ETYGQRW

SEQ ID NO: 17601 - protein, 7 aa, Artificial Sequence
  Synthetic
WGSLARL

SEQ ID NO: 17602 - protein, 7 aa, Artificial Sequence
  Synthetic
VVTHGWS

SEQ ID NO: 17603 - protein, 7 aa, Artificial Sequence
  Synthetic
GSTVGPW

SEQ ID NO: 17604 - protein, 7 aa, Artificial Sequence
  Synthetic
KFSLVGY

SEQ ID NO: 17605 - protein, 7 aa, Artificial Sequence
  Synthetic
KPHGHGP

SEQ ID NO: 17606 - protein, 7 aa, Artificial Sequence
  Synthetic
VTNPGRW

SEQ ID NO: 17607 - protein, 7 aa, Artificial Sequence
  Synthetic
PIQSGYW

SEQ ID NO: 17608 - protein, 7 aa, Artificial Sequence
  Synthetic
LTQGYSQ

SEQ ID NO: 17609 - protein, 7 aa, Artificial Sequence
  Synthetic
WRDLPEV

SEQ ID NO: 17610 - protein, 7 aa, Artificial Sequence
  Synthetic
GAVIGPR

SEQ ID NO: 17611 - protein, 7 aa, Artificial Sequence
  Synthetic
TLRLGSS

SEQ ID NO: 17612 - protein, 7 aa, Artificial Sequence
  Synthetic
LRANWSA

SEQ ID NO: 17613 - protein, 7 aa, Artificial Sequence
  Synthetic
GASVGAW

SEQ ID NO: 17614 - protein, 7 aa, Artificial Sequence
  Synthetic
SPQWSIA

SEQ ID NO: 17615 - protein, 7 aa, Artificial Sequence
  Synthetic
MNWQGSA

SEQ ID NO: 17616 - protein, 7 aa, Artificial Sequence
  Synthetic
SGDSGRW

SEQ ID NO: 17617 - protein, 7 aa, Artificial Sequence
  Synthetic
TEWRGAA

SEQ ID NO: 17618 - protein, 7 aa, Artificial Sequence
  Synthetic
RNHPSPQ

SEQ ID NO: 17619 - protein, 7 aa, Artificial Sequence
  Synthetic
DERLLQY

SEQ ID NO: 17620 - protein, 7 aa, Artificial Sequence
  Synthetic
IVPGYSS

SEQ ID NO: 17621 - protein, 7 aa, Artificial Sequence
  Synthetic
VITYGSS

SEQ ID NO: 17622 - protein, 7 aa, Artificial Sequence
  Synthetic
WRLSGSA

SEQ ID NO: 17623 - protein, 7 aa, Artificial Sequence
  Synthetic
ILGYGHL

SEQ ID NO: 17624 - protein, 7 aa, Artificial Sequence
  Synthetic
VPADSRW

SEQ ID NO: 17625 - protein, 7 aa, Artificial Sequence
  Synthetic
SFAGGAS

SEQ ID NO: 17626 - protein, 7 aa, Artificial Sequence
  Synthetic
VPYSLTV

SEQ ID NO: 17627 - protein, 7 aa, Artificial Sequence
  Synthetic
RYVPAPA

SEQ ID NO: 17628 - protein, 7 aa, Artificial Sequence
  Synthetic
SFQGGQW

SEQ ID NO: 17629 - protein, 7 aa, Artificial Sequence
  Synthetic
EIITARF

SEQ ID NO: 17630 - protein, 7 aa, Artificial Sequence
  Synthetic
PAVVLKI

SEQ ID NO: 17631 - protein, 7 aa, Artificial Sequence
  Synthetic
LAYMGSV

SEQ ID NO: 17632 - protein, 7 aa, Artificial Sequence
  Synthetic
HERGYSS

SEQ ID NO: 17633 - protein, 7 aa, Artificial Sequence
  Synthetic
LTAGYSS

SEQ ID NO: 17634 - protein, 7 aa, Artificial Sequence
  Synthetic
FGLGYST

SEQ ID NO: 17635 - protein, 7 aa, Artificial Sequence
  Synthetic
RLEWDRA

SEQ ID NO: 17636 - protein, 7 aa, Artificial Sequence
  Synthetic
SMTGPMY

SEQ ID NO: 17637 - protein, 7 aa, Artificial Sequence
  Synthetic
TSRGYAS

SEQ ID NO: 17638 - protein, 7 aa, Artificial Sequence
  Synthetic
VRENHPR

SEQ ID NO: 17639 - protein, 7 aa, Artificial Sequence
  Synthetic
RQLNDSR

SEQ ID NO: 17640 - protein, 7 aa, Artificial Sequence
  Synthetic
VAWNGSI

SEQ ID NO: 17641 - protein, 7 aa, Artificial Sequence
  Synthetic
PWVSAAS

SEQ ID NO: 17642 - protein, 7 aa, Artificial Sequence
  Synthetic
MRMNGSI

SEQ ID NO: 17643 - protein, 7 aa, Artificial Sequence
  Synthetic
LHAGFSH

SEQ ID NO: 17644 - protein, 7 aa, Artificial Sequence
  Synthetic
PWHGTSS

SEQ ID NO: 17645 - protein, 7 aa, Artificial Sequence
  Synthetic
VASLLPY

SEQ ID NO: 17646 - protein, 7 aa, Artificial Sequence
  Synthetic
FRHQSES

SEQ ID NO: 17647 - protein, 7 aa, Artificial Sequence
  Synthetic
RQRSDLA

SEQ ID NO: 17648 - protein, 7 aa, Artificial Sequence
  Synthetic
FVQVAIS

SEQ ID NO: 17649 - protein, 7 aa, Artificial Sequence
  Synthetic
LRHQGSM

SEQ ID NO: 17650 - protein, 7 aa, Artificial Sequence
  Synthetic
LRVQGSS

SEQ ID NO: 17651 - protein, 7 aa, Artificial Sequence
  Synthetic
VTFGYST

SEQ ID NO: 17652 - protein, 7 aa, Artificial Sequence
  Synthetic
SERYGSS

SEQ ID NO: 17653 - protein, 7 aa, Artificial Sequence
  Synthetic
ITSSSWN

SEQ ID NO: 17654 - protein, 7 aa, Artificial Sequence
  Synthetic
GGWDMVV

SEQ ID NO: 17655 - protein, 7 aa, Artificial Sequence
  Synthetic
SYSYGSA

SEQ ID NO: 17656 - protein, 7 aa, Artificial Sequence
  Synthetic
VRYSVGL

SEQ ID NO: 17657 - protein, 7 aa, Artificial Sequence
  Synthetic
DRSPGMW

SEQ ID NO: 17658 - protein, 7 aa, Artificial Sequence
  Synthetic
KFPGASS

SEQ ID NO: 17659 - protein, 7 aa, Artificial Sequence
  Synthetic
DYSHVGW

SEQ ID NO: 17660 - protein, 7 aa, Artificial Sequence
  Synthetic
PFSYSAS

SEQ ID NO: 17661 - protein, 7 aa, Artificial Sequence
  Synthetic
GVYEGMY

SEQ ID NO: 17662 - protein, 7 aa, Artificial Sequence
  Synthetic
IMLSQAM

SEQ ID NO: 17663 - protein, 7 aa, Artificial Sequence
  Synthetic
VQYHLPL

SEQ ID NO: 17664 - protein, 7 aa, Artificial Sequence
  Synthetic
RFTGDNS

SEQ ID NO: 17665 - protein, 7 aa, Artificial Sequence
  Synthetic
GLHVGSW

SEQ ID NO: 17666 - protein, 7 aa, Artificial Sequence
  Synthetic
MGSPGIW

SEQ ID NO: 17667 - protein, 7 aa, Artificial Sequence
  Synthetic
DYRPASH

SEQ ID NO: 17668 - protein, 7 aa, Artificial Sequence
  Synthetic
SRAGYAA

SEQ ID NO: 17669 - protein, 7 aa, Artificial Sequence
  Synthetic
VLRGSVY

SEQ ID NO: 17670 - protein, 7 aa, Artificial Sequence
  Synthetic
PNQFSGY

SEQ ID NO: 17671 - protein, 7 aa, Artificial Sequence
  Synthetic
MAAYQAS

SEQ ID NO: 17672 - protein, 7 aa, Artificial Sequence
  Synthetic
AEWKGSS

SEQ ID NO: 17673 - protein, 7 aa, Artificial Sequence
  Synthetic
WQAYGSV

SEQ ID NO: 17674 - protein, 7 aa, Artificial Sequence
  Synthetic
WTPGGSQ

SEQ ID NO: 17675 - protein, 7 aa, Artificial Sequence
  Synthetic
DEVKPDH

SEQ ID NO: 17676 - protein, 7 aa, Artificial Sequence
  Synthetic
KVESAYW

SEQ ID NO: 17677 - protein, 7 aa, Artificial Sequence
  Synthetic
AASFGSS

SEQ ID NO: 17678 - protein, 7 aa, Artificial Sequence
  Synthetic
AVVGWSS

SEQ ID NO: 17679 - protein, 7 aa, Artificial Sequence
  Synthetic
LIPRGST

SEQ ID NO: 17680 - protein, 7 aa, Artificial Sequence
  Synthetic
FARASWD

SEQ ID NO: 17681 - protein, 7 aa, Artificial Sequence
  Synthetic
ENFRGST

SEQ ID NO: 17682 - protein, 7 aa, Artificial Sequence
  Synthetic
LIAGYSQ

SEQ ID NO: 17683 - protein, 7 aa, Artificial Sequence
  Synthetic
TRVSQWE

SEQ ID NO: 17684 - protein, 7 aa, Artificial Sequence
  Synthetic
AKITNGW

SEQ ID NO: 17685 - protein, 7 aa, Artificial Sequence
  Synthetic
RAGPEMK

SEQ ID NO: 17686 - protein, 7 aa, Artificial Sequence
  Synthetic
GSLKGSW

SEQ ID NO: 17687 - protein, 7 aa, Artificial Sequence
  Synthetic
EKWSGSS

SEQ ID NO: 17688 - protein, 7 aa, Artificial Sequence
  Synthetic
PYVGSAQ

SEQ ID NO: 17689 - protein, 7 aa, Artificial Sequence
  Synthetic
PRFQYGE

SEQ ID NO: 17690 - protein, 7 aa, Artificial Sequence
  Synthetic
TYYHGSA

SEQ ID NO: 17691 - protein, 7 aa, Artificial Sequence
  Synthetic
LLSTDMN

SEQ ID NO: 17692 - protein, 7 aa, Artificial Sequence
  Synthetic
SWHGSAA

SEQ ID NO: 17693 - protein, 7 aa, Artificial Sequence
  Synthetic
FISLPSV

SEQ ID NO: 17694 - protein, 7 aa, Artificial Sequence
  Synthetic
WLRLGSA

SEQ ID NO: 17695 - protein, 7 aa, Artificial Sequence
  Synthetic
WVLPLGG

SEQ ID NO: 17696 - protein, 7 aa, Artificial Sequence
  Synthetic
GLHLNSW

SEQ ID NO: 17697 - protein, 7 aa, Artificial Sequence
  Synthetic
GYSYTGS

SEQ ID NO: 17698 - protein, 7 aa, Artificial Sequence
  Synthetic
MHGQTSR

SEQ ID NO: 17699 - protein, 7 aa, Artificial Sequence
  Synthetic
DFVGARF

SEQ ID NO: 17700 - protein, 7 aa, Artificial Sequence
  Synthetic
VYSLKSI

SEQ ID NO: 17701 - protein, 7 aa, Artificial Sequence
  Synthetic
GNHHGVW

SEQ ID NO: 17702 - protein, 7 aa, Artificial Sequence
  Synthetic
SVWGGAQ

SEQ ID NO: 17703 - protein, 7 aa, Artificial Sequence
  Synthetic
TQWKFEH

SEQ ID NO: 17704 - protein, 7 aa, Artificial Sequence
  Synthetic
RSDHMLW

SEQ ID NO: 17705 - protein, 7 aa, Artificial Sequence
  Synthetic
PAWGQAY

SEQ ID NO: 17706 - protein, 7 aa, Artificial Sequence
  Synthetic
ITTLVVA

SEQ ID NO: 17707 - protein, 7 aa, Artificial Sequence
  Synthetic
NHARAIS

SEQ ID NO: 17708 - protein, 7 aa, Artificial Sequence
  Synthetic
EIPTWSH

SEQ ID NO: 17709 - protein, 7 aa, Artificial Sequence
  Synthetic
GTYTGYG

SEQ ID NO: 17710 - protein, 7 aa, Artificial Sequence
  Synthetic
RFHSDAS

SEQ ID NO: 17711 - protein, 7 aa, Artificial Sequence
  Synthetic
MISRGSA

SEQ ID NO: 17712 - protein, 7 aa, Artificial Sequence
  Synthetic
YVPLPYF

SEQ ID NO: 17713 - protein, 7 aa, Artificial Sequence
  Synthetic
SGLFMST

SEQ ID NO: 17714 - protein, 7 aa, Artificial Sequence
  Synthetic
VERLGSA

SEQ ID NO: 17715 - protein, 7 aa, Artificial Sequence
  Synthetic
YATWSAN

SEQ ID NO: 17716 - protein, 7 aa, Artificial Sequence
  Synthetic
ESWGTAQ

SEQ ID NO: 17717 - protein, 7 aa, Artificial Sequence
  Synthetic
PEVAGRW

SEQ ID NO: 17718 - protein, 7 aa, Artificial Sequence
  Synthetic
DLMTSRW

SEQ ID NO: 17719 - protein, 7 aa, Artificial Sequence
  Synthetic
LYSGYTP

SEQ ID NO: 17720 - protein, 7 aa, Artificial Sequence
  Synthetic
EPYRAFT

SEQ ID NO: 17721 - protein, 7 aa, Artificial Sequence
  Synthetic
GSSPGMW

SEQ ID NO: 17722 - protein, 7 aa, Artificial Sequence
  Synthetic
GVDSYRW

SEQ ID NO: 17723 - protein, 7 aa, Artificial Sequence
  Synthetic
WGALNRM

SEQ ID NO: 17724 - protein, 7 aa, Artificial Sequence
  Synthetic
VREEIRR

SEQ ID NO: 17725 - protein, 7 aa, Artificial Sequence
  Synthetic
DVWNGST

SEQ ID NO: 17726 - protein, 7 aa, Artificial Sequence
  Synthetic
DRDRGLR

SEQ ID NO: 17727 - protein, 7 aa, Artificial Sequence
  Synthetic
CNGRSCS

SEQ ID NO: 17728 - protein, 7 aa, Artificial Sequence
  Synthetic
YVEFPRL

SEQ ID NO: 17729 - protein, 7 aa, Artificial Sequence
  Synthetic
VWPATST

SEQ ID NO: 17730 - protein, 7 aa, Artificial Sequence
  Synthetic
TPRNWHD

SEQ ID NO: 17731 - protein, 7 aa, Artificial Sequence
  Synthetic
AAWGSVS

SEQ ID NO: 17732 - protein, 7 aa, Artificial Sequence
  Synthetic
DTIKPNR

SEQ ID NO: 17733 - protein, 7 aa, Artificial Sequence
  Synthetic
SYERTWD

SEQ ID NO: 17734 - protein, 7 aa, Artificial Sequence
  Synthetic
EPRDFSW

SEQ ID NO: 17735 - protein, 7 aa, Artificial Sequence
  Synthetic
RGDVTMR

SEQ ID NO: 17736 - protein, 7 aa, Artificial Sequence
  Synthetic
RAAGFSS

SEQ ID NO: 17737 - protein, 7 aa, Artificial Sequence
  Synthetic
RYASDAA

SEQ ID NO: 17738 - protein, 7 aa, Artificial Sequence
  Synthetic
RDSYRDW

SEQ ID NO: 17739 - protein, 7 aa, Artificial Sequence
  Synthetic
GEHMGMW

SEQ ID NO: 17740 - protein, 7 aa, Artificial Sequence
  Synthetic
VIDSQHW

SEQ ID NO: 17741 - protein, 7 aa, Artificial Sequence
  Synthetic
FVSLPDV

SEQ ID NO: 17742 - protein, 7 aa, Artificial Sequence
  Synthetic
LGWGSST

SEQ ID NO: 17743 - protein, 7 aa, Artificial Sequence
  Synthetic
IFPGESQ

SEQ ID NO: 17744 - protein, 7 aa, Artificial Sequence
  Synthetic
HGSGALK

SEQ ID NO: 17745 - protein, 7 aa, Artificial Sequence
  Synthetic
SGWHGSS

SEQ ID NO: 17746 - protein, 7 aa, Artificial Sequence
  Synthetic
AVGARVT

SEQ ID NO: 17747 - protein, 7 aa, Artificial Sequence
  Synthetic
RNVNVDR

SEQ ID NO: 17748 - protein, 7 aa, Artificial Sequence
  Synthetic
WKSTTTH

SEQ ID NO: 17749 - protein, 7 aa, Artificial Sequence
  Synthetic
GMRDPVW

SEQ ID NO: 17750 - protein, 7 aa, Artificial Sequence
  Synthetic
VGPHRPH

SEQ ID NO: 17751 - protein, 7 aa, Artificial Sequence
  Synthetic
TGHAGIW

SEQ ID NO: 17752 - protein, 7 aa, Artificial Sequence
  Synthetic
LNYSHSM

SEQ ID NO: 17753 - protein, 7 aa, Artificial Sequence
  Synthetic
YGRLDAL

SEQ ID NO: 17754 - protein, 7 aa, Artificial Sequence
  Synthetic
WGALSGL

SEQ ID NO: 17755 - protein, 7 aa, Artificial Sequence
  Synthetic
VASGWST

SEQ ID NO: 17756 - protein, 7 aa, Artificial Sequence
  Synthetic
DAVAVRW

SEQ ID NO: 17757 - protein, 7 aa, Artificial Sequence
  Synthetic
IMRNLVH

SEQ ID NO: 17758 - protein, 7 aa, Artificial Sequence
  Synthetic
AGHRTLA

SEQ ID NO: 17759 - protein, 7 aa, Artificial Sequence
  Synthetic
KVIQASW

SEQ ID NO: 17760 - protein, 7 aa, Artificial Sequence
  Synthetic
EPYRHLH

SEQ ID NO: 17761 - protein, 7 aa, Artificial Sequence
  Synthetic
IQYKMPT

SEQ ID NO: 17762 - protein, 7 aa, Artificial Sequence
  Synthetic
RATWVAD

SEQ ID NO: 17763 - protein, 7 aa, Artificial Sequence
  Synthetic
WVWGATE

SEQ ID NO: 17764 - protein, 7 aa, Artificial Sequence
  Synthetic
PLERSFG

SEQ ID NO: 17765 - protein, 7 aa, Artificial Sequence
  Synthetic
LGFLNKT

SEQ ID NO: 17766 - protein, 7 aa, Artificial Sequence
  Synthetic
RGIVLVN

SEQ ID NO: 17767 - protein, 7 aa, Artificial Sequence
  Synthetic
SVDFARY

SEQ ID NO: 17768 - protein, 7 aa, Artificial Sequence
  Synthetic
ILRAYGV

SEQ ID NO: 17769 - protein, 7 aa, Artificial Sequence
  Synthetic
TGNRLHA

SEQ ID NO: 17770 - protein, 7 aa, Artificial Sequence
  Synthetic
EKAWQAQ

SEQ ID NO: 17771 - protein, 7 aa, Artificial Sequence
  Synthetic
PLANFSA

SEQ ID NO: 17772 - protein, 7 aa, Artificial Sequence
  Synthetic
QGYTEHW

SEQ ID NO: 17773 - protein, 7 aa, Artificial Sequence
  Synthetic
EKFRLGQ

SEQ ID NO: 17774 - protein, 7 aa, Artificial Sequence
  Synthetic
ESHGFSS

SEQ ID NO: 17775 - protein, 7 aa, Artificial Sequence
  Synthetic
THPAWSH

SEQ ID NO: 17776 - protein, 7 aa, Artificial Sequence
  Synthetic
KWDLRLE

SEQ ID NO: 17777 - protein, 7 aa, Artificial Sequence
  Synthetic
ARLMGSQ

SEQ ID NO: 17778 - protein, 7 aa, Artificial Sequence
  Synthetic
WRNGGSM

SEQ ID NO: 17779 - protein, 7 aa, Artificial Sequence
  Synthetic
SWPGSSA

SEQ ID NO: 17780 - protein, 7 aa, Artificial Sequence
  Synthetic
IPGSGMW

SEQ ID NO: 17781 - protein, 7 aa, Artificial Sequence
  Synthetic
RWGADAS

SEQ ID NO: 17782 - protein, 7 aa, Artificial Sequence
  Synthetic
TPDTARW

SEQ ID NO: 17783 - protein, 7 aa, Artificial Sequence
  Synthetic
RVYSEGW

SEQ ID NO: 17784 - protein, 7 aa, Artificial Sequence
  Synthetic
LLFHGSA

SEQ ID NO: 17785 - protein, 7 aa, Artificial Sequence
  Synthetic
MSSLSHW

SEQ ID NO: 17786 - protein, 7 aa, Artificial Sequence
  Synthetic
VPYKFEL

SEQ ID NO: 17787 - protein, 7 aa, Artificial Sequence
  Synthetic
SHVGYSS

SEQ ID NO: 17788 - protein, 7 aa, Artificial Sequence
  Synthetic
PWERSLS

SEQ ID NO: 17789 - protein, 7 aa, Artificial Sequence
  Synthetic
EIPGYSS

SEQ ID NO: 17790 - protein, 7 aa, Artificial Sequence
  Synthetic
TERYYAS

SEQ ID NO: 17791 - protein, 7 aa, Artificial Sequence
  Synthetic
LFYGGAS

SEQ ID NO: 17792 - protein, 7 aa, Artificial Sequence
  Synthetic
GKAQGPW

SEQ ID NO: 17793 - protein, 7 aa, Artificial Sequence
  Synthetic
TLRGLAQ

SEQ ID NO: 17794 - protein, 7 aa, Artificial Sequence
  Synthetic
WGKPPVM

SEQ ID NO: 17795 - protein, 7 aa, Artificial Sequence
  Synthetic
EFWAGSV

SEQ ID NO: 17796 - protein, 7 aa, Artificial Sequence
  Synthetic
AFGTGFH

SEQ ID NO: 17797 - protein, 7 aa, Artificial Sequence
  Synthetic
GVTGLLW

SEQ ID NO: 17798 - protein, 7 aa, Artificial Sequence
  Synthetic
EAHWRAD

SEQ ID NO: 17799 - protein, 7 aa, Artificial Sequence
  Synthetic
MPKGSGW

SEQ ID NO: 17800 - protein, 7 aa, Artificial Sequence
  Synthetic
GRLIGER

SEQ ID NO: 17801 - protein, 7 aa, Artificial Sequence
  Synthetic
EARNWAS

SEQ ID NO: 17802 - protein, 7 aa, Artificial Sequence
  Synthetic
VPYSLPL

SEQ ID NO: 17803 - protein, 7 aa, Artificial Sequence
  Synthetic
MHVGFAQ

SEQ ID NO: 17804 - protein, 7 aa, Artificial Sequence
  Synthetic
EKALMFR

SEQ ID NO: 17805 - protein, 7 aa, Artificial Sequence
  Synthetic
YISLPDI

SEQ ID NO: 17806 - protein, 7 aa, Artificial Sequence
  Synthetic
ILAGYMD

SEQ ID NO: 17807 - protein, 7 aa, Artificial Sequence
  Synthetic
QAPGWAS

SEQ ID NO: 17808 - protein, 7 aa, Artificial Sequence
  Synthetic
PAIGRAQ

SEQ ID NO: 17809 - protein, 7 aa, Artificial Sequence
  Synthetic
LFVGGSS

SEQ ID NO: 17810 - protein, 7 aa, Artificial Sequence
  Synthetic
SRPGFAQ

SEQ ID NO: 17811 - protein, 7 aa, Artificial Sequence
  Synthetic
RLVQSGH

SEQ ID NO: 17812 - protein, 7 aa, Artificial Sequence
  Synthetic
TPFKFPD

SEQ ID NO: 17813 - protein, 7 aa, Artificial Sequence
  Synthetic
EVLGARW

SEQ ID NO: 17814 - protein, 7 aa, Artificial Sequence
  Synthetic
SHTGFST

SEQ ID NO: 17815 - protein, 7 aa, Artificial Sequence
  Synthetic
GSHLGAW

SEQ ID NO: 17816 - protein, 7 aa, Artificial Sequence
  Synthetic
LFARGSA

SEQ ID NO: 17817 - protein, 7 aa, Artificial Sequence
  Synthetic
YPMYRSD

SEQ ID NO: 17818 - protein, 7 aa, Artificial Sequence
  Synthetic
DQRQWSS

SEQ ID NO: 17819 - protein, 7 aa, Artificial Sequence
  Synthetic
RGGIAER

SEQ ID NO: 17820 - protein, 7 aa, Artificial Sequence
  Synthetic
MESYTAA

SEQ ID NO: 17821 - protein, 7 aa, Artificial Sequence
  Synthetic
EGRIGTW

SEQ ID NO: 17822 - protein, 7 aa, Artificial Sequence
  Synthetic
SGVEGRW

SEQ ID NO: 17823 - protein, 7 aa, Artificial Sequence
  Synthetic
RWEHGST

SEQ ID NO: 17824 - protein, 7 aa, Artificial Sequence
  Synthetic
LKFGAAQ

SEQ ID NO: 17825 - protein, 7 aa, Artificial Sequence
  Synthetic
VEYRLPM

SEQ ID NO: 17826 - protein, 7 aa, Artificial Sequence
  Synthetic
VFDLRQM

SEQ ID NO: 17827 - protein, 7 aa, Artificial Sequence
  Synthetic
WGSLSPT

SEQ ID NO: 17828 - protein, 7 aa, Artificial Sequence
  Synthetic
WEPLSGY

SEQ ID NO: 17829 - protein, 7 aa, Artificial Sequence
  Synthetic
VNSLWVA

SEQ ID NO: 17830 - protein, 7 aa, Artificial Sequence
  Synthetic
TEFLYSA

SEQ ID NO: 17831 - protein, 7 aa, Artificial Sequence
  Synthetic
HGKMSGG

SEQ ID NO: 17832 - protein, 7 aa, Artificial Sequence
  Synthetic
ERMFLSS

SEQ ID NO: 17833 - protein, 7 aa, Artificial Sequence
  Synthetic
LVIRGSQ

SEQ ID NO: 17834 - protein, 7 aa, Artificial Sequence
  Synthetic
GGNLGVW

SEQ ID NO: 17835 - protein, 7 aa, Artificial Sequence
  Synthetic
LVWQGST

SEQ ID NO: 17836 - protein, 7 aa, Artificial Sequence
  Synthetic
HYPRELT

SEQ ID NO: 17837 - protein, 7 aa, Artificial Sequence
  Synthetic
FVYGAQQ

SEQ ID NO: 17838 - protein, 7 aa, Artificial Sequence
  Synthetic
NQPQSGR

SEQ ID NO: 17839 - protein, 7 aa, Artificial Sequence
  Synthetic
GRNIGPF

SEQ ID NO: 17840 - protein, 7 aa, Artificial Sequence
  Synthetic
WVTLPST

SEQ ID NO: 17841 - protein, 7 aa, Artificial Sequence
  Synthetic
VHHSITL

SEQ ID NO: 17842 - protein, 7 aa, Artificial Sequence
  Synthetic
RVAGPNW

SEQ ID NO: 17843 - protein, 7 aa, Artificial Sequence
  Synthetic
MSHAGIW

SEQ ID NO: 17844 - protein, 7 aa, Artificial Sequence
  Synthetic
DHYLGSH

SEQ ID NO: 17845 - protein, 7 aa, Artificial Sequence
  Synthetic
MDLLPSG

SEQ ID NO: 17846 - protein, 7 aa, Artificial Sequence
  Synthetic
VHTYAFG

SEQ ID NO: 17847 - protein, 7 aa, Artificial Sequence
  Synthetic
VSPVWSS

SEQ ID NO: 17848 - protein, 7 aa, Artificial Sequence
  Synthetic
KSEWGSY

SEQ ID NO: 17849 - protein, 7 aa, Artificial Sequence
  Synthetic
KDVNWSY

SEQ ID NO: 17850 - protein, 7 aa, Artificial Sequence
  Synthetic
ALRSEAR

SEQ ID NO: 17851 - protein, 7 aa, Artificial Sequence
  Synthetic
ERVGYAW

SEQ ID NO: 17852 - protein, 7 aa, Artificial Sequence
  Synthetic
LLLGYST

SEQ ID NO: 17853 - protein, 7 aa, Artificial Sequence
  Synthetic
PVDNGRW

SEQ ID NO: 17854 - protein, 7 aa, Artificial Sequence
  Synthetic
GAFGFSS

SEQ ID NO: 17855 - protein, 7 aa, Artificial Sequence
  Synthetic
RAFDYNM

SEQ ID NO: 17856 - protein, 7 aa, Artificial Sequence
  Synthetic
GPDAGRW

SEQ ID NO: 17857 - protein, 7 aa, Artificial Sequence
  Synthetic
AESPGRW

SEQ ID NO: 17858 - protein, 7 aa, Artificial Sequence
  Synthetic
RGDYAPW

SEQ ID NO: 17859 - protein, 7 aa, Artificial Sequence
  Synthetic
DKWKLPT

SEQ ID NO: 17860 - protein, 7 aa, Artificial Sequence
  Synthetic
RRPGDAA

SEQ ID NO: 17861 - protein, 7 aa, Artificial Sequence
  Synthetic
RAREERL

SEQ ID NO: 17862 - protein, 7 aa, Artificial Sequence
  Synthetic
PAGTVRW

SEQ ID NO: 17863 - protein, 7 aa, Artificial Sequence
  Synthetic
RMSVMTF

SEQ ID NO: 17864 - protein, 7 aa, Artificial Sequence
  Synthetic
LVIMGSS

SEQ ID NO: 17865 - protein, 7 aa, Artificial Sequence
  Synthetic
LSDLSYW

SEQ ID NO: 17866 - protein, 7 aa, Artificial Sequence
  Synthetic
SAWQGST

SEQ ID NO: 17867 - protein, 7 aa, Artificial Sequence
  Synthetic
LMPNPVR

SEQ ID NO: 17868 - protein, 7 aa, Artificial Sequence
  Synthetic
RGGRPDW

SEQ ID NO: 17869 - protein, 7 aa, Artificial Sequence
  Synthetic
MWAGHSM

SEQ ID NO: 17870 - protein, 7 aa, Artificial Sequence
  Synthetic
TDLGWAR

SEQ ID NO: 17871 - protein, 7 aa, Artificial Sequence
  Synthetic
SDPVWHS

SEQ ID NO: 17872 - protein, 7 aa, Artificial Sequence
  Synthetic
SYDSGRW

SEQ ID NO: 17873 - protein, 7 aa, Artificial Sequence
  Synthetic
GVGEVRW

SEQ ID NO: 17874 - protein, 7 aa, Artificial Sequence
  Synthetic
DNWHLPH

SEQ ID NO: 17875 - protein, 7 aa, Artificial Sequence
  Synthetic
QVLMGSA

SEQ ID NO: 17876 - protein, 7 aa, Artificial Sequence
  Synthetic
EVVGRGW

SEQ ID NO: 17877 - protein, 7 aa, Artificial Sequence
  Synthetic
KEYRIYD

SEQ ID NO: 17878 - protein, 7 aa, Artificial Sequence
  Synthetic
VWVGGAA

SEQ ID NO: 17879 - protein, 7 aa, Artificial Sequence
  Synthetic
DKHLYSA

SEQ ID NO: 17880 - protein, 7 aa, Artificial Sequence
  Synthetic
VHPGYSM

SEQ ID NO: 17881 - protein, 7 aa, Artificial Sequence
  Synthetic
LIGESRW

SEQ ID NO: 17882 - protein, 7 aa, Artificial Sequence
  Synthetic
SWAMGSA

SEQ ID NO: 17883 - protein, 7 aa, Artificial Sequence
  Synthetic
EPTGVRW

SEQ ID NO: 17884 - protein, 7 aa, Artificial Sequence
  Synthetic
GYVGFST

SEQ ID NO: 17885 - protein, 7 aa, Artificial Sequence
  Synthetic
CPGYTSA

SEQ ID NO: 17886 - protein, 7 aa, Artificial Sequence
  Synthetic
LHPGDSS

SEQ ID NO: 17887 - protein, 7 aa, Artificial Sequence
  Synthetic
LYSMMSS

SEQ ID NO: 17888 - protein, 7 aa, Artificial Sequence
  Synthetic
AWGTTGA

SEQ ID NO: 17889 - protein, 7 aa, Artificial Sequence
  Synthetic
GLERGMW

SEQ ID NO: 17890 - protein, 7 aa, Artificial Sequence
  Synthetic
IGHQWAY

SEQ ID NO: 17891 - protein, 7 aa, Artificial Sequence
  Synthetic
MPYLLNG

SEQ ID NO: 17892 - protein, 7 aa, Artificial Sequence
  Synthetic
ERPSYSS

SEQ ID NO: 17893 - protein, 7 aa, Artificial Sequence
  Synthetic
PIEHGSY

SEQ ID NO: 17894 - protein, 7 aa, Artificial Sequence
  Synthetic
DFRLGST

SEQ ID NO: 17895 - protein, 7 aa, Artificial Sequence
  Synthetic
KSMENSR

SEQ ID NO: 17896 - protein, 7 aa, Artificial Sequence
  Synthetic
PGNGGRY

SEQ ID NO: 17897 - protein, 7 aa, Artificial Sequence
  Synthetic
HSTLGSS

SEQ ID NO: 17898 - protein, 7 aa, Artificial Sequence
  Synthetic
PFPGGSQ

SEQ ID NO: 17899 - protein, 7 aa, Artificial Sequence
  Synthetic
MRVAHSS

SEQ ID NO: 17900 - protein, 7 aa, Artificial Sequence
  Synthetic
RVVHNNA

SEQ ID NO: 17901 - protein, 7 aa, Artificial Sequence
  Synthetic
AYENWHV

SEQ ID NO: 17902 - protein, 7 aa, Artificial Sequence
  Synthetic
GNEVGRW

SEQ ID NO: 17903 - protein, 7 aa, Artificial Sequence
  Synthetic
FMKLGST

SEQ ID NO: 17904 - protein, 7 aa, Artificial Sequence
  Synthetic
RWTMDNA

SEQ ID NO: 17905 - protein, 7 aa, Artificial Sequence
  Synthetic
ELVGYRI

SEQ ID NO: 17906 - protein, 7 aa, Artificial Sequence
  Synthetic
HAYSLER

SEQ ID NO: 17907 - protein, 7 aa, Artificial Sequence
  Synthetic
HGPARWD

SEQ ID NO: 17908 - protein, 7 aa, Artificial Sequence
  Synthetic
LHAGYAS

SEQ ID NO: 17909 - protein, 7 aa, Artificial Sequence
  Synthetic
PEPGWSA

SEQ ID NO: 17910 - protein, 7 aa, Artificial Sequence
  Synthetic
GEWRRFD

SEQ ID NO: 17911 - protein, 7 aa, Artificial Sequence
  Synthetic
LAVRLAS

SEQ ID NO: 17912 - protein, 7 aa, Artificial Sequence
  Synthetic
PVERHGW

SEQ ID NO: 17913 - protein, 7 aa, Artificial Sequence
  Synthetic
YDYTKGY

SEQ ID NO: 17914 - protein, 7 aa, Artificial Sequence
  Synthetic
SLYMGSS

SEQ ID NO: 17915 - protein, 7 aa, Artificial Sequence
  Synthetic
AWHDKER

SEQ ID NO: 17916 - protein, 7 aa, Artificial Sequence
  Synthetic
IMLRGST

SEQ ID NO: 17917 - protein, 7 aa, Artificial Sequence
  Synthetic
MTYETRY

SEQ ID NO: 17918 - protein, 7 aa, Artificial Sequence
  Synthetic
DVRWNSS

SEQ ID NO: 17919 - protein, 7 aa, Artificial Sequence
  Synthetic
EISYGSS

SEQ ID NO: 17920 - protein, 7 aa, Artificial Sequence
  Synthetic
LYHGHST

SEQ ID NO: 17921 - protein, 7 aa, Artificial Sequence
  Synthetic
RMEGPNW

SEQ ID NO: 17922 - protein, 7 aa, Artificial Sequence
  Synthetic
PTPFLSS

SEQ ID NO: 17923 - protein, 7 aa, Artificial Sequence
  Synthetic
LTYSTTL

SEQ ID NO: 17924 - protein, 7 aa, Artificial Sequence
  Synthetic
WVNLPDR

SEQ ID NO: 17925 - protein, 7 aa, Artificial Sequence
  Synthetic
FNPDPMI

SEQ ID NO: 17926 - protein, 7 aa, Artificial Sequence
  Synthetic
VFIGGSS

SEQ ID NO: 17927 - protein, 7 aa, Artificial Sequence
  Synthetic
RGMEFNR

SEQ ID NO: 17928 - protein, 7 aa, Artificial Sequence
  Synthetic
TARPGPW

SEQ ID NO: 17929 - protein, 7 aa, Artificial Sequence
  Synthetic
YRLGYGA

SEQ ID NO: 17930 - protein, 7 aa, Artificial Sequence
  Synthetic
MPRDNRW

SEQ ID NO: 17931 - protein, 7 aa, Artificial Sequence
  Synthetic
SYIGMSS

SEQ ID NO: 17932 - protein, 7 aa, Artificial Sequence
  Synthetic
LDSRFSS

SEQ ID NO: 17933 - protein, 7 aa, Artificial Sequence
  Synthetic
EVYQGSS

SEQ ID NO: 17934 - protein, 7 aa, Artificial Sequence
  Synthetic
WGVLSDL

SEQ ID NO: 17935 - protein, 7 aa, Artificial Sequence
  Synthetic
WELQAGY

SEQ ID NO: 17936 - protein, 7 aa, Artificial Sequence
  Synthetic
GSNLGKW

SEQ ID NO: 17937 - protein, 7 aa, Artificial Sequence
  Synthetic
IMNSYGV

SEQ ID NO: 17938 - protein, 7 aa, Artificial Sequence
  Synthetic
YGSLHGW

SEQ ID NO: 17939 - protein, 7 aa, Artificial Sequence
  Synthetic
YSHSSWA

SEQ ID NO: 17940 - protein, 7 aa, Artificial Sequence
  Synthetic
WNYVGSS

SEQ ID NO: 17941 - protein, 7 aa, Artificial Sequence
  Synthetic
WDVAAGY

SEQ ID NO: 17942 - protein, 7 aa, Artificial Sequence
  Synthetic
WAYRIGD

SEQ ID NO: 17943 - protein, 7 aa, Artificial Sequence
  Synthetic
AVHETRW

SEQ ID NO: 17944 - protein, 7 aa, Artificial Sequence
  Synthetic
PRAHANS

SEQ ID NO: 17945 - protein, 7 aa, Artificial Sequence
  Synthetic
APHTGFH

SEQ ID NO: 17946 - protein, 7 aa, Artificial Sequence
  Synthetic
ASYGQYW

SEQ ID NO: 17947 - protein, 7 aa, Artificial Sequence
  Synthetic
SFPGMAQ

SEQ ID NO: 17948 - protein, 7 aa, Artificial Sequence
  Synthetic
EMPFGSA

SEQ ID NO: 17949 - protein, 7 aa, Artificial Sequence
  Synthetic
WIPLGAS

SEQ ID NO: 17950 - protein, 7 aa, Artificial Sequence
  Synthetic
WGLSSGF

SEQ ID NO: 17951 - protein, 7 aa, Artificial Sequence
  Synthetic
LRIKGGD

SEQ ID NO: 17952 - protein, 7 aa, Artificial Sequence
  Synthetic
RPIGDWA

SEQ ID NO: 17953 - protein, 7 aa, Artificial Sequence
  Synthetic
SWGKQGA

SEQ ID NO: 17954 - protein, 7 aa, Artificial Sequence
  Synthetic
LYIPSSH

SEQ ID NO: 17955 - protein, 7 aa, Artificial Sequence
  Synthetic
LWSGGAQ

SEQ ID NO: 17956 - protein, 7 aa, Artificial Sequence
  Synthetic
HGLGAGK

SEQ ID NO: 17957 - protein, 7 aa, Artificial Sequence
  Synthetic
VLVGRTG

SEQ ID NO: 17958 - protein, 7 aa, Artificial Sequence
  Synthetic
VHVGGAQ

SEQ ID NO: 17959 - protein, 7 aa, Artificial Sequence
  Synthetic
DSRPPAR

SEQ ID NO: 17960 - protein, 7 aa, Artificial Sequence
  Synthetic
SGDVGRW

SEQ ID NO: 17961 - protein, 7 aa, Artificial Sequence
  Synthetic
DVPVFRP

SEQ ID NO: 17962 - protein, 7 aa, Artificial Sequence
  Synthetic
FVWMHSD

SEQ ID NO: 17963 - protein, 7 aa, Artificial Sequence
  Synthetic
PLSNGRY

SEQ ID NO: 17964 - protein, 7 aa, Artificial Sequence
  Synthetic
IGHGGWH

SEQ ID NO: 17965 - protein, 7 aa, Artificial Sequence
  Synthetic
LSMDGRW

SEQ ID NO: 17966 - protein, 7 aa, Artificial Sequence
  Synthetic
HRFNGSS

SEQ ID NO: 17967 - protein, 7 aa, Artificial Sequence
  Synthetic
LHSGYSQ

SEQ ID NO: 17968 - protein, 7 aa, Artificial Sequence
  Synthetic
LSDYSFH

SEQ ID NO: 17969 - protein, 7 aa, Artificial Sequence
  Synthetic
ILAGWTE

SEQ ID NO: 17970 - protein, 7 aa, Artificial Sequence
  Synthetic
QEFRLPV

SEQ ID NO: 17971 - protein, 7 aa, Artificial Sequence
  Synthetic
MRFILPD

SEQ ID NO: 17972 - protein, 7 aa, Artificial Sequence
  Synthetic
RQDTGAR

SEQ ID NO: 17973 - protein, 7 aa, Artificial Sequence
  Synthetic
DGYFSSS

SEQ ID NO: 17974 - protein, 7 aa, Artificial Sequence
  Synthetic
WMYEGSS

SEQ ID NO: 17975 - protein, 7 aa, Artificial Sequence
  Synthetic
VWAGTAQ

SEQ ID NO: 17976 - protein, 7 aa, Artificial Sequence
  Synthetic
RRDLLPY

SEQ ID NO: 17977 - protein, 7 aa, Artificial Sequence
  Synthetic
PEFHNGW

SEQ ID NO: 17978 - protein, 7 aa, Artificial Sequence
  Synthetic
EPLHSRW

SEQ ID NO: 17979 - protein, 7 aa, Artificial Sequence
  Synthetic
RWQSDAI

SEQ ID NO: 17980 - protein, 7 aa, Artificial Sequence
  Synthetic
PPYGGAW

SEQ ID NO: 17981 - protein, 7 aa, Artificial Sequence
  Synthetic
LNWGAAM

SEQ ID NO: 17982 - protein, 7 aa, Artificial Sequence
  Synthetic
VVRLGSA

SEQ ID NO: 17983 - protein, 7 aa, Artificial Sequence
  Synthetic
NPFRLPV

SEQ ID NO: 17984 - protein, 7 aa, Artificial Sequence
  Synthetic
SFVPYAA

SEQ ID NO: 17985 - protein, 7 aa, Artificial Sequence
  Synthetic
AIPGWSS

SEQ ID NO: 17986 - protein, 7 aa, Artificial Sequence
  Synthetic
RGPSVDR

SEQ ID NO: 17987 - protein, 7 aa, Artificial Sequence
  Synthetic
HKQAGGY

SEQ ID NO: 17988 - protein, 7 aa, Artificial Sequence
  Synthetic
MQNWAYG

SEQ ID NO: 17989 - protein, 7 aa, Artificial Sequence
  Synthetic
TYHGASS

SEQ ID NO: 17990 - protein, 7 aa, Artificial Sequence
  Synthetic
SWPATST

SEQ ID NO: 17991 - protein, 7 aa, Artificial Sequence
  Synthetic
HRPAMSG

SEQ ID NO: 17992 - protein, 7 aa, Artificial Sequence
  Synthetic
REYQNNW

SEQ ID NO: 17993 - protein, 7 aa, Artificial Sequence
  Synthetic
EPIILKP

SEQ ID NO: 17994 - protein, 7 aa, Artificial Sequence
  Synthetic
GGTVGVW

SEQ ID NO: 17995 - protein, 7 aa, Artificial Sequence
  Synthetic
LNGRAHP

SEQ ID NO: 17996 - protein, 7 aa, Artificial Sequence
  Synthetic
HRGDGRV

SEQ ID NO: 17997 - protein, 7 aa, Artificial Sequence
  Synthetic
TLVRQNH

SEQ ID NO: 17998 - protein, 7 aa, Artificial Sequence
  Synthetic
MVLMGST

SEQ ID NO: 17999 - protein, 7 aa, Artificial Sequence
  Synthetic
SKLDAHR

SEQ ID NO: 18000 - protein, 7 aa, Artificial Sequence
  Synthetic
ERIVLKQ

SEQ ID NO: 18001 - protein, 7 aa, Artificial Sequence
  Synthetic
TRTLGSA

SEQ ID NO: 18002 - protein, 7 aa, Artificial Sequence
  Synthetic
CYPVLDC

SEQ ID NO: 18003 - protein, 7 aa, Artificial Sequence
  Synthetic
RFHMDAT

SEQ ID NO: 18004 - protein, 7 aa, Artificial Sequence
  Synthetic
SKWDMRV

SEQ ID NO: 18005 - protein, 7 aa, Artificial Sequence
  Synthetic
LWGGGSS

SEQ ID NO: 18006 - protein, 7 aa, Artificial Sequence
  Synthetic
GAPFNHY

SEQ ID NO: 18007 - protein, 7 aa, Artificial Sequence
  Synthetic
RQIDSGR

SEQ ID NO: 18008 - protein, 7 aa, Artificial Sequence
  Synthetic
QHVGDFR

SEQ ID NO: 18009 - protein, 7 aa, Artificial Sequence
  Synthetic
GFMMGST

SEQ ID NO: 18010 - protein, 7 aa, Artificial Sequence
  Synthetic
KPPANTW

SEQ ID NO: 18011 - protein, 7 aa, Artificial Sequence
  Synthetic
NFVPAQH

SEQ ID NO: 18012 - protein, 7 aa, Artificial Sequence
  Synthetic
RYVGLAS

SEQ ID NO: 18013 - protein, 7 aa, Artificial Sequence
  Synthetic
RFEADSA

SEQ ID NO: 18014 - protein, 7 aa, Artificial Sequence
  Synthetic
FGVLDRV

SEQ ID NO: 18015 - protein, 7 aa, Artificial Sequence
  Synthetic
WHSLGSD

SEQ ID NO: 18016 - protein, 7 aa, Artificial Sequence
  Synthetic
PEWSAGR

SEQ ID NO: 18017 - protein, 7 aa, Artificial Sequence
  Synthetic
ERHVHVS

SEQ ID NO: 18018 - protein, 7 aa, Artificial Sequence
  Synthetic
GPPRSIQ

SEQ ID NO: 18019 - protein, 7 aa, Artificial Sequence
  Synthetic
SKQGWSS

SEQ ID NO: 18020 - protein, 7 aa, Artificial Sequence
  Synthetic
PWAHLAS

SEQ ID NO: 18021 - protein, 7 aa, Artificial Sequence
  Synthetic
RFSPDAA

SEQ ID NO: 18022 - protein, 7 aa, Artificial Sequence
  Synthetic
VGHGFSS

SEQ ID NO: 18023 - protein, 7 aa, Artificial Sequence
  Synthetic
LYVNGSV

SEQ ID NO: 18024 - protein, 7 aa, Artificial Sequence
  Synthetic
WSSGGSQ

SEQ ID NO: 18025 - protein, 7 aa, Artificial Sequence
  Synthetic
IWDNKVA

SEQ ID NO: 18026 - protein, 7 aa, Artificial Sequence
  Synthetic
VLYRVDT

SEQ ID NO: 18027 - protein, 7 aa, Artificial Sequence
  Synthetic
RPYVPTQ

SEQ ID NO: 18028 - protein, 7 aa, Artificial Sequence
  Synthetic
EWDRLLK

SEQ ID NO: 18029 - protein, 7 aa, Artificial Sequence
  Synthetic
VMWGEAQ

SEQ ID NO: 18030 - protein, 7 aa, Artificial Sequence
  Synthetic
KVANFHV

SEQ ID NO: 18031 - protein, 7 aa, Artificial Sequence
  Synthetic
IMETSYW

SEQ ID NO: 18032 - protein, 7 aa, Artificial Sequence
  Synthetic
LFLSGST

SEQ ID NO: 18033 - protein, 7 aa, Artificial Sequence
  Synthetic
LNSLWNA

SEQ ID NO: 18034 - protein, 7 aa, Artificial Sequence
  Synthetic
GLSDGRW

SEQ ID NO: 18035 - protein, 7 aa, Artificial Sequence
  Synthetic
WILAGSA

SEQ ID NO: 18036 - protein, 7 aa, Artificial Sequence
  Synthetic
LEHRYSS

SEQ ID NO: 18037 - protein, 7 aa, Artificial Sequence
  Synthetic
EWPGSAT

SEQ ID NO: 18038 - protein, 7 aa, Artificial Sequence
  Synthetic
EKWRGDA

SEQ ID NO: 18039 - protein, 7 aa, Artificial Sequence
  Synthetic
LHFNGSM

SEQ ID NO: 18040 - protein, 7 aa, Artificial Sequence
  Synthetic
LSRGFST

SEQ ID NO: 18041 - protein, 7 aa, Artificial Sequence
  Synthetic
LMSGYAQ

SEQ ID NO: 18042 - protein, 7 aa, Artificial Sequence
  Synthetic
SLMSGYG

SEQ ID NO: 18043 - protein, 7 aa, Artificial Sequence
  Synthetic
DPQWSYA

SEQ ID NO: 18044 - protein, 7 aa, Artificial Sequence
  Synthetic
LMSHYST

SEQ ID NO: 18045 - protein, 7 aa, Artificial Sequence
  Synthetic
HGTGARM

SEQ ID NO: 18046 - protein, 7 aa, Artificial Sequence
  Synthetic
WVLPLGG

SEQ ID NO: 18047 - protein, 7 aa, Artificial Sequence
  Synthetic
WSTDAGY

SEQ ID NO: 18048 - protein, 7 aa, Artificial Sequence
  Synthetic
AMELYGR

SEQ ID NO: 18049 - protein, 7 aa, Artificial Sequence
  Synthetic
GPGEGRW

SEQ ID NO: 18050 - protein, 7 aa, Artificial Sequence
  Synthetic
ESPTWRY

SEQ ID NO: 18051 - protein, 7 aa, Artificial Sequence
  Synthetic
DVRWQAS

SEQ ID NO: 18052 - protein, 7 aa, Artificial Sequence
  Synthetic
VSMSLWS

SEQ ID NO: 18053 - protein, 7 aa, Artificial Sequence
  Synthetic
STYYHKE

SEQ ID NO: 18054 - protein, 7 aa, Artificial Sequence
  Synthetic
ASIGSVY

SEQ ID NO: 18055 - protein, 7 aa, Artificial Sequence
  Synthetic
IIRLGSS

SEQ ID NO: 18056 - protein, 7 aa, Artificial Sequence
  Synthetic
NVSTQFY

SEQ ID NO: 18057 - protein, 7 aa, Artificial Sequence
  Synthetic
VKYSLAN

SEQ ID NO: 18058 - protein, 7 aa, Artificial Sequence
  Synthetic
DWNSARY

SEQ ID NO: 18059 - protein, 7 aa, Artificial Sequence
  Synthetic
WNMQKGF

SEQ ID NO: 18060 - protein, 7 aa, Artificial Sequence
  Synthetic
WITNGSA

SEQ ID NO: 18061 - protein, 7 aa, Artificial Sequence
  Synthetic
LYASGST

SEQ ID NO: 18062 - protein, 7 aa, Artificial Sequence
  Synthetic
EVLGTRW

SEQ ID NO: 18063 - protein, 7 aa, Artificial Sequence
  Synthetic
DFARGAS

SEQ ID NO: 18064 - protein, 7 aa, Artificial Sequence
  Synthetic
KESPGPW

SEQ ID NO: 18065 - protein, 7 aa, Artificial Sequence
  Synthetic
LGRGMNP

SEQ ID NO: 18066 - protein, 7 aa, Artificial Sequence
  Synthetic
KGEQTLR

SEQ ID NO: 18067 - protein, 7 aa, Artificial Sequence
  Synthetic
PYQGMSS

SEQ ID NO: 18068 - protein, 7 aa, Artificial Sequence
  Synthetic
GSSPGRW

SEQ ID NO: 18069 - protein, 7 aa, Artificial Sequence
  Synthetic
RVIADRA

SEQ ID NO: 18070 - protein, 7 aa, Artificial Sequence
  Synthetic
YRLMGAA

SEQ ID NO: 18071 - protein, 7 aa, Artificial Sequence
  Synthetic
GVYSGHF

SEQ ID NO: 18072 - protein, 7 aa, Artificial Sequence
  Synthetic
NKFDLRS

SEQ ID NO: 18073 - protein, 7 aa, Artificial Sequence
  Synthetic
DYRPAAS

SEQ ID NO: 18074 - protein, 7 aa, Artificial Sequence
  Synthetic
WEVRGGF

SEQ ID NO: 18075 - protein, 7 aa, Artificial Sequence
  Synthetic
RQPGESQ

SEQ ID NO: 18076 - protein, 7 aa, Artificial Sequence
  Synthetic
TGLSRFN

SEQ ID NO: 18077 - protein, 7 aa, Artificial Sequence
  Synthetic
IFPGMAS

SEQ ID NO: 18078 - protein, 7 aa, Artificial Sequence
  Synthetic
GLDKNRW

SEQ ID NO: 18079 - protein, 7 aa, Artificial Sequence
  Synthetic
DVHLRWA

SEQ ID NO: 18080 - protein, 7 aa, Artificial Sequence
  Synthetic
EQFRGSS

SEQ ID NO: 18081 - protein, 7 aa, Artificial Sequence
  Synthetic
LRDNRVH

SEQ ID NO: 18082 - protein, 7 aa, Artificial Sequence
  Synthetic
SGAVGMW

SEQ ID NO: 18083 - protein, 7 aa, Artificial Sequence
  Synthetic
RDFRLPN

SEQ ID NO: 18084 - protein, 7 aa, Artificial Sequence
  Synthetic
TFPGAQW

SEQ ID NO: 18085 - protein, 7 aa, Artificial Sequence
  Synthetic
GGQVRWD

SEQ ID NO: 18086 - protein, 7 aa, Artificial Sequence
  Synthetic
SRTEGYW

SEQ ID NO: 18087 - protein, 7 aa, Artificial Sequence
  Synthetic
DNPTMRY

SEQ ID NO: 18088 - protein, 7 aa, Artificial Sequence
  Synthetic
GESLGPW

SEQ ID NO: 18089 - protein, 7 aa, Artificial Sequence
  Synthetic
VWKQENA

SEQ ID NO: 18090 - protein, 7 aa, Artificial Sequence
  Synthetic
LNSLWAG

SEQ ID NO: 18091 - protein, 7 aa, Artificial Sequence
  Synthetic
LRVAYSS

SEQ ID NO: 18092 - protein, 7 aa, Artificial Sequence
  Synthetic
DNLVRWS

SEQ ID NO: 18093 - protein, 7 aa, Artificial Sequence
  Synthetic
MATSRWD

SEQ ID NO: 18094 - protein, 7 aa, Artificial Sequence
  Synthetic
WGMIPRD

SEQ ID NO: 18095 - protein, 7 aa, Artificial Sequence
  Synthetic
WGLYVDR

SEQ ID NO: 18096 - protein, 7 aa, Artificial Sequence
  Synthetic
WGLLPSS

SEQ ID NO: 18097 - protein, 7 aa, Artificial Sequence
  Synthetic
TRASEVR

SEQ ID NO: 18098 - protein, 7 aa, Artificial Sequence
  Synthetic
NRGVEQK

SEQ ID NO: 18099 - protein, 7 aa, Artificial Sequence
  Synthetic
RDSSMRH

SEQ ID NO: 18100 - protein, 7 aa, Artificial Sequence
  Synthetic
EIKYDLR

SEQ ID NO: 18101 - protein, 7 aa, Artificial Sequence
  Synthetic
GVYGQLF

SEQ ID NO: 18102 - protein, 7 aa, Artificial Sequence
  Synthetic
EKYRLNV

SEQ ID NO: 18103 - protein, 7 aa, Artificial Sequence
  Synthetic
WGLFQVT

SEQ ID NO: 18104 - protein, 7 aa, Artificial Sequence
  Synthetic
NVLNYHI

SEQ ID NO: 18105 - protein, 7 aa, Artificial Sequence
  Synthetic
RMHNVNL

SEQ ID NO: 18106 - protein, 7 aa, Artificial Sequence
  Synthetic
EYRGQAQ

SEQ ID NO: 18107 - protein, 7 aa, Artificial Sequence
  Synthetic
TSLGSVY

SEQ ID NO: 18108 - protein, 7 aa, Artificial Sequence
  Synthetic
WALQGAQ

SEQ ID NO: 18109 - protein, 7 aa, Artificial Sequence
  Synthetic
HNIERSW

SEQ ID NO: 18110 - protein, 7 aa, Artificial Sequence
  Synthetic
HFMGGSS

SEQ ID NO: 18111 - protein, 7 aa, Artificial Sequence
  Synthetic
RTLPHLV

SEQ ID NO: 18112 - protein, 7 aa, Artificial Sequence
  Synthetic
HPHKEGR

SEQ ID NO: 18113 - protein, 7 aa, Artificial Sequence
  Synthetic
ERWREHP

SEQ ID NO: 18114 - protein, 7 aa, Artificial Sequence
  Synthetic
GLGTGPR

SEQ ID NO: 18115 - protein, 7 aa, Artificial Sequence
  Synthetic
RLAVNYP

SEQ ID NO: 18116 - protein, 7 aa, Artificial Sequence
  Synthetic
IKYAGSS

SEQ ID NO: 18117 - protein, 7 aa, Artificial Sequence
  Synthetic
TAPTAYY

SEQ ID NO: 18118 - protein, 7 aa, Artificial Sequence
  Synthetic
TVSYSKL

SEQ ID NO: 18119 - protein, 7 aa, Artificial Sequence
  Synthetic
DRAMGSW

SEQ ID NO: 18120 - protein, 7 aa, Artificial Sequence
  Synthetic
TWDLEFP

SEQ ID NO: 18121 - protein, 7 aa, Artificial Sequence
  Synthetic
VARGFST

SEQ ID NO: 18122 - protein, 7 aa, Artificial Sequence
  Synthetic
PVASARF

SEQ ID NO: 18123 - protein, 7 aa, Artificial Sequence
  Synthetic
KIAYSPL

SEQ ID NO: 18124 - protein, 7 aa, Artificial Sequence
  Synthetic
TSGSRWD

SEQ ID NO: 18125 - protein, 7 aa, Artificial Sequence
  Synthetic
TYAFGSA

SEQ ID NO: 18126 - protein, 7 aa, Artificial Sequence
  Synthetic
MERFGSS

SEQ ID NO: 18127 - protein, 7 aa, Artificial Sequence
  Synthetic
PHAQWSA

SEQ ID NO: 18128 - protein, 7 aa, Artificial Sequence
  Synthetic
EHGTGRW

SEQ ID NO: 18129 - protein, 7 aa, Artificial Sequence
  Synthetic
VASFGSS

SEQ ID NO: 18130 - protein, 7 aa, Artificial Sequence
  Synthetic
RWHENGS

SEQ ID NO: 18131 - protein, 7 aa, Artificial Sequence
  Synthetic
WNSLARP

SEQ ID NO: 18132 - protein, 7 aa, Artificial Sequence
  Synthetic
MDYRLGF

SEQ ID NO: 18133 - protein, 7 aa, Artificial Sequence
  Synthetic
ENVRHLW

SEQ ID NO: 18134 - protein, 7 aa, Artificial Sequence
  Synthetic
EGTRMLW

SEQ ID NO: 18135 - protein, 7 aa, Artificial Sequence
  Synthetic
RGGPSFP

SEQ ID NO: 18136 - protein, 7 aa, Artificial Sequence
  Synthetic
WHKAGSG

SEQ ID NO: 18137 - protein, 7 aa, Artificial Sequence
  Synthetic
LYVGLSQ

SEQ ID NO: 18138 - protein, 7 aa, Artificial Sequence
  Synthetic
PDYKLPL

SEQ ID NO: 18139 - protein, 7 aa, Artificial Sequence
  Synthetic
LQMNYSS

SEQ ID NO: 18140 - protein, 7 aa, Artificial Sequence
  Synthetic
EAKWPGN

SEQ ID NO: 18141 - protein, 7 aa, Artificial Sequence
  Synthetic
LFTGGSQ

SEQ ID NO: 18142 - protein, 7 aa, Artificial Sequence
  Synthetic
QLPFSVR

SEQ ID NO: 18143 - protein, 7 aa, Artificial Sequence
  Synthetic
WLHGYAQ

SEQ ID NO: 18144 - protein, 7 aa, Artificial Sequence
  Synthetic
RLGPNTG

SEQ ID NO: 18145 - protein, 7 aa, Artificial Sequence
  Synthetic
APNEVRW

SEQ ID NO: 18146 - protein, 7 aa, Artificial Sequence
  Synthetic
SYLTGYH

SEQ ID NO: 18147 - protein, 7 aa, Artificial Sequence
  Synthetic
GSSPGQW

SEQ ID NO: 18148 - protein, 7 aa, Artificial Sequence
  Synthetic
LLLPKMA

SEQ ID NO: 18149 - protein, 7 aa, Artificial Sequence
  Synthetic
LYMSGSS

SEQ ID NO: 18150 - protein, 7 aa, Artificial Sequence
  Synthetic
KAQWANV

SEQ ID NO: 18151 - protein, 7 aa, Artificial Sequence
  Synthetic
HNSGYPK

SEQ ID NO: 18152 - protein, 7 aa, Artificial Sequence
  Synthetic
KTEYAAW

SEQ ID NO: 18153 - protein, 7 aa, Artificial Sequence
  Synthetic
RYAGSST

SEQ ID NO: 18154 - protein, 7 aa, Artificial Sequence
  Synthetic
PAKYGFG

SEQ ID NO: 18155 - protein, 7 aa, Artificial Sequence
  Synthetic
ETKFAMW

SEQ ID NO: 18156 - protein, 7 aa, Artificial Sequence
  Synthetic
FVSMDAH

SEQ ID NO: 18157 - protein, 7 aa, Artificial Sequence
  Synthetic
LIYNGSS

SEQ ID NO: 18158 - protein, 7 aa, Artificial Sequence
  Synthetic
EKSYSGW

SEQ ID NO: 18159 - protein, 7 aa, Artificial Sequence
  Synthetic
RSAGMSQ

SEQ ID NO: 18160 - protein, 7 aa, Artificial Sequence
  Synthetic
ADRDYWN

SEQ ID NO: 18161 - protein, 7 aa, Artificial Sequence
  Synthetic
MRIGMSS

SEQ ID NO: 18162 - protein, 7 aa, Artificial Sequence
  Synthetic
WIVGGST

SEQ ID NO: 18163 - protein, 7 aa, Artificial Sequence
  Synthetic
YDANARR

SEQ ID NO: 18164 - protein, 7 aa, Artificial Sequence
  Synthetic
INAPGLW

SEQ ID NO: 18165 - protein, 7 aa, Artificial Sequence
  Synthetic
MILMGSV

SEQ ID NO: 18166 - protein, 7 aa, Artificial Sequence
  Synthetic
TDATRWA

SEQ ID NO: 18167 - protein, 7 aa, Artificial Sequence
  Synthetic
EVQFGYH

SEQ ID NO: 18168 - protein, 7 aa, Artificial Sequence
  Synthetic
LHIGGST

SEQ ID NO: 18169 - protein, 7 aa, Artificial Sequence
  Synthetic
WGSLLSL

SEQ ID NO: 18170 - protein, 7 aa, Artificial Sequence
  Synthetic
DPQSVRW

SEQ ID NO: 18171 - protein, 7 aa, Artificial Sequence
  Synthetic
REWSVGV

SEQ ID NO: 18172 - protein, 7 aa, Artificial Sequence
  Synthetic
RGHQSNG

SEQ ID NO: 18173 - protein, 7 aa, Artificial Sequence
  Synthetic
MDRPAQR

SEQ ID NO: 18174 - protein, 7 aa, Artificial Sequence
  Synthetic
ALGREWV

SEQ ID NO: 18175 - protein, 7 aa, Artificial Sequence
  Synthetic
EMTHGSA

SEQ ID NO: 18176 - protein, 7 aa, Artificial Sequence
  Synthetic
RGAGLSQ

SEQ ID NO: 18177 - protein, 7 aa, Artificial Sequence
  Synthetic
LYIAHSS

SEQ ID NO: 18178 - protein, 7 aa, Artificial Sequence
  Synthetic
FGVLDRI

SEQ ID NO: 18179 - protein, 7 aa, Artificial Sequence
  Synthetic
PNLSGRY

SEQ ID NO: 18180 - protein, 7 aa, Artificial Sequence
  Synthetic
LVPAWSS

SEQ ID NO: 18181 - protein, 7 aa, Artificial Sequence
  Synthetic
GEWGARF

SEQ ID NO: 18182 - protein, 7 aa, Artificial Sequence
  Synthetic
GVTQSMW

SEQ ID NO: 18183 - protein, 7 aa, Artificial Sequence
  Synthetic
FLSGFSQ

SEQ ID NO: 18184 - protein, 7 aa, Artificial Sequence
  Synthetic
TRSFGFD

SEQ ID NO: 18185 - protein, 7 aa, Artificial Sequence
  Synthetic
LKVQGWS

SEQ ID NO: 18186 - protein, 7 aa, Artificial Sequence
  Synthetic
VADFSHW

SEQ ID NO: 18187 - protein, 7 aa, Artificial Sequence
  Synthetic
AVWGGAS

SEQ ID NO: 18188 - protein, 7 aa, Artificial Sequence
  Synthetic
EKWDLSR

SEQ ID NO: 18189 - protein, 7 aa, Artificial Sequence
  Synthetic
SNKSHQH

SEQ ID NO: 18190 - protein, 7 aa, Artificial Sequence
  Synthetic
RHVGDAA

SEQ ID NO: 18191 - protein, 7 aa, Artificial Sequence
  Synthetic
KTAYADW

SEQ ID NO: 18192 - protein, 7 aa, Artificial Sequence
  Synthetic
RLTNELK

SEQ ID NO: 18193 - protein, 7 aa, Artificial Sequence
  Synthetic
ERSLGST

SEQ ID NO: 18194 - protein, 7 aa, Artificial Sequence
  Synthetic
HWASAHG

SEQ ID NO: 18195 - protein, 7 aa, Artificial Sequence
  Synthetic
LYLAHAS

SEQ ID NO: 18196 - protein, 7 aa, Artificial Sequence
  Synthetic
PAGTAHW

SEQ ID NO: 18197 - protein, 7 aa, Artificial Sequence
  Synthetic
RSEYTTW

SEQ ID NO: 18198 - protein, 7 aa, Artificial Sequence
  Synthetic
VEYRRFD

SEQ ID NO: 18199 - protein, 7 aa, Artificial Sequence
  Synthetic
VFVGSST

SEQ ID NO: 18200 - protein, 7 aa, Artificial Sequence
  Synthetic
LANPGAW

SEQ ID NO: 18201 - protein, 7 aa, Artificial Sequence
  Synthetic
ALHSPIW

SEQ ID NO: 18202 - protein, 7 aa, Artificial Sequence
  Synthetic
FVFDKPF

SEQ ID NO: 18203 - protein, 7 aa, Artificial Sequence
  Synthetic
LKVGFSM

SEQ ID NO: 18204 - protein, 7 aa, Artificial Sequence
  Synthetic
VTKLNMW

SEQ ID NO: 18205 - protein, 7 aa, Artificial Sequence
  Synthetic
YGLFVST

SEQ ID NO: 18206 - protein, 7 aa, Artificial Sequence
  Synthetic
RFDHDAA

SEQ ID NO: 18207 - protein, 7 aa, Artificial Sequence
  Synthetic
PTWGSIG

SEQ ID NO: 18208 - protein, 7 aa, Artificial Sequence
  Synthetic
PIWGESS

SEQ ID NO: 18209 - protein, 7 aa, Artificial Sequence
  Synthetic
WAYNGDR

SEQ ID NO: 18210 - protein, 7 aa, Artificial Sequence
  Synthetic
GLSDARW

SEQ ID NO: 18211 - protein, 7 aa, Artificial Sequence
  Synthetic
DATVRWS

SEQ ID NO: 18212 - protein, 7 aa, Artificial Sequence
  Synthetic
RHIADRS

SEQ ID NO: 18213 - protein, 7 aa, Artificial Sequence
  Synthetic
LLRLGST

SEQ ID NO: 18214 - protein, 7 aa, Artificial Sequence
  Synthetic
VRFGDFS

SEQ ID NO: 18215 - protein, 7 aa, Artificial Sequence
  Synthetic
TLLTKYY

SEQ ID NO: 18216 - protein, 7 aa, Artificial Sequence
  Synthetic
HYSFDRA

SEQ ID NO: 18217 - protein, 7 aa, Artificial Sequence
  Synthetic
RWSGEAS

SEQ ID NO: 18218 - protein, 7 aa, Artificial Sequence
  Synthetic
ETRFFSA

SEQ ID NO: 18219 - protein, 7 aa, Artificial Sequence
  Synthetic
VLIGRTG

SEQ ID NO: 18220 - protein, 7 aa, Artificial Sequence
  Synthetic
WHSLTYE

SEQ ID NO: 18221 - protein, 7 aa, Artificial Sequence
  Synthetic
WHSLSSA

SEQ ID NO: 18222 - protein, 7 aa, Artificial Sequence
  Synthetic
VAFKYGD

SEQ ID NO: 18223 - protein, 7 aa, Artificial Sequence
  Synthetic
ESSSGRW

SEQ ID NO: 18224 - protein, 7 aa, Artificial Sequence
  Synthetic
PAPYVGW

SEQ ID NO: 18225 - protein, 7 aa, Artificial Sequence
  Synthetic
QKENGRW

SEQ ID NO: 18226 - protein, 7 aa, Artificial Sequence
  Synthetic
LRPVHVN

SEQ ID NO: 18227 - protein, 7 aa, Artificial Sequence
  Synthetic
HAINHIR

SEQ ID NO: 18228 - protein, 7 aa, Artificial Sequence
  Synthetic
IRAGYAV

SEQ ID NO: 18229 - protein, 7 aa, Artificial Sequence
  Synthetic
KHSPESR

SEQ ID NO: 18230 - protein, 7 aa, Artificial Sequence
  Synthetic
LVIMGAS

SEQ ID NO: 18231 - protein, 7 aa, Artificial Sequence
  Synthetic
VRGTDAR

SEQ ID NO: 18232 - protein, 7 aa, Artificial Sequence
  Synthetic
QYFTGSA

SEQ ID NO: 18233 - protein, 7 aa, Artificial Sequence
  Synthetic
VLKGSIY

SEQ ID NO: 18234 - protein, 7 aa, Artificial Sequence
  Synthetic
GASSRWD

SEQ ID NO: 18235 - protein, 7 aa, Artificial Sequence
  Synthetic
EYMRGSA

SEQ ID NO: 18236 - protein, 7 aa, Artificial Sequence
  Synthetic
SKPGYSS

SEQ ID NO: 18237 - protein, 7 aa, Artificial Sequence
  Synthetic
SSTARWD

SEQ ID NO: 18238 - protein, 7 aa, Artificial Sequence
  Synthetic
AAHLAGW

SEQ ID NO: 18239 - protein, 7 aa, Artificial Sequence
  Synthetic
KSEWAHF

SEQ ID NO: 18240 - protein, 7 aa, Artificial Sequence
  Synthetic
WSVTSGY

SEQ ID NO: 18241 - protein, 7 aa, Artificial Sequence
  Synthetic
EDARRFT

SEQ ID NO: 18242 - protein, 7 aa, Artificial Sequence
  Synthetic
LYHGESM

SEQ ID NO: 18243 - protein, 7 aa, Artificial Sequence
  Synthetic
QWDLSKS

SEQ ID NO: 18244 - protein, 7 aa, Artificial Sequence
  Synthetic
VFAGYST

SEQ ID NO: 18245 - protein, 7 aa, Artificial Sequence
  Synthetic
CRATAML

SEQ ID NO: 18246 - protein, 7 aa, Artificial Sequence
  Synthetic
GGPSRFN

SEQ ID NO: 18247 - protein, 7 aa, Artificial Sequence
  Synthetic
LVPFYSM

SEQ ID NO: 18248 - protein, 7 aa, Artificial Sequence
  Synthetic
DMLSGRW

SEQ ID NO: 18249 - protein, 7 aa, Artificial Sequence
  Synthetic
WGTLMGL

SEQ ID NO: 18250 - protein, 7 aa, Artificial Sequence
  Synthetic
EHAWEAS

SEQ ID NO: 18251 - protein, 7 aa, Artificial Sequence
  Synthetic
EAAWGST

SEQ ID NO: 18252 - protein, 7 aa, Artificial Sequence
  Synthetic
SVYRGSV

SEQ ID NO: 18253 - protein, 7 aa, Artificial Sequence
  Synthetic
HAGGQVR

SEQ ID NO: 18254 - protein, 7 aa, Artificial Sequence
  Synthetic
WITQGAA

SEQ ID NO: 18255 - protein, 7 aa, Artificial Sequence
  Synthetic
TKTYGST

SEQ ID NO: 18256 - protein, 7 aa, Artificial Sequence
  Synthetic
GRTMHVA

SEQ ID NO: 18257 - protein, 7 aa, Artificial Sequence
  Synthetic
HTGGTRA

SEQ ID NO: 18258 - protein, 7 aa, Artificial Sequence
  Synthetic
IMMGFSA

SEQ ID NO: 18259 - protein, 7 aa, Artificial Sequence
  Synthetic
RWVPEAS

SEQ ID NO: 18260 - protein, 7 aa, Artificial Sequence
  Synthetic
GEVAGRW

SEQ ID NO: 18261 - protein, 7 aa, Artificial Sequence
  Synthetic
PDNPGLW

SEQ ID NO: 18262 - protein, 7 aa, Artificial Sequence
  Synthetic
VMVGWAS

SEQ ID NO: 18263 - protein, 7 aa, Artificial Sequence
  Synthetic
RISHGSC

SEQ ID NO: 18264 - protein, 7 aa, Artificial Sequence
  Synthetic
ERGGYSS

SEQ ID NO: 18265 - protein, 7 aa, Artificial Sequence
  Synthetic
NHYHGSS

SEQ ID NO: 18266 - protein, 7 aa, Artificial Sequence
  Synthetic
GIYETRW

SEQ ID NO: 18267 - protein, 7 aa, Artificial Sequence
  Synthetic
WRHVEQH

SEQ ID NO: 18268 - protein, 7 aa, Artificial Sequence
  Synthetic
ASFDGRW

SEQ ID NO: 18269 - protein, 7 aa, Artificial Sequence
  Synthetic
RFPGAAS

SEQ ID NO: 18270 - protein, 7 aa, Artificial Sequence
  Synthetic
MYVGGST

SEQ ID NO: 18271 - protein, 7 aa, Artificial Sequence
  Synthetic
LRDFGSS

SEQ ID NO: 18272 - protein, 7 aa, Artificial Sequence
  Synthetic
VYPGFSV

SEQ ID NO: 18273 - protein, 7 aa, Artificial Sequence
  Synthetic
RFSGDAS

SEQ ID NO: 18274 - protein, 7 aa, Artificial Sequence
  Synthetic
LIPFTSS

SEQ ID NO: 18275 - protein, 7 aa, Artificial Sequence
  Synthetic
WAPNTGY

SEQ ID NO: 18276 - protein, 7 aa, Artificial Sequence
  Synthetic
FTLSTRP

SEQ ID NO: 18277 - protein, 7 aa, Artificial Sequence
  Synthetic
VGRGMAQ

SEQ ID NO: 18278 - protein, 7 aa, Artificial Sequence
  Synthetic
PYTNFSA

SEQ ID NO: 18279 - protein, 7 aa, Artificial Sequence
  Synthetic
GLYMGLH

SEQ ID NO: 18280 - protein, 7 aa, Artificial Sequence
  Synthetic
NSYPGVW

SEQ ID NO: 18281 - protein, 7 aa, Artificial Sequence
  Synthetic
WHQHSER

SEQ ID NO: 18282 - protein, 7 aa, Artificial Sequence
  Synthetic
GVRGVDR

SEQ ID NO: 18283 - protein, 7 aa, Artificial Sequence
  Synthetic
EAWGGSQ

SEQ ID NO: 18284 - protein, 7 aa, Artificial Sequence
  Synthetic
VGSYSSW

SEQ ID NO: 18285 - protein, 7 aa, Artificial Sequence
  Synthetic
LWTGMAQ

SEQ ID NO: 18286 - protein, 7 aa, Artificial Sequence
  Synthetic
VLMGREG

SEQ ID NO: 18287 - protein, 7 aa, Artificial Sequence
  Synthetic
RPHPNPH

SEQ ID NO: 18288 - protein, 7 aa, Artificial Sequence
  Synthetic
TVVGSLW

SEQ ID NO: 18289 - protein, 7 aa, Artificial Sequence
  Synthetic
LFGGGST

SEQ ID NO: 18290 - protein, 7 aa, Artificial Sequence
  Synthetic
NPDSSRW

SEQ ID NO: 18291 - protein, 7 aa, Artificial Sequence
  Synthetic
SFPGSSA

SEQ ID NO: 18292 - protein, 7 aa, Artificial Sequence
  Synthetic
RLPYPDL

SEQ ID NO: 18293 - protein, 7 aa, Artificial Sequence
  Synthetic
SAVGTVY

SEQ ID NO: 18294 - protein, 7 aa, Artificial Sequence
  Synthetic
AVAGFRY

SEQ ID NO: 18295 - protein, 7 aa, Artificial Sequence
  Synthetic
PVYGLSS

SEQ ID NO: 18296 - protein, 7 aa, Artificial Sequence
  Synthetic
PRQNFSS

SEQ ID NO: 18297 - protein, 7 aa, Artificial Sequence
  Synthetic
LQMGYAQ

SEQ ID NO: 18298 - protein, 7 aa, Artificial Sequence
  Synthetic
WIYGGSA

SEQ ID NO: 18299 - protein, 7 aa, Artificial Sequence
  Synthetic
DVAPGRW

SEQ ID NO: 18300 - protein, 7 aa, Artificial Sequence
  Synthetic
PFMGTYA

SEQ ID NO: 18301 - protein, 7 aa, Artificial Sequence
  Synthetic
LMTKSLW

SEQ ID NO: 18302 - protein, 7 aa, Artificial Sequence
  Synthetic
GVLLHIK

SEQ ID NO: 18303 - protein, 7 aa, Artificial Sequence
  Synthetic
RPTRPEH

SEQ ID NO: 18304 - protein, 7 aa, Artificial Sequence
  Synthetic
AHEVHRW

SEQ ID NO: 18305 - protein, 7 aa, Artificial Sequence
  Synthetic
SAFHLPT

SEQ ID NO: 18306 - protein, 7 aa, Artificial Sequence
  Synthetic
EGNVGRW

SEQ ID NO: 18307 - protein, 7 aa, Artificial Sequence
  Synthetic
LVIYGAA

SEQ ID NO: 18308 - protein, 7 aa, Artificial Sequence
  Synthetic
WVYGTSE

SEQ ID NO: 18309 - protein, 7 aa, Artificial Sequence
  Synthetic
GVAWGSS

SEQ ID NO: 18310 - protein, 7 aa, Artificial Sequence
  Synthetic
NLLYGYN

SEQ ID NO: 18311 - protein, 7 aa, Artificial Sequence
  Synthetic
TYPLGSV

SEQ ID NO: 18312 - protein, 7 aa, Artificial Sequence
  Synthetic
LPGFGSR

SEQ ID NO: 18313 - protein, 7 aa, Artificial Sequence
  Synthetic
RHPADSS

SEQ ID NO: 18314 - protein, 7 aa, Artificial Sequence
  Synthetic
TYDLRFT

SEQ ID NO: 18315 - protein, 7 aa, Artificial Sequence
  Synthetic
LWPGASA

SEQ ID NO: 18316 - protein, 7 aa, Artificial Sequence
  Synthetic
WGNQVGR

SEQ ID NO: 18317 - protein, 7 aa, Artificial Sequence
  Synthetic
LVRPYSS

SEQ ID NO: 18318 - protein, 7 aa, Artificial Sequence
  Synthetic
EWHRGSS

SEQ ID NO: 18319 - protein, 7 aa, Artificial Sequence
  Synthetic
AEWRGAA

SEQ ID NO: 18320 - protein, 7 aa, Artificial Sequence
  Synthetic
LTYGMAQ

SEQ ID NO: 18321 - protein, 7 aa, Artificial Sequence
  Synthetic
RVVENQR

SEQ ID NO: 18322 - protein, 7 aa, Artificial Sequence
  Synthetic
AYVHDYK

SEQ ID NO: 18323 - protein, 7 aa, Artificial Sequence
  Synthetic
EGAPGAW

SEQ ID NO: 18324 - protein, 7 aa, Artificial Sequence
  Synthetic
MVSYGSS

SEQ ID NO: 18325 - protein, 7 aa, Artificial Sequence
  Synthetic
PESSFRW

SEQ ID NO: 18326 - protein, 7 aa, Artificial Sequence
  Synthetic
TRPLGSS

SEQ ID NO: 18327 - protein, 7 aa, Artificial Sequence
  Synthetic
QRMLNRD

SEQ ID NO: 18328 - protein, 7 aa, Artificial Sequence
  Synthetic
HKVEMHR

SEQ ID NO: 18329 - protein, 7 aa, Artificial Sequence
  Synthetic
VYAGYSS

SEQ ID NO: 18330 - protein, 7 aa, Artificial Sequence
  Synthetic
GKDMSRW

SEQ ID NO: 18331 - protein, 7 aa, Artificial Sequence
  Synthetic
DGPGLRY

SEQ ID NO: 18332 - protein, 7 aa, Artificial Sequence
  Synthetic
GSNLGMW

SEQ ID NO: 18333 - protein, 7 aa, Artificial Sequence
  Synthetic
EGWGTST

SEQ ID NO: 18334 - protein, 7 aa, Artificial Sequence
  Synthetic
DPSTARW

SEQ ID NO: 18335 - protein, 7 aa, Artificial Sequence
  Synthetic
WVYGTKE

SEQ ID NO: 18336 - protein, 7 aa, Artificial Sequence
  Synthetic
DPNPGRW

SEQ ID NO: 18337 - protein, 7 aa, Artificial Sequence
  Synthetic
NVWHGSV

SEQ ID NO: 18338 - protein, 7 aa, Artificial Sequence
  Synthetic
KGGWVEH

SEQ ID NO: 18339 - protein, 7 aa, Artificial Sequence
  Synthetic
PVKFALG

SEQ ID NO: 18340 - protein, 7 aa, Artificial Sequence
  Synthetic
YLLGKEA

SEQ ID NO: 18341 - protein, 7 aa, Artificial Sequence
  Synthetic
PVWGHTT

SEQ ID NO: 18342 - protein, 7 aa, Artificial Sequence
  Synthetic
TTDYSRW

SEQ ID NO: 18343 - protein, 7 aa, Artificial Sequence
  Synthetic
SGHVGPW

SEQ ID NO: 18344 - protein, 7 aa, Artificial Sequence
  Synthetic
YWGGLGP

SEQ ID NO: 18345 - protein, 7 aa, Artificial Sequence
  Synthetic
DIPTHRW

SEQ ID NO: 18346 - protein, 7 aa, Artificial Sequence
  Synthetic
RFAPGRD

SEQ ID NO: 18347 - protein, 7 aa, Artificial Sequence
  Synthetic
RHDPSGH

SEQ ID NO: 18348 - protein, 7 aa, Artificial Sequence
  Synthetic
VDGVVRW

SEQ ID NO: 18349 - protein, 7 aa, Artificial Sequence
  Synthetic
RLGTESR

SEQ ID NO: 18350 - protein, 7 aa, Artificial Sequence
  Synthetic
CPELYGC

SEQ ID NO: 18351 - protein, 7 aa, Artificial Sequence
  Synthetic
PPHGSWS

SEQ ID NO: 18352 - protein, 7 aa, Artificial Sequence
  Synthetic
HASGYAQ

SEQ ID NO: 18353 - protein, 7 aa, Artificial Sequence
  Synthetic
EYIQLRP

SEQ ID NO: 18354 - protein, 7 aa, Artificial Sequence
  Synthetic
PRYAIDH

SEQ ID NO: 18355 - protein, 7 aa, Artificial Sequence
  Synthetic
MWTAGST

SEQ ID NO: 18356 - protein, 7 aa, Artificial Sequence
  Synthetic
RAGAVAW

SEQ ID NO: 18357 - protein, 7 aa, Artificial Sequence
  Synthetic
SHVAHGW

SEQ ID NO: 18358 - protein, 7 aa, Artificial Sequence
  Synthetic
KWTERPP

SEQ ID NO: 18359 - protein, 7 aa, Artificial Sequence
  Synthetic
FRADGHK

SEQ ID NO: 18360 - protein, 7 aa, Artificial Sequence
  Synthetic
GTASRWD

SEQ ID NO: 18361 - protein, 7 aa, Artificial Sequence
  Synthetic
WTLSAAY

SEQ ID NO: 18362 - protein, 7 aa, Artificial Sequence
  Synthetic
TKSLWAA

SEQ ID NO: 18363 - protein, 7 aa, Artificial Sequence
  Synthetic
ILNRWGD

SEQ ID NO: 18364 - protein, 7 aa, Artificial Sequence
  Synthetic
SEYIRSI

SEQ ID NO: 18365 - protein, 7 aa, Artificial Sequence
  Synthetic
VWGGMGH

SEQ ID NO: 18366 - protein, 7 aa, Artificial Sequence
  Synthetic
KAPGFSV

SEQ ID NO: 18367 - protein, 7 aa, Artificial Sequence
  Synthetic
MISLGSS

SEQ ID NO: 18368 - protein, 7 aa, Artificial Sequence
  Synthetic
AHAHDYY

SEQ ID NO: 18369 - protein, 7 aa, Artificial Sequence
  Synthetic
TYFAGAT

SEQ ID NO: 18370 - protein, 7 aa, Artificial Sequence
  Synthetic
PWIEGAW

SEQ ID NO: 18371 - protein, 7 aa, Artificial Sequence
  Synthetic
DPSRSWT

SEQ ID NO: 18372 - protein, 7 aa, Artificial Sequence
  Synthetic
WQMKGST

SEQ ID NO: 18373 - protein, 7 aa, Artificial Sequence
  Synthetic
WPAMARP

SEQ ID NO: 18374 - protein, 7 aa, Artificial Sequence
  Synthetic
VYMSGFH

SEQ ID NO: 18375 - protein, 7 aa, Artificial Sequence
  Synthetic
GHRGGSS

SEQ ID NO: 18376 - protein, 7 aa, Artificial Sequence
  Synthetic
WSTWTEG

SEQ ID NO: 18377 - protein, 7 aa, Artificial Sequence
  Synthetic
RYLGELS

SEQ ID NO: 18378 - protein, 7 aa, Artificial Sequence
  Synthetic
PIPSGQW

SEQ ID NO: 18379 - protein, 7 aa, Artificial Sequence
  Synthetic
YRIHGDH

SEQ ID NO: 18380 - protein, 7 aa, Artificial Sequence
  Synthetic
RLSAGSH

SEQ ID NO: 18381 - protein, 7 aa, Artificial Sequence
  Synthetic
SQVWERS

SEQ ID NO: 18382 - protein, 7 aa, Artificial Sequence
  Synthetic
RFPGDNS

SEQ ID NO: 18383 - protein, 7 aa, Artificial Sequence
  Synthetic
FPGFNLH

SEQ ID NO: 18384 - protein, 7 aa, Artificial Sequence
  Synthetic
ERLGLAQ

SEQ ID NO: 18385 - protein, 7 aa, Artificial Sequence
  Synthetic
PVAGWSS

SEQ ID NO: 18386 - protein, 7 aa, Artificial Sequence
  Synthetic
LSMGFAQ

SEQ ID NO: 18387 - protein, 7 aa, Artificial Sequence
  Synthetic
VVYGGST

SEQ ID NO: 18388 - protein, 7 aa, Artificial Sequence
  Synthetic
SAFRGST

SEQ ID NO: 18389 - protein, 7 aa, Artificial Sequence
  Synthetic
RLTTRGD

SEQ ID NO: 18390 - protein, 7 aa, Artificial Sequence
  Synthetic
SHQLLPY

SEQ ID NO: 18391 - protein, 7 aa, Artificial Sequence
  Synthetic
GIERQYF

SEQ ID NO: 18392 - protein, 7 aa, Artificial Sequence
  Synthetic
GAINNHW

SEQ ID NO: 18393 - protein, 7 aa, Artificial Sequence
  Synthetic
GESHGRW

SEQ ID NO: 18394 - protein, 7 aa, Artificial Sequence
  Synthetic
ANEYMGW

SEQ ID NO: 18395 - protein, 7 aa, Artificial Sequence
  Synthetic
SLGYGYS

SEQ ID NO: 18396 - protein, 7 aa, Artificial Sequence
  Synthetic
KAYSLNV

SEQ ID NO: 18397 - protein, 7 aa, Artificial Sequence
  Synthetic
PSELYGW

SEQ ID NO: 18398 - protein, 7 aa, Artificial Sequence
  Synthetic
MGMRENR

SEQ ID NO: 18399 - protein, 7 aa, Artificial Sequence
  Synthetic
NWQGNGK

SEQ ID NO: 18400 - protein, 7 aa, Artificial Sequence
  Synthetic
VYHGYTI

SEQ ID NO: 18401 - protein, 7 aa, Artificial Sequence
  Synthetic
VPNWRAD

SEQ ID NO: 18402 - protein, 7 aa, Artificial Sequence
  Synthetic
PWERFSS

SEQ ID NO: 18403 - protein, 7 aa, Artificial Sequence
  Synthetic
AHLGDFR

SEQ ID NO: 18404 - protein, 7 aa, Artificial Sequence
  Synthetic
AYSGYSL

SEQ ID NO: 18405 - protein, 7 aa, Artificial Sequence
  Synthetic
VFLLGSA

SEQ ID NO: 18406 - protein, 7 aa, Artificial Sequence
  Synthetic
SLDSGRW

SEQ ID NO: 18407 - protein, 7 aa, Artificial Sequence
  Synthetic
PWNNSYG

SEQ ID NO: 18408 - protein, 7 aa, Artificial Sequence
  Synthetic
PAHAIPY

SEQ ID NO: 18409 - protein, 7 aa, Artificial Sequence
  Synthetic
QVRGFSS

SEQ ID NO: 18410 - protein, 7 aa, Artificial Sequence
  Synthetic
MVYGNAQ

SEQ ID NO: 18411 - protein, 7 aa, Artificial Sequence
  Synthetic
WVVKGSA

SEQ ID NO: 18412 - protein, 7 aa, Artificial Sequence
  Synthetic
TKAQWNS

SEQ ID NO: 18413 - protein, 7 aa, Artificial Sequence
  Synthetic
YRLGHES

SEQ ID NO: 18414 - protein, 7 aa, Artificial Sequence
  Synthetic
RDRDSTR

SEQ ID NO: 18415 - protein, 7 aa, Artificial Sequence
  Synthetic
EDGSSRW

SEQ ID NO: 18416 - protein, 7 aa, Artificial Sequence
  Synthetic
PLHAAYA

SEQ ID NO: 18417 - protein, 7 aa, Artificial Sequence
  Synthetic
VGVVNMW

SEQ ID NO: 18418 - protein, 7 aa, Artificial Sequence
  Synthetic
ASAHSMW

SEQ ID NO: 18419 - protein, 7 aa, Artificial Sequence
  Synthetic
AEWHGST

SEQ ID NO: 18420 - protein, 7 aa, Artificial Sequence
  Synthetic
IAMGYST

SEQ ID NO: 18421 - protein, 7 aa, Artificial Sequence
  Synthetic
VAVFGYA

SEQ ID NO: 18422 - protein, 7 aa, Artificial Sequence
  Synthetic
WANLGST

SEQ ID NO: 18423 - protein, 7 aa, Artificial Sequence
  Synthetic
LFIHQSS

SEQ ID NO: 18424 - protein, 7 aa, Artificial Sequence
  Synthetic
QYKGYST

SEQ ID NO: 18425 - protein, 7 aa, Artificial Sequence
  Synthetic
IHVESRK

SEQ ID NO: 18426 - protein, 7 aa, Artificial Sequence
  Synthetic
YVPLPGF

SEQ ID NO: 18427 - protein, 7 aa, Artificial Sequence
  Synthetic
QSSFSGW

SEQ ID NO: 18428 - protein, 7 aa, Artificial Sequence
  Synthetic
HVPEKRI

SEQ ID NO: 18429 - protein, 7 aa, Artificial Sequence
  Synthetic
MGNSGIW

SEQ ID NO: 18430 - protein, 7 aa, Artificial Sequence
  Synthetic
LAPGLSS

SEQ ID NO: 18431 - protein, 7 aa, Artificial Sequence
  Synthetic
PYAGASH

SEQ ID NO: 18432 - protein, 7 aa, Artificial Sequence
  Synthetic
SISFGSS

SEQ ID NO: 18433 - protein, 7 aa, Artificial Sequence
  Synthetic
NGEPGRW

SEQ ID NO: 18434 - protein, 7 aa, Artificial Sequence
  Synthetic
SEVWMAS

SEQ ID NO: 18435 - protein, 7 aa, Artificial Sequence
  Synthetic
DAWRGSA

SEQ ID NO: 18436 - protein, 7 aa, Artificial Sequence
  Synthetic
PLNNGRW

SEQ ID NO: 18437 - protein, 7 aa, Artificial Sequence
  Synthetic
GVLEMRW

SEQ ID NO: 18438 - protein, 7 aa, Artificial Sequence
  Synthetic
DGHRSIY

SEQ ID NO: 18439 - protein, 7 aa, Artificial Sequence
  Synthetic
GRYDLNH

SEQ ID NO: 18440 - protein, 7 aa, Artificial Sequence
  Synthetic
VAYRGAS

SEQ ID NO: 18441 - protein, 7 aa, Artificial Sequence
  Synthetic
NVHNSRC

SEQ ID NO: 18442 - protein, 7 aa, Artificial Sequence
  Synthetic
LGSGHPR

SEQ ID NO: 18443 - protein, 7 aa, Artificial Sequence
  Synthetic
IVAMGSS

SEQ ID NO: 18444 - protein, 7 aa, Artificial Sequence
  Synthetic
RGFGDYV

SEQ ID NO: 18445 - protein, 7 aa, Artificial Sequence
  Synthetic
SVTGHLW

SEQ ID NO: 18446 - protein, 7 aa, Artificial Sequence
  Synthetic
YRGGTGA

SEQ ID NO: 18447 - protein, 7 aa, Artificial Sequence
  Synthetic
QPFQLGH

SEQ ID NO: 18448 - protein, 7 aa, Artificial Sequence
  Synthetic
DQGTSYW

SEQ ID NO: 18449 - protein, 7 aa, Artificial Sequence
  Synthetic
ENGYARY

SEQ ID NO: 18450 - protein, 7 aa, Artificial Sequence
  Synthetic
LWTGGAS

SEQ ID NO: 18451 - protein, 7 aa, Artificial Sequence
  Synthetic
PLYSSFT

SEQ ID NO: 18452 - protein, 7 aa, Artificial Sequence
  Synthetic
HSRNGLL

SEQ ID NO: 18453 - protein, 7 aa, Artificial Sequence
  Synthetic
FPGYGST

SEQ ID NO: 18454 - protein, 7 aa, Artificial Sequence
  Synthetic
EYYKGSA

SEQ ID NO: 18455 - protein, 7 aa, Artificial Sequence
  Synthetic
LAHHGSS

SEQ ID NO: 18456 - protein, 7 aa, Artificial Sequence
  Synthetic
IRVGQSW

SEQ ID NO: 18457 - protein, 7 aa, Artificial Sequence
  Synthetic
AYYSGST

SEQ ID NO: 18458 - protein, 7 aa, Artificial Sequence
  Synthetic
VVGDARW

SEQ ID NO: 18459 - protein, 7 aa, Artificial Sequence
  Synthetic
FGLFIER

SEQ ID NO: 18460 - protein, 7 aa, Artificial Sequence
  Synthetic
DVLGARW

SEQ ID NO: 18461 - protein, 7 aa, Artificial Sequence
  Synthetic
DLDGWHY

SEQ ID NO: 18462 - protein, 7 aa, Artificial Sequence
  Synthetic
PMPYTSS

SEQ ID NO: 18463 - protein, 7 aa, Artificial Sequence
  Synthetic
MGNPLLK

SEQ ID NO: 18464 - protein, 7 aa, Artificial Sequence
  Synthetic
RGPNKVD

SEQ ID NO: 18465 - protein, 7 aa, Artificial Sequence
  Synthetic
TEYRGAT

SEQ ID NO: 18466 - protein, 7 aa, Artificial Sequence
  Synthetic
VESSRWA

SEQ ID NO: 18467 - protein, 7 aa, Artificial Sequence
  Synthetic
LVYAGSA

SEQ ID NO: 18468 - protein, 7 aa, Artificial Sequence
  Synthetic
ANHSPGW

SEQ ID NO: 18469 - protein, 7 aa, Artificial Sequence
  Synthetic
GLSYVGW

SEQ ID NO: 18470 - protein, 7 aa, Artificial Sequence
  Synthetic
ERLNFSS

SEQ ID NO: 18471 - protein, 7 aa, Artificial Sequence
  Synthetic
RLDSAVW

SEQ ID NO: 18472 - protein, 7 aa, Artificial Sequence
  Synthetic
VMQWDRA

SEQ ID NO: 18473 - protein, 7 aa, Artificial Sequence
  Synthetic
LFIGQSS

SEQ ID NO: 18474 - protein, 7 aa, Artificial Sequence
  Synthetic
GGLAPRY

SEQ ID NO: 18475 - protein, 7 aa, Artificial Sequence
  Synthetic
ERTIPSR

SEQ ID NO: 18476 - protein, 7 aa, Artificial Sequence
  Synthetic
YGTLSIF

SEQ ID NO: 18477 - protein, 7 aa, Artificial Sequence
  Synthetic
SVVNYHS

SEQ ID NO: 18478 - protein, 7 aa, Artificial Sequence
  Synthetic
SWPGLSQ

SEQ ID NO: 18479 - protein, 7 aa, Artificial Sequence
  Synthetic
RQNPNWG

SEQ ID NO: 18480 - protein, 7 aa, Artificial Sequence
  Synthetic
RGTPGPW

SEQ ID NO: 18481 - protein, 7 aa, Artificial Sequence
  Synthetic
EYYNGSA

SEQ ID NO: 18482 - protein, 7 aa, Artificial Sequence
  Synthetic
VESWNRA

SEQ ID NO: 18483 - protein, 7 aa, Artificial Sequence
  Synthetic
SFMGYSS

SEQ ID NO: 18484 - protein, 7 aa, Artificial Sequence
  Synthetic
GSAYDLR

SEQ ID NO: 18485 - protein, 7 aa, Artificial Sequence
  Synthetic
MVQLGYA

SEQ ID NO: 18486 - protein, 7 aa, Artificial Sequence
  Synthetic
SSIGWSA

SEQ ID NO: 18487 - protein, 7 aa, Artificial Sequence
  Synthetic
KTYEIPY

SEQ ID NO: 18488 - protein, 7 aa, Artificial Sequence
  Synthetic
DATVSRW

SEQ ID NO: 18489 - protein, 7 aa, Artificial Sequence
  Synthetic
MKHEYSS

SEQ ID NO: 18490 - protein, 7 aa, Artificial Sequence
  Synthetic
RLETQFK

SEQ ID NO: 18491 - protein, 7 aa, Artificial Sequence
  Synthetic
AAWGHAQ

SEQ ID NO: 18492 - protein, 7 aa, Artificial Sequence
  Synthetic
LRQLGSS

SEQ ID NO: 18493 - protein, 7 aa, Artificial Sequence
  Synthetic
SAAWSAS

SEQ ID NO: 18494 - protein, 7 aa, Artificial Sequence
  Synthetic
PQWGGIS

SEQ ID NO: 18495 - protein, 7 aa, Artificial Sequence
  Synthetic
AVPGWSM

SEQ ID NO: 18496 - protein, 7 aa, Artificial Sequence
  Synthetic
WGVLNVM

SEQ ID NO: 18497 - protein, 7 aa, Artificial Sequence
  Synthetic
SAWQGSS

SEQ ID NO: 18498 - protein, 7 aa, Artificial Sequence
  Synthetic
GLLTGFG

SEQ ID NO: 18499 - protein, 7 aa, Artificial Sequence
  Synthetic
EMGSVRW

SEQ ID NO: 18500 - protein, 7 aa, Artificial Sequence
  Synthetic
RDTGPGR

SEQ ID NO: 18501 - protein, 7 aa, Artificial Sequence
  Synthetic
GNRADGK

SEQ ID NO: 18502 - protein, 7 aa, Artificial Sequence
  Synthetic
TRNLGSA

SEQ ID NO: 18503 - protein, 7 aa, Artificial Sequence
  Synthetic
WGRGMDG

SEQ ID NO: 18504 - protein, 7 aa, Artificial Sequence
  Synthetic
LYVHGAS

SEQ ID NO: 18505 - protein, 7 aa, Artificial Sequence
  Synthetic
RRDPNLV

SEQ ID NO: 18506 - protein, 7 aa, Artificial Sequence
  Synthetic
LFPHQST

SEQ ID NO: 18507 - protein, 7 aa, Artificial Sequence
  Synthetic
VPFSLSL

SEQ ID NO: 18508 - protein, 7 aa, Artificial Sequence
  Synthetic
VWAGQSS

SEQ ID NO: 18509 - protein, 7 aa, Artificial Sequence
  Synthetic
HYVGSSY

SEQ ID NO: 18510 - protein, 7 aa, Artificial Sequence
  Synthetic
RHTIEVR

SEQ ID NO: 18511 - protein, 7 aa, Artificial Sequence
  Synthetic
HGFQRNA

SEQ ID NO: 18512 - protein, 7 aa, Artificial Sequence
  Synthetic
IRMNQSH

SEQ ID NO: 18513 - protein, 7 aa, Artificial Sequence
  Synthetic
WVLPRGE

SEQ ID NO: 18514 - protein, 7 aa, Artificial Sequence
  Synthetic
LLGRAVG

SEQ ID NO: 18515 - protein, 7 aa, Artificial Sequence
  Synthetic
MRLGASQ

SEQ ID NO: 18516 - protein, 7 aa, Artificial Sequence
  Synthetic
QWPGDAS

SEQ ID NO: 18517 - protein, 7 aa, Artificial Sequence
  Synthetic
DPASNRW

SEQ ID NO: 18518 - protein, 7 aa, Artificial Sequence
  Synthetic
NLLGGFR

SEQ ID NO: 18519 - protein, 7 aa, Artificial Sequence
  Synthetic
RWDRDLL

SEQ ID NO: 18520 - protein, 7 aa, Artificial Sequence
  Synthetic
EARGFSQ

SEQ ID NO: 18521 - protein, 7 aa, Artificial Sequence
  Synthetic
DRPGYSS

SEQ ID NO: 18522 - protein, 7 aa, Artificial Sequence
  Synthetic
VFSIQSI

SEQ ID NO: 18523 - protein, 7 aa, Artificial Sequence
  Synthetic
RYIPEAS

SEQ ID NO: 18524 - protein, 7 aa, Artificial Sequence
  Synthetic
WDTARGY

SEQ ID NO: 18525 - protein, 7 aa, Artificial Sequence
  Synthetic
GVERGPR

SEQ ID NO: 18526 - protein, 7 aa, Artificial Sequence
  Synthetic
RDGGKHA

SEQ ID NO: 18527 - protein, 7 aa, Artificial Sequence
  Synthetic
AKSHGRE

SEQ ID NO: 18528 - protein, 7 aa, Artificial Sequence
  Synthetic
RGQYDPM

SEQ ID NO: 18529 - protein, 7 aa, Artificial Sequence
  Synthetic
EGHVGKW

SEQ ID NO: 18530 - protein, 7 aa, Artificial Sequence
  Synthetic
VVDTGRW

SEQ ID NO: 18531 - protein, 7 aa, Artificial Sequence
  Synthetic
TVVHAYL

SEQ ID NO: 18532 - protein, 7 aa, Artificial Sequence
  Synthetic
LNPNNQR

SEQ ID NO: 18533 - protein, 7 aa, Artificial Sequence
  Synthetic
WSVGTIY

SEQ ID NO: 18534 - protein, 7 aa, Artificial Sequence
  Synthetic
MREASSR

SEQ ID NO: 18535 - protein, 7 aa, Artificial Sequence
  Synthetic
LVAGYSS

SEQ ID NO: 18536 - protein, 7 aa, Artificial Sequence
  Synthetic
IPVYSNT

SEQ ID NO: 18537 - protein, 7 aa, Artificial Sequence
  Synthetic
PDNSGRW

SEQ ID NO: 18538 - protein, 7 aa, Artificial Sequence
  Synthetic
SHWGAAS

SEQ ID NO: 18539 - protein, 7 aa, Artificial Sequence
  Synthetic
PSAHSMW

SEQ ID NO: 18540 - protein, 7 aa, Artificial Sequence
  Synthetic
PANSAVW

SEQ ID NO: 18541 - protein, 7 aa, Artificial Sequence
  Synthetic
VLLRSWD

SEQ ID NO: 18542 - protein, 7 aa, Artificial Sequence
  Synthetic
EWKYSAA

SEQ ID NO: 18543 - protein, 7 aa, Artificial Sequence
  Synthetic
LFYGGSL

SEQ ID NO: 18544 - protein, 7 aa, Artificial Sequence
  Synthetic
SPGLDLF

SEQ ID NO: 18545 - protein, 7 aa, Artificial Sequence
  Synthetic
RYEGYSA

SEQ ID NO: 18546 - protein, 7 aa, Artificial Sequence
  Synthetic
NWGGFGE

SEQ ID NO: 18547 - protein, 7 aa, Artificial Sequence
  Synthetic
VLRTDWA

SEQ ID NO: 18548 - protein, 7 aa, Artificial Sequence
  Synthetic
HNGSFPR

SEQ ID NO: 18549 - protein, 7 aa, Artificial Sequence
  Synthetic
HFTLMSA

SEQ ID NO: 18550 - protein, 7 aa, Artificial Sequence
  Synthetic
ERHLHPS

SEQ ID NO: 18551 - protein, 7 aa, Artificial Sequence
  Synthetic
GHSISHW

SEQ ID NO: 18552 - protein, 7 aa, Artificial Sequence
  Synthetic
WSTFSAG

SEQ ID NO: 18553 - protein, 7 aa, Artificial Sequence
  Synthetic
PLGTQHW

SEQ ID NO: 18554 - protein, 7 aa, Artificial Sequence
  Synthetic
LWAHHST

SEQ ID NO: 18555 - protein, 7 aa, Artificial Sequence
  Synthetic
WENMRYG

SEQ ID NO: 18556 - protein, 7 aa, Artificial Sequence
  Synthetic
VLTYRQG

SEQ ID NO: 18557 - protein, 7 aa, Artificial Sequence
  Synthetic
WGEIGRW

SEQ ID NO: 18558 - protein, 7 aa, Artificial Sequence
  Synthetic
GTSMGAW

SEQ ID NO: 18559 - protein, 7 aa, Artificial Sequence
  Synthetic
AYPGQAS

SEQ ID NO: 18560 - protein, 7 aa, Artificial Sequence
  Synthetic
EQRGWSA

SEQ ID NO: 18561 - protein, 7 aa, Artificial Sequence
  Synthetic
LRDRAIF

SEQ ID NO: 18562 - protein, 7 aa, Artificial Sequence
  Synthetic
KLSERSH

SEQ ID NO: 18563 - protein, 7 aa, Artificial Sequence
  Synthetic
WSAMGSA

SEQ ID NO: 18564 - protein, 7 aa, Artificial Sequence
  Synthetic
DAPWMSH

SEQ ID NO: 18565 - protein, 7 aa, Artificial Sequence
  Synthetic
GELNWSS

SEQ ID NO: 18566 - protein, 7 aa, Artificial Sequence
  Synthetic
LDSIWVH

SEQ ID NO: 18567 - protein, 7 aa, Artificial Sequence
  Synthetic
LNYSASL

SEQ ID NO: 18568 - protein, 7 aa, Artificial Sequence
  Synthetic
SNPGFSS

SEQ ID NO: 18569 - protein, 7 aa, Artificial Sequence
  Synthetic
SDYSLRY

SEQ ID NO: 18570 - protein, 7 aa, Artificial Sequence
  Synthetic
PFGSGVW

SEQ ID NO: 18571 - protein, 7 aa, Artificial Sequence
  Synthetic
RPYVLPD

SEQ ID NO: 18572 - protein, 7 aa, Artificial Sequence
  Synthetic
ERTHGSS

SEQ ID NO: 18573 - protein, 7 aa, Artificial Sequence
  Synthetic
VKTGYGY

SEQ ID NO: 18574 - protein, 7 aa, Artificial Sequence
  Synthetic
VQMGSIY

SEQ ID NO: 18575 - protein, 7 aa, Artificial Sequence
  Synthetic
VYVPQSA

SEQ ID NO: 18576 - protein, 7 aa, Artificial Sequence
  Synthetic
VRSWASD

SEQ ID NO: 18577 - protein, 7 aa, Artificial Sequence
  Synthetic
AHGHYMH

SEQ ID NO: 18578 - protein, 7 aa, Artificial Sequence
  Synthetic
RGMEGPR

SEQ ID NO: 18579 - protein, 7 aa, Artificial Sequence
  Synthetic
WRDGGSS

SEQ ID NO: 18580 - protein, 7 aa, Artificial Sequence
  Synthetic
WSLPSGG

SEQ ID NO: 18581 - protein, 7 aa, Artificial Sequence
  Synthetic
GVMDSRW

SEQ ID NO: 18582 - protein, 7 aa, Artificial Sequence
  Synthetic
RIWGSPE

SEQ ID NO: 18583 - protein, 7 aa, Artificial Sequence
  Synthetic
SPGYPLY

SEQ ID NO: 18584 - protein, 7 aa, Artificial Sequence
  Synthetic
MFLAMSS

SEQ ID NO: 18585 - protein, 7 aa, Artificial Sequence
  Synthetic
LVKGWSV

SEQ ID NO: 18586 - protein, 7 aa, Artificial Sequence
  Synthetic
LREVWSS

SEQ ID NO: 18587 - protein, 7 aa, Artificial Sequence
  Synthetic
PGLGTVY

SEQ ID NO: 18588 - protein, 7 aa, Artificial Sequence
  Synthetic
SFNLRET

SEQ ID NO: 18589 - protein, 7 aa, Artificial Sequence
  Synthetic
MWVPGSS

SEQ ID NO: 18590 - protein, 7 aa, Artificial Sequence
  Synthetic
LVWGEVV

SEQ ID NO: 18591 - protein, 7 aa, Artificial Sequence
  Synthetic
WGLLPTK

SEQ ID NO: 18592 - protein, 7 aa, Artificial Sequence
  Synthetic
MWAGSST

SEQ ID NO: 18593 - protein, 7 aa, Artificial Sequence
  Synthetic
WESKLTR

SEQ ID NO: 18594 - protein, 7 aa, Artificial Sequence
  Synthetic
THDSRPR

SEQ ID NO: 18595 - protein, 7 aa, Artificial Sequence
  Synthetic
EARWGAA

SEQ ID NO: 18596 - protein, 7 aa, Artificial Sequence
  Synthetic
FRLREMG

SEQ ID NO: 18597 - protein, 7 aa, Artificial Sequence
  Synthetic
HMVGSAW

SEQ ID NO: 18598 - protein, 7 aa, Artificial Sequence
  Synthetic
ENSHWSS

SEQ ID NO: 18599 - protein, 7 aa, Artificial Sequence
  Synthetic
MMVGFSS

SEQ ID NO: 18600 - protein, 7 aa, Artificial Sequence
  Synthetic
HGMLIQL

SEQ ID NO: 18601 - protein, 7 aa, Artificial Sequence
  Synthetic
RVMYEIA

SEQ ID NO: 18602 - protein, 7 aa, Artificial Sequence
  Synthetic
VYLGGSS

SEQ ID NO: 18603 - protein, 7 aa, Artificial Sequence
  Synthetic
HMVGWSS

SEQ ID NO: 18604 - protein, 7 aa, Artificial Sequence
  Synthetic
LHHAWAS

SEQ ID NO: 18605 - protein, 7 aa, Artificial Sequence
  Synthetic
MLRGLAQ

SEQ ID NO: 18606 - protein, 7 aa, Artificial Sequence
  Synthetic
YPQWDRA

SEQ ID NO: 18607 - protein, 7 aa, Artificial Sequence
  Synthetic
HLRTWSD

SEQ ID NO: 18608 - protein, 7 aa, Artificial Sequence
  Synthetic
PRLHLSA

SEQ ID NO: 18609 - protein, 7 aa, Artificial Sequence
  Synthetic
MVAREGR

SEQ ID NO: 18610 - protein, 7 aa, Artificial Sequence
  Synthetic
RSEVSGK

SEQ ID NO: 18611 - protein, 7 aa, Artificial Sequence
  Synthetic
AARNFDR

SEQ ID NO: 18612 - protein, 7 aa, Artificial Sequence
  Synthetic
NNAPAVR

SEQ ID NO: 18613 - protein, 7 aa, Artificial Sequence
  Synthetic
DRKHVEW

SEQ ID NO: 18614 - protein, 7 aa, Artificial Sequence
  Synthetic
FGGATPR

SEQ ID NO: 18615 - protein, 7 aa, Artificial Sequence
  Synthetic
HKPSTLS

SEQ ID NO: 18616 - protein, 7 aa, Artificial Sequence
  Synthetic
FQGPVVR

SEQ ID NO: 18617 - protein, 7 aa, Artificial Sequence
  Synthetic
WVHGYSQ

SEQ ID NO: 18618 - protein, 7 aa, Artificial Sequence
  Synthetic
WTVQNGH

SEQ ID NO: 18619 - protein, 7 aa, Artificial Sequence
  Synthetic
VRWRPEE

SEQ ID NO: 18620 - protein, 7 aa, Artificial Sequence
  Synthetic
LLPVMHR

SEQ ID NO: 18621 - protein, 7 aa, Artificial Sequence
  Synthetic
TVSWPKS

SEQ ID NO: 18622 - protein, 7 aa, Artificial Sequence
  Synthetic
YGVLSLV

SEQ ID NO: 18623 - protein, 7 aa, Artificial Sequence
  Synthetic
PLAHWSA

SEQ ID NO: 18624 - protein, 7 aa, Artificial Sequence
  Synthetic
LQLRGST

SEQ ID NO: 18625 - protein, 7 aa, Artificial Sequence
  Synthetic
NFDLRYH

SEQ ID NO: 18626 - protein, 7 aa, Artificial Sequence
  Synthetic
YGSLSSF

SEQ ID NO: 18627 - protein, 7 aa, Artificial Sequence
  Synthetic
EVAHWSS

SEQ ID NO: 18628 - protein, 7 aa, Artificial Sequence
  Synthetic
AYAFHSS

SEQ ID NO: 18629 - protein, 7 aa, Artificial Sequence
  Synthetic
FYLPGGD

SEQ ID NO: 18630 - protein, 7 aa, Artificial Sequence
  Synthetic
DGRFMAS

SEQ ID NO: 18631 - protein, 7 aa, Artificial Sequence
  Synthetic
VWPGDRS

SEQ ID NO: 18632 - protein, 7 aa, Artificial Sequence
  Synthetic
YVSYPDR

SEQ ID NO: 18633 - protein, 7 aa, Artificial Sequence
  Synthetic
LRYEGSM

SEQ ID NO: 18634 - protein, 7 aa, Artificial Sequence
  Synthetic
QKFNGSM

SEQ ID NO: 18635 - protein, 7 aa, Artificial Sequence
  Synthetic
PYGGSAW

SEQ ID NO: 18636 - protein, 7 aa, Artificial Sequence
  Synthetic
LRREGGA

SEQ ID NO: 18637 - protein, 7 aa, Artificial Sequence
  Synthetic
VDRGYSV

SEQ ID NO: 18638 - protein, 7 aa, Artificial Sequence
  Synthetic
HWRSDTQ

SEQ ID NO: 18639 - protein, 7 aa, Artificial Sequence
  Synthetic
RNRSWDD

SEQ ID NO: 18640 - protein, 7 aa, Artificial Sequence
  Synthetic
AWTGYAA

SEQ ID NO: 18641 - protein, 7 aa, Artificial Sequence
  Synthetic
PLNNGIW

SEQ ID NO: 18642 - protein, 7 aa, Artificial Sequence
  Synthetic
IVYGGSS

SEQ ID NO: 18643 - protein, 7 aa, Artificial Sequence
  Synthetic
LLPREGR

SEQ ID NO: 18644 - protein, 7 aa, Artificial Sequence
  Synthetic
WTTGTGF

SEQ ID NO: 18645 - protein, 7 aa, Artificial Sequence
  Synthetic
SKWHMQE

SEQ ID NO: 18646 - protein, 7 aa, Artificial Sequence
  Synthetic
FEFRGST

SEQ ID NO: 18647 - protein, 7 aa, Artificial Sequence
  Synthetic
ARVIMNN

SEQ ID NO: 18648 - protein, 7 aa, Artificial Sequence
  Synthetic
ERVYGSH

SEQ ID NO: 18649 - protein, 7 aa, Artificial Sequence
  Synthetic
DVRWGAS

SEQ ID NO: 18650 - protein, 7 aa, Artificial Sequence
  Synthetic
APNSGVW

SEQ ID NO: 18651 - protein, 7 aa, Artificial Sequence
  Synthetic
LFLHGSV

SEQ ID NO: 18652 - protein, 7 aa, Artificial Sequence
  Synthetic
SFAGSSS

SEQ ID NO: 18653 - protein, 7 aa, Artificial Sequence
  Synthetic
FWEGFSA

SEQ ID NO: 18654 - protein, 7 aa, Artificial Sequence
  Synthetic
KDVYASW

SEQ ID NO: 18655 - protein, 7 aa, Artificial Sequence
  Synthetic
YRNSEKP

SEQ ID NO: 18656 - protein, 7 aa, Artificial Sequence
  Synthetic
LYQHSNF

SEQ ID NO: 18657 - protein, 7 aa, Artificial Sequence
  Synthetic
QDVPGRW

SEQ ID NO: 18658 - protein, 7 aa, Artificial Sequence
  Synthetic
AAHSGLW

SEQ ID NO: 18659 - protein, 7 aa, Artificial Sequence
  Synthetic
VSPMSHW

SEQ ID NO: 18660 - protein, 7 aa, Artificial Sequence
  Synthetic
AYHGGST

SEQ ID NO: 18661 - protein, 7 aa, Artificial Sequence
  Synthetic
IRHMGSS

SEQ ID NO: 18662 - protein, 7 aa, Artificial Sequence
  Synthetic
AFDRYLT

SEQ ID NO: 18663 - protein, 7 aa, Artificial Sequence
  Synthetic
SRTHFSA

SEQ ID NO: 18664 - protein, 7 aa, Artificial Sequence
  Synthetic
HEVWGSS

SEQ ID NO: 18665 - protein, 7 aa, Artificial Sequence
  Synthetic
EVWLHSS

SEQ ID NO: 18666 - protein, 7 aa, Artificial Sequence
  Synthetic
ASQFDLR

SEQ ID NO: 18667 - protein, 7 aa, Artificial Sequence
  Synthetic
NISWGSS

SEQ ID NO: 18668 - protein, 7 aa, Artificial Sequence
  Synthetic
QRITLFN

SEQ ID NO: 18669 - protein, 7 aa, Artificial Sequence
  Synthetic
WREGGAQ

SEQ ID NO: 18670 - protein, 7 aa, Artificial Sequence
  Synthetic
ESPSARY

SEQ ID NO: 18671 - protein, 7 aa, Artificial Sequence
  Synthetic
DYPGWQA

SEQ ID NO: 18672 - protein, 7 aa, Artificial Sequence
  Synthetic
DLRWGSA

SEQ ID NO: 18673 - protein, 7 aa, Artificial Sequence
  Synthetic
EPKNVAR

SEQ ID NO: 18674 - protein, 7 aa, Artificial Sequence
  Synthetic
LRGFGSS

SEQ ID NO: 18675 - protein, 7 aa, Artificial Sequence
  Synthetic
NNYGYSS

SEQ ID NO: 18676 - protein, 7 aa, Artificial Sequence
  Synthetic
EMLGFSS

SEQ ID NO: 18677 - protein, 7 aa, Artificial Sequence
  Synthetic
RGSVHDW

SEQ ID NO: 18678 - protein, 7 aa, Artificial Sequence
  Synthetic
GSPPWSH

SEQ ID NO: 18679 - protein, 7 aa, Artificial Sequence
  Synthetic
GSMGWSS

SEQ ID NO: 18680 - protein, 7 aa, Artificial Sequence
  Synthetic
DPYTLSY

SEQ ID NO: 18681 - protein, 7 aa, Artificial Sequence
  Synthetic
PFAGYAS

SEQ ID NO: 18682 - protein, 7 aa, Artificial Sequence
  Synthetic
LRIGEAQ

SEQ ID NO: 18683 - protein, 7 aa, Artificial Sequence
  Synthetic
RFELDSA

SEQ ID NO: 18684 - protein, 7 aa, Artificial Sequence
  Synthetic
RYPADAI

SEQ ID NO: 18685 - protein, 7 aa, Artificial Sequence
  Synthetic
ARMQRDA

SEQ ID NO: 18686 - protein, 7 aa, Artificial Sequence
  Synthetic
RNTTMDR

SEQ ID NO: 18687 - protein, 7 aa, Artificial Sequence
  Synthetic
RASYGSA

SEQ ID NO: 18688 - protein, 7 aa, Artificial Sequence
  Synthetic
CITLGSA

SEQ ID NO: 18689 - protein, 7 aa, Artificial Sequence
  Synthetic
SERYQGW

SEQ ID NO: 18690 - protein, 7 aa, Artificial Sequence
  Synthetic
LHTWQSQ

SEQ ID NO: 18691 - protein, 7 aa, Artificial Sequence
  Synthetic
LAYEGFR

SEQ ID NO: 18692 - protein, 7 aa, Artificial Sequence
  Synthetic
LTVRYGL

SEQ ID NO: 18693 - protein, 7 aa, Artificial Sequence
  Synthetic
RYPHDAS

SEQ ID NO: 18694 - protein, 7 aa, Artificial Sequence
  Synthetic
VMIGRAG

SEQ ID NO: 18695 - protein, 7 aa, Artificial Sequence
  Synthetic
RSEYMTF

SEQ ID NO: 18696 - protein, 7 aa, Artificial Sequence
  Synthetic
VLMFTHG

SEQ ID NO: 18697 - protein, 7 aa, Artificial Sequence
  Synthetic
RWTADQT

SEQ ID NO: 18698 - protein, 7 aa, Artificial Sequence
  Synthetic
LTAIRSI

SEQ ID NO: 18699 - protein, 7 aa, Artificial Sequence
  Synthetic
ASSSAYW

SEQ ID NO: 18700 - protein, 7 aa, Artificial Sequence
  Synthetic
MFVGFAS

SEQ ID NO: 18701 - protein, 7 aa, Artificial Sequence
  Synthetic
IVKGYSS

SEQ ID NO: 18702 - protein, 7 aa, Artificial Sequence
  Synthetic
ISSGYAQ

SEQ ID NO: 18703 - protein, 7 aa, Artificial Sequence
  Synthetic
GTFNWAA

SEQ ID NO: 18704 - protein, 7 aa, Artificial Sequence
  Synthetic
SPSYRAD

SEQ ID NO: 18705 - protein, 7 aa, Artificial Sequence
  Synthetic
MVALGSS

SEQ ID NO: 18706 - protein, 7 aa, Artificial Sequence
  Synthetic
NEALLPY

SEQ ID NO: 18707 - protein, 7 aa, Artificial Sequence
  Synthetic
PAIRLLN

SEQ ID NO: 18708 - protein, 7 aa, Artificial Sequence
  Synthetic
SRETEYW

SEQ ID NO: 18709 - protein, 7 aa, Artificial Sequence
  Synthetic
TDLTGRW

SEQ ID NO: 18710 - protein, 7 aa, Artificial Sequence
  Synthetic
VEYRLPL

SEQ ID NO: 18711 - protein, 7 aa, Artificial Sequence
  Synthetic
IEWKIGN

SEQ ID NO: 18712 - protein, 7 aa, Artificial Sequence
  Synthetic
ERGGWSA

SEQ ID NO: 18713 - protein, 7 aa, Artificial Sequence
  Synthetic
GQQPGVW

SEQ ID NO: 18714 - protein, 7 aa, Artificial Sequence
  Synthetic
DAYRLPH

SEQ ID NO: 18715 - protein, 7 aa, Artificial Sequence
  Synthetic
LVAHGST

SEQ ID NO: 18716 - protein, 7 aa, Artificial Sequence
  Synthetic
MVWQGSV

SEQ ID NO: 18717 - protein, 7 aa, Artificial Sequence
  Synthetic
DRRDVHW

SEQ ID NO: 18718 - protein, 7 aa, Artificial Sequence
  Synthetic
GPQWTAS

SEQ ID NO: 18719 - protein, 7 aa, Artificial Sequence
  Synthetic
VRDMALR

SEQ ID NO: 18720 - protein, 7 aa, Artificial Sequence
  Synthetic
VGFGYSM

SEQ ID NO: 18721 - protein, 7 aa, Artificial Sequence
  Synthetic
LIERGSS

SEQ ID NO: 18722 - protein, 7 aa, Artificial Sequence
  Synthetic
PVHRSYG

SEQ ID NO: 18723 - protein, 7 aa, Artificial Sequence
  Synthetic
LFAHGSA

SEQ ID NO: 18724 - protein, 7 aa, Artificial Sequence
  Synthetic
RAWSPDG

SEQ ID NO: 18725 - protein, 7 aa, Artificial Sequence
  Synthetic
KWPGSAM

SEQ ID NO: 18726 - protein, 7 aa, Artificial Sequence
  Synthetic
RLDYQSW

SEQ ID NO: 18727 - protein, 7 aa, Artificial Sequence
  Synthetic
LGAVGPW

SEQ ID NO: 18728 - protein, 7 aa, Artificial Sequence
  Synthetic
REDRMWV

SEQ ID NO: 18729 - protein, 7 aa, Artificial Sequence
  Synthetic
EKGYVGW

SEQ ID NO: 18730 - protein, 7 aa, Artificial Sequence
  Synthetic
RGNPGHG

SEQ ID NO: 18731 - protein, 7 aa, Artificial Sequence
  Synthetic
KPRLVET

SEQ ID NO: 18732 - protein, 7 aa, Artificial Sequence
  Synthetic
WVALPHS

SEQ ID NO: 18733 - protein, 7 aa, Artificial Sequence
  Synthetic
GRIVLHV

SEQ ID NO: 18734 - protein, 7 aa, Artificial Sequence
  Synthetic
MWPGSSV

SEQ ID NO: 18735 - protein, 7 aa, Artificial Sequence
  Synthetic
LIEFGSA

SEQ ID NO: 18736 - protein, 7 aa, Artificial Sequence
  Synthetic
GYPGSST

SEQ ID NO: 18737 - protein, 7 aa, Artificial Sequence
  Synthetic
LFHGYQQ

SEQ ID NO: 18738 - protein, 7 aa, Artificial Sequence
  Synthetic
KWVSGKD

SEQ ID NO: 18739 - protein, 7 aa, Artificial Sequence
  Synthetic
FLRDAVP

SEQ ID NO: 18740 - protein, 7 aa, Artificial Sequence
  Synthetic
VQWTEFH

SEQ ID NO: 18741 - protein, 7 aa, Artificial Sequence
  Synthetic
SVPYSSS

SEQ ID NO: 18742 - protein, 7 aa, Artificial Sequence
  Synthetic
SSHLLPY

SEQ ID NO: 18743 - protein, 7 aa, Artificial Sequence
  Synthetic
IKWEGSS

SEQ ID NO: 18744 - protein, 7 aa, Artificial Sequence
  Synthetic
FEWMGAA

SEQ ID NO: 18745 - protein, 7 aa, Artificial Sequence
  Synthetic
FFLGGSQ

SEQ ID NO: 18746 - protein, 7 aa, Artificial Sequence
  Synthetic
SITHGSS

SEQ ID NO: 18747 - protein, 7 aa, Artificial Sequence
  Synthetic
TWYDGAS

SEQ ID NO: 18748 - protein, 7 aa, Artificial Sequence
  Synthetic
PYAGFAS

SEQ ID NO: 18749 - protein, 7 aa, Artificial Sequence
  Synthetic
GNPGWSQ

SEQ ID NO: 18750 - protein, 7 aa, Artificial Sequence
  Synthetic
PYTNAAR

SEQ ID NO: 18751 - protein, 7 aa, Artificial Sequence
  Synthetic
HGTRPNT

SEQ ID NO: 18752 - protein, 7 aa, Artificial Sequence
  Synthetic
GFSSGSW

SEQ ID NO: 18753 - protein, 7 aa, Artificial Sequence
  Synthetic
LQYMLSS

SEQ ID NO: 18754 - protein, 7 aa, Artificial Sequence
  Synthetic
PSQFDLR

SEQ ID NO: 18755 - protein, 7 aa, Artificial Sequence
  Synthetic
GVHVGLW

SEQ ID NO: 18756 - protein, 7 aa, Artificial Sequence
  Synthetic
RAFDLRP

SEQ ID NO: 18757 - protein, 7 aa, Artificial Sequence
  Synthetic
SWAGSST

SEQ ID NO: 18758 - protein, 7 aa, Artificial Sequence
  Synthetic
WGLVPGH

SEQ ID NO: 18759 - protein, 7 aa, Artificial Sequence
  Synthetic
SVPGMSS

SEQ ID NO: 18760 - protein, 7 aa, Artificial Sequence
  Synthetic
VLRLMSL

SEQ ID NO: 18761 - protein, 7 aa, Artificial Sequence
  Synthetic
PPLTHGW

SEQ ID NO: 18762 - protein, 7 aa, Artificial Sequence
  Synthetic
VGGPGIW

SEQ ID NO: 18763 - protein, 7 aa, Artificial Sequence
  Synthetic
GSWHGPG

SEQ ID NO: 18764 - protein, 7 aa, Artificial Sequence
  Synthetic
NRNVGFA

SEQ ID NO: 18765 - protein, 7 aa, Artificial Sequence
  Synthetic
TAGEGRW

SEQ ID NO: 18766 - protein, 7 aa, Artificial Sequence
  Synthetic
PNPTGRY

SEQ ID NO: 18767 - protein, 7 aa, Artificial Sequence
  Synthetic
LVGRAMG

SEQ ID NO: 18768 - protein, 7 aa, Artificial Sequence
  Synthetic
FAHGYSS

SEQ ID NO: 18769 - protein, 7 aa, Artificial Sequence
  Synthetic
LGSLERF

SEQ ID NO: 18770 - protein, 7 aa, Artificial Sequence
  Synthetic
VRDYASW

SEQ ID NO: 18771 - protein, 7 aa, Artificial Sequence
  Synthetic
VAQGWSQ

SEQ ID NO: 18772 - protein, 7 aa, Artificial Sequence
  Synthetic
RFMPDAA

SEQ ID NO: 18773 - protein, 7 aa, Artificial Sequence
  Synthetic
PQVVMAP

SEQ ID NO: 18774 - protein, 7 aa, Artificial Sequence
  Synthetic
GSDGARF

SEQ ID NO: 18775 - protein, 7 aa, Artificial Sequence
  Synthetic
MRCGQMC

SEQ ID NO: 18776 - protein, 7 aa, Artificial Sequence
  Synthetic
RSGTPER

SEQ ID NO: 18777 - protein, 7 aa, Artificial Sequence
  Synthetic
NHNTSLR

SEQ ID NO: 18778 - protein, 7 aa, Artificial Sequence
  Synthetic
ARDWSYG

SEQ ID NO: 18779 - protein, 7 aa, Artificial Sequence
  Synthetic
PGSYMSS

SEQ ID NO: 18780 - protein, 7 aa, Artificial Sequence
  Synthetic
AKVVAGW

SEQ ID NO: 18781 - protein, 7 aa, Artificial Sequence
  Synthetic
RVHPNRE

SEQ ID NO: 18782 - protein, 7 aa, Artificial Sequence
  Synthetic
RSENRVN

SEQ ID NO: 18783 - protein, 7 aa, Artificial Sequence
  Synthetic
GPAHVGR

SEQ ID NO: 18784 - protein, 7 aa, Artificial Sequence
  Synthetic
WTLPTGH

SEQ ID NO: 18785 - protein, 7 aa, Artificial Sequence
  Synthetic
WSQFGPG

SEQ ID NO: 18786 - protein, 7 aa, Artificial Sequence
  Synthetic
GVHMAIY

SEQ ID NO: 18787 - protein, 7 aa, Artificial Sequence
  Synthetic
GNDYNRW

SEQ ID NO: 18788 - protein, 7 aa, Artificial Sequence
  Synthetic
ERPYMSA

SEQ ID NO: 18789 - protein, 7 aa, Artificial Sequence
  Synthetic
DNRAWGA

SEQ ID NO: 18790 - protein, 7 aa, Artificial Sequence
  Synthetic
GEPHGRW

SEQ ID NO: 18791 - protein, 7 aa, Artificial Sequence
  Synthetic
TLLRLPN

SEQ ID NO: 18792 - protein, 7 aa, Artificial Sequence
  Synthetic
TREWGAQ

SEQ ID NO: 18793 - protein, 7 aa, Artificial Sequence
  Synthetic
AWHQGSA

SEQ ID NO: 18794 - protein, 7 aa, Artificial Sequence
  Synthetic
RFIGSSA

SEQ ID NO: 18795 - protein, 7 aa, Artificial Sequence
  Synthetic
GKDVGRW

SEQ ID NO: 18796 - protein, 7 aa, Artificial Sequence
  Synthetic
LYLGGSS

SEQ ID NO: 18797 - protein, 7 aa, Artificial Sequence
  Synthetic
QSFGYSS

SEQ ID NO: 18798 - protein, 7 aa, Artificial Sequence
  Synthetic
GLSRGDL

SEQ ID NO: 18799 - protein, 7 aa, Artificial Sequence
  Synthetic
PGIGYSS

SEQ ID NO: 18800 - protein, 7 aa, Artificial Sequence
  Synthetic
DVTRMWV

SEQ ID NO: 18801 - protein, 7 aa, Artificial Sequence
  Synthetic
WAAGYNH

SEQ ID NO: 18802 - protein, 7 aa, Artificial Sequence
  Synthetic
LGPGFGR

SEQ ID NO: 18803 - protein, 7 aa, Artificial Sequence
  Synthetic
PAPGIGW

SEQ ID NO: 18804 - protein, 7 aa, Artificial Sequence
  Synthetic
LNPVALW

SEQ ID NO: 18805 - protein, 7 aa, Artificial Sequence
  Synthetic
WSVGGSS

SEQ ID NO: 18806 - protein, 7 aa, Artificial Sequence
  Synthetic
MNMLNPR

SEQ ID NO: 18807 - protein, 7 aa, Artificial Sequence
  Synthetic
KSLGQHN

SEQ ID NO: 18808 - protein, 7 aa, Artificial Sequence
  Synthetic
GPERHRI

SEQ ID NO: 18809 - protein, 7 aa, Artificial Sequence
  Synthetic
RTHGPLM

SEQ ID NO: 18810 - protein, 7 aa, Artificial Sequence
  Synthetic
GRDAARY

SEQ ID NO: 18811 - protein, 7 aa, Artificial Sequence
  Synthetic
WSAGTGY

SEQ ID NO: 18812 - protein, 7 aa, Artificial Sequence
  Synthetic
YAIYGSG

SEQ ID NO: 18813 - protein, 7 aa, Artificial Sequence
  Synthetic
LGFSMSQ

SEQ ID NO: 18814 - protein, 7 aa, Artificial Sequence
  Synthetic
RVPGHVV

SEQ ID NO: 18815 - protein, 7 aa, Artificial Sequence
  Synthetic
AWGKIGG

SEQ ID NO: 18816 - protein, 7 aa, Artificial Sequence
  Synthetic
VWIPAAS

SEQ ID NO: 18817 - protein, 7 aa, Artificial Sequence
  Synthetic
LHIGMGY

SEQ ID NO: 18818 - protein, 7 aa, Artificial Sequence
  Synthetic
SYNFRVE

SEQ ID NO: 18819 - protein, 7 aa, Artificial Sequence
  Synthetic
KYLGGAS

SEQ ID NO: 18820 - protein, 7 aa, Artificial Sequence
  Synthetic
ADSYAHW

SEQ ID NO: 18821 - protein, 7 aa, Artificial Sequence
  Synthetic
IGPGWSM

SEQ ID NO: 18822 - protein, 7 aa, Artificial Sequence
  Synthetic
LSSLFSS

SEQ ID NO: 18823 - protein, 7 aa, Artificial Sequence
  Synthetic
LREQGFW

SEQ ID NO: 18824 - protein, 7 aa, Artificial Sequence
  Synthetic
FVFGTEV

SEQ ID NO: 18825 - protein, 7 aa, Artificial Sequence
  Synthetic
TWNSLGA

SEQ ID NO: 18826 - protein, 7 aa, Artificial Sequence
  Synthetic
WGTYPSF

SEQ ID NO: 18827 - protein, 7 aa, Artificial Sequence
  Synthetic
WGSLPVN

SEQ ID NO: 18828 - protein, 7 aa, Artificial Sequence
  Synthetic
WGSLAQI

SEQ ID NO: 18829 - protein, 7 aa, Artificial Sequence
  Synthetic
WASLGSA

SEQ ID NO: 18830 - protein, 7 aa, Artificial Sequence
  Synthetic
EKNPGRW

SEQ ID NO: 18831 - protein, 7 aa, Artificial Sequence
  Synthetic
GSTPGVW

SEQ ID NO: 18832 - protein, 7 aa, Artificial Sequence
  Synthetic
FNTGWAS

SEQ ID NO: 18833 - protein, 7 aa, Artificial Sequence
  Synthetic
GYTREHW

SEQ ID NO: 18834 - protein, 7 aa, Artificial Sequence
  Synthetic
PVTRTSW

SEQ ID NO: 18835 - protein, 7 aa, Artificial Sequence
  Synthetic
TRAMPER

SEQ ID NO: 18836 - protein, 7 aa, Artificial Sequence
  Synthetic
HLGRGRE

SEQ ID NO: 18837 - protein, 7 aa, Artificial Sequence
  Synthetic
WSIMEGH

SEQ ID NO: 18838 - protein, 7 aa, Artificial Sequence
  Synthetic
FGHTRWE

SEQ ID NO: 18839 - protein, 7 aa, Artificial Sequence
  Synthetic
RPQHGPN

SEQ ID NO: 18840 - protein, 7 aa, Artificial Sequence
  Synthetic
GWPGQAS

SEQ ID NO: 18841 - protein, 7 aa, Artificial Sequence
  Synthetic
SWDFNSG

SEQ ID NO: 18842 - protein, 7 aa, Artificial Sequence
  Synthetic
TTWGGST

SEQ ID NO: 18843 - protein, 7 aa, Artificial Sequence
  Synthetic
NGLPWAH

SEQ ID NO: 18844 - protein, 7 aa, Artificial Sequence
  Synthetic
LLLRPTL

SEQ ID NO: 18845 - protein, 7 aa, Artificial Sequence
  Synthetic
VKIGWST

SEQ ID NO: 18846 - protein, 7 aa, Artificial Sequence
  Synthetic
TVRLGST

SEQ ID NO: 18847 - protein, 7 aa, Artificial Sequence
  Synthetic
PITSPMW

SEQ ID NO: 18848 - protein, 7 aa, Artificial Sequence
  Synthetic
RNTTEAR

SEQ ID NO: 18849 - protein, 7 aa, Artificial Sequence
  Synthetic
SYDLRHP

SEQ ID NO: 18850 - protein, 7 aa, Artificial Sequence
  Synthetic
MVMRGSA

SEQ ID NO: 18851 - protein, 7 aa, Artificial Sequence
  Synthetic
AGPVRFS

SEQ ID NO: 18852 - protein, 7 aa, Artificial Sequence
  Synthetic
TGGYGYH

SEQ ID NO: 18853 - protein, 7 aa, Artificial Sequence
  Synthetic
PKQTGGW

SEQ ID NO: 18854 - protein, 7 aa, Artificial Sequence
  Synthetic
LYHNHSM

SEQ ID NO: 18855 - protein, 7 aa, Artificial Sequence
  Synthetic
IPGREWT

SEQ ID NO: 18856 - protein, 7 aa, Artificial Sequence
  Synthetic
VHGWKHD

SEQ ID NO: 18857 - protein, 7 aa, Artificial Sequence
  Synthetic
SYLLGAS

SEQ ID NO: 18858 - protein, 7 aa, Artificial Sequence
  Synthetic
NHISLRD

SEQ ID NO: 18859 - protein, 7 aa, Artificial Sequence
  Synthetic
QHQGWSS

SEQ ID NO: 18860 - protein, 7 aa, Artificial Sequence
  Synthetic
EAWHGSS

SEQ ID NO: 18861 - protein, 7 aa, Artificial Sequence
  Synthetic
VRAHGSS

SEQ ID NO: 18862 - protein, 7 aa, Artificial Sequence
  Synthetic
NEQTRWQ

SEQ ID NO: 18863 - protein, 7 aa, Artificial Sequence
  Synthetic
SHPGWSA

SEQ ID NO: 18864 - protein, 7 aa, Artificial Sequence
  Synthetic
KYVADRT

SEQ ID NO: 18865 - protein, 7 aa, Artificial Sequence
  Synthetic
EGYGRLN

SEQ ID NO: 18866 - protein, 7 aa, Artificial Sequence
  Synthetic
RWGEDFL

SEQ ID NO: 18867 - protein, 7 aa, Artificial Sequence
  Synthetic
LEPWNRT

SEQ ID NO: 18868 - protein, 7 aa, Artificial Sequence
  Synthetic
PRVILSP

SEQ ID NO: 18869 - protein, 7 aa, Artificial Sequence
  Synthetic
SFLYGSV

SEQ ID NO: 18870 - protein, 7 aa, Artificial Sequence
  Synthetic
MVRLGSS

SEQ ID NO: 18871 - protein, 7 aa, Artificial Sequence
  Synthetic
VSYGMAQ

SEQ ID NO: 18872 - protein, 7 aa, Artificial Sequence
  Synthetic
WGLLQDR

SEQ ID NO: 18873 - protein, 7 aa, Artificial Sequence
  Synthetic
DNGGSRW

SEQ ID NO: 18874 - protein, 7 aa, Artificial Sequence
  Synthetic
TRHHDDR

SEQ ID NO: 18875 - protein, 7 aa, Artificial Sequence
  Synthetic
AWDRGSS

SEQ ID NO: 18876 - protein, 7 aa, Artificial Sequence
  Synthetic
HGEYRQW

SEQ ID NO: 18877 - protein, 7 aa, Artificial Sequence
  Synthetic
LFRDPVR

SEQ ID NO: 18878 - protein, 7 aa, Artificial Sequence
  Synthetic
VHSWSAS

SEQ ID NO: 18879 - protein, 7 aa, Artificial Sequence
  Synthetic
RYVGGSM

SEQ ID NO: 18880 - protein, 7 aa, Artificial Sequence
  Synthetic
MRPLGSS

SEQ ID NO: 18881 - protein, 7 aa, Artificial Sequence
  Synthetic
SENSRWA

SEQ ID NO: 18882 - protein, 7 aa, Artificial Sequence
  Synthetic
GRAGNLN

SEQ ID NO: 18883 - protein, 7 aa, Artificial Sequence
  Synthetic
GRDVGVW

SEQ ID NO: 18884 - protein, 7 aa, Artificial Sequence
  Synthetic
GGSGRFL

SEQ ID NO: 18885 - protein, 7 aa, Artificial Sequence
  Synthetic
DVRTPFR

SEQ ID NO: 18886 - protein, 7 aa, Artificial Sequence
  Synthetic
VAGSVYL

SEQ ID NO: 18887 - protein, 7 aa, Artificial Sequence
  Synthetic
GYLPLGR

SEQ ID NO: 18888 - protein, 7 aa, Artificial Sequence
  Synthetic
PAQWAAS

SEQ ID NO: 18889 - protein, 7 aa, Artificial Sequence
  Synthetic
YVALPGL

SEQ ID NO: 18890 - protein, 7 aa, Artificial Sequence
  Synthetic
AEHRHGW

SEQ ID NO: 18891 - protein, 7 aa, Artificial Sequence
  Synthetic
DNRPPNR

SEQ ID NO: 18892 - protein, 7 aa, Artificial Sequence
  Synthetic
FVSLPRL

SEQ ID NO: 18893 - protein, 7 aa, Artificial Sequence
  Synthetic
VRAWESH

SEQ ID NO: 18894 - protein, 7 aa, Artificial Sequence
  Synthetic
MGAGFSS

SEQ ID NO: 18895 - protein, 7 aa, Artificial Sequence
  Synthetic
PIELYGR

SEQ ID NO: 18896 - protein, 7 aa, Artificial Sequence
  Synthetic
LVEWGSA

SEQ ID NO: 18897 - protein, 7 aa, Artificial Sequence
  Synthetic
GSLPWSS

SEQ ID NO: 18898 - protein, 7 aa, Artificial Sequence
  Synthetic
GLGASPP

SEQ ID NO: 18899 - protein, 7 aa, Artificial Sequence
  Synthetic
NERHWER

SEQ ID NO: 18900 - protein, 7 aa, Artificial Sequence
  Synthetic
ARQERLA

SEQ ID NO: 18901 - protein, 7 aa, Artificial Sequence
  Synthetic
GIVDVRS

SEQ ID NO: 18902 - protein, 7 aa, Artificial Sequence
  Synthetic
KRDDGKW

SEQ ID NO: 18903 - protein, 7 aa, Artificial Sequence
  Synthetic
RTEERRV

SEQ ID NO: 18904 - protein, 7 aa, Artificial Sequence
  Synthetic
GSQGGSR

SEQ ID NO: 18905 - protein, 7 aa, Artificial Sequence
  Synthetic
RAYTESW

SEQ ID NO: 18906 - protein, 7 aa, Artificial Sequence
  Synthetic
LAMGFST

SEQ ID NO: 18907 - protein, 7 aa, Artificial Sequence
  Synthetic
GMNSGMW

SEQ ID NO: 18908 - protein, 7 aa, Artificial Sequence
  Synthetic
VEYRLPV

SEQ ID NO: 18909 - protein, 7 aa, Artificial Sequence
  Synthetic
GVAEGRW

SEQ ID NO: 18910 - protein, 7 aa, Artificial Sequence
  Synthetic
QGGAGFK

SEQ ID NO: 18911 - protein, 7 aa, Artificial Sequence
  Synthetic
RLPYANT

SEQ ID NO: 18912 - protein, 7 aa, Artificial Sequence
  Synthetic
ALVSYAY

SEQ ID NO: 18913 - protein, 7 aa, Artificial Sequence
  Synthetic
YTVPGGW

SEQ ID NO: 18914 - protein, 7 aa, Artificial Sequence
  Synthetic
FEFRLDR

SEQ ID NO: 18915 - protein, 7 aa, Artificial Sequence
  Synthetic
ASWGMTS

SEQ ID NO: 18916 - protein, 7 aa, Artificial Sequence
  Synthetic
LVIRHAS

SEQ ID NO: 18917 - protein, 7 aa, Artificial Sequence
  Synthetic
RHPGESS

SEQ ID NO: 18918 - protein, 7 aa, Artificial Sequence
  Synthetic
GLVGWAQ

SEQ ID NO: 18919 - protein, 7 aa, Artificial Sequence
  Synthetic
DMYRGAS

SEQ ID NO: 18920 - protein, 7 aa, Artificial Sequence
  Synthetic
IPSEARW

SEQ ID NO: 18921 - protein, 7 aa, Artificial Sequence
  Synthetic
GRMREEW

SEQ ID NO: 18922 - protein, 7 aa, Artificial Sequence
  Synthetic
STGNAMR

SEQ ID NO: 18923 - protein, 7 aa, Artificial Sequence
  Synthetic
VWDNRLG

SEQ ID NO: 18924 - protein, 7 aa, Artificial Sequence
  Synthetic
YTVTGGF

SEQ ID NO: 18925 - protein, 7 aa, Artificial Sequence
  Synthetic
PLKPNGW

SEQ ID NO: 18926 - protein, 7 aa, Artificial Sequence
  Synthetic
FRSNGSM

SEQ ID NO: 18927 - protein, 7 aa, Artificial Sequence
  Synthetic
HTYRLDM

SEQ ID NO: 18928 - protein, 7 aa, Artificial Sequence
  Synthetic
RLREMSV

SEQ ID NO: 18929 - protein, 7 aa, Artificial Sequence
  Synthetic
VISFSFG

SEQ ID NO: 18930 - protein, 7 aa, Artificial Sequence
  Synthetic
YGKGREG

SEQ ID NO: 18931 - protein, 7 aa, Artificial Sequence
  Synthetic
YRSLPGV

SEQ ID NO: 18932 - protein, 7 aa, Artificial Sequence
  Synthetic
ERTHGAA

SEQ ID NO: 18933 - protein, 7 aa, Artificial Sequence
  Synthetic
RGDLERR

SEQ ID NO: 18934 - protein, 7 aa, Artificial Sequence
  Synthetic
ALGSSIW

SEQ ID NO: 18935 - protein, 7 aa, Artificial Sequence
  Synthetic
LQSWSSQ

SEQ ID NO: 18936 - protein, 7 aa, Artificial Sequence
  Synthetic
NHENFIE

SEQ ID NO: 18937 - protein, 7 aa, Artificial Sequence
  Synthetic
GLRSSER

SEQ ID NO: 18938 - protein, 7 aa, Artificial Sequence
  Synthetic
WSKMGSA

SEQ ID NO: 18939 - protein, 7 aa, Artificial Sequence
  Synthetic
SRAYGSA

SEQ ID NO: 18940 - protein, 7 aa, Artificial Sequence
  Synthetic
LLQGPCC

SEQ ID NO: 18941 - protein, 7 aa, Artificial Sequence
  Synthetic
EVIYGSS

SEQ ID NO: 18942 - protein, 7 aa, Artificial Sequence
  Synthetic
DVQWGSS

SEQ ID NO: 18943 - protein, 7 aa, Artificial Sequence
  Synthetic
LLSFGSS

SEQ ID NO: 18944 - protein, 7 aa, Artificial Sequence
  Synthetic
WELRGSS

SEQ ID NO: 18945 - protein, 7 aa, Artificial Sequence
  Synthetic
LYAGSAS

SEQ ID NO: 18946 - protein, 7 aa, Artificial Sequence
  Synthetic
ERKLMSA

SEQ ID NO: 18947 - protein, 7 aa, Artificial Sequence
  Synthetic
HAKDSIR

SEQ ID NO: 18948 - protein, 7 aa, Artificial Sequence
  Synthetic
WGLEGGW

SEQ ID NO: 18949 - protein, 7 aa, Artificial Sequence
  Synthetic
KSLGLSQ

SEQ ID NO: 18950 - protein, 7 aa, Artificial Sequence
  Synthetic
GPHLGTW

SEQ ID NO: 18951 - protein, 7 aa, Artificial Sequence
  Synthetic
RTVVEGR

SEQ ID NO: 18952 - protein, 7 aa, Artificial Sequence
  Synthetic
RQHHTLG

SEQ ID NO: 18953 - protein, 7 aa, Artificial Sequence
  Synthetic
WNDLLGR

SEQ ID NO: 18954 - protein, 7 aa, Artificial Sequence
  Synthetic
YGRLEFM

SEQ ID NO: 18955 - protein, 7 aa, Artificial Sequence
  Synthetic
ILAGYQQ

SEQ ID NO: 18956 - protein, 7 aa, Artificial Sequence
  Synthetic
PFEYAVA

SEQ ID NO: 18957 - protein, 7 aa, Artificial Sequence
  Synthetic
GVSEGRW

SEQ ID NO: 18958 - protein, 7 aa, Artificial Sequence
  Synthetic
GGVEGRW

SEQ ID NO: 18959 - protein, 7 aa, Artificial Sequence
  Synthetic
LAVPWSS

SEQ ID NO: 18960 - protein, 7 aa, Artificial Sequence
  Synthetic
EVSWAAS

SEQ ID NO: 18961 - protein, 7 aa, Artificial Sequence
  Synthetic
DYRVLPY

SEQ ID NO: 18962 - protein, 7 aa, Artificial Sequence
  Synthetic
DIRWVAG

SEQ ID NO: 18963 - protein, 7 aa, Artificial Sequence
  Synthetic
AQYMGSS

SEQ ID NO: 18964 - protein, 7 aa, Artificial Sequence
  Synthetic
SASFGSS

SEQ ID NO: 18965 - protein, 7 aa, Artificial Sequence
  Synthetic
HLYGLSQ

SEQ ID NO: 18966 - protein, 7 aa, Artificial Sequence
  Synthetic
LRQMGSA

SEQ ID NO: 18967 - protein, 7 aa, Artificial Sequence
  Synthetic
GPDWNRT

SEQ ID NO: 18968 - protein, 7 aa, Artificial Sequence
  Synthetic
HLSSGGR

SEQ ID NO: 18969 - protein, 7 aa, Artificial Sequence
  Synthetic
GIRHVAI

SEQ ID NO: 18970 - protein, 7 aa, Artificial Sequence
  Synthetic
WTLQEAY

SEQ ID NO: 18971 - protein, 7 aa, Artificial Sequence
  Synthetic
AVVNTHR

SEQ ID NO: 18972 - protein, 7 aa, Artificial Sequence
  Synthetic
ITRAIPY

SEQ ID NO: 18973 - protein, 7 aa, Artificial Sequence
  Synthetic
SFGHGFH

SEQ ID NO: 18974 - protein, 7 aa, Artificial Sequence
  Synthetic
DPGDARW

SEQ ID NO: 18975 - protein, 7 aa, Artificial Sequence
  Synthetic
GHPIAVK

SEQ ID NO: 18976 - protein, 7 aa, Artificial Sequence
  Synthetic
HDYNSRF

SEQ ID NO: 18977 - protein, 7 aa, Artificial Sequence
  Synthetic
THYGQGW

SEQ ID NO: 18978 - protein, 7 aa, Artificial Sequence
  Synthetic
KTLNDYW

SEQ ID NO: 18979 - protein, 7 aa, Artificial Sequence
  Synthetic
RSLGNDR

SEQ ID NO: 18980 - protein, 7 aa, Artificial Sequence
  Synthetic
RIAQETR

SEQ ID NO: 18981 - protein, 7 aa, Artificial Sequence
  Synthetic
RWGNDAI

SEQ ID NO: 18982 - protein, 7 aa, Artificial Sequence
  Synthetic
HHKTSNP

SEQ ID NO: 18983 - protein, 7 aa, Artificial Sequence
  Synthetic
GMRLPAH

SEQ ID NO: 18984 - protein, 7 aa, Artificial Sequence
  Synthetic
PKLDNRW

SEQ ID NO: 18985 - protein, 7 aa, Artificial Sequence
  Synthetic
WSPERGY

SEQ ID NO: 18986 - protein, 7 aa, Artificial Sequence
  Synthetic
MTTPSFF

SEQ ID NO: 18987 - protein, 7 aa, Artificial Sequence
  Synthetic
RLNNVHT

SEQ ID NO: 18988 - protein, 7 aa, Artificial Sequence
  Synthetic
MGDRWAY

SEQ ID NO: 18989 - protein, 7 aa, Artificial Sequence
  Synthetic
GLLNGFH

SEQ ID NO: 18990 - protein, 7 aa, Artificial Sequence
  Synthetic
EVRFGSA

SEQ ID NO: 18991 - protein, 7 aa, Artificial Sequence
  Synthetic
DSYATRF

SEQ ID NO: 18992 - protein, 7 aa, Artificial Sequence
  Synthetic
VNVGYSS

SEQ ID NO: 18993 - protein, 7 aa, Artificial Sequence
  Synthetic
SLHARWD

SEQ ID NO: 18994 - protein, 7 aa, Artificial Sequence
  Synthetic
PRLQYSA

SEQ ID NO: 18995 - protein, 7 aa, Artificial Sequence
  Synthetic
SVPHSHW

SEQ ID NO: 18996 - protein, 7 aa, Artificial Sequence
  Synthetic
LWELGSS

SEQ ID NO: 18997 - protein, 7 aa, Artificial Sequence
  Synthetic
TTMGYSS

SEQ ID NO: 18998 - protein, 7 aa, Artificial Sequence
  Synthetic
MNYGMST

SEQ ID NO: 18999 - protein, 7 aa, Artificial Sequence
  Synthetic
WAERGSS

SEQ ID NO: 19000 - protein, 7 aa, Artificial Sequence
  Synthetic
HMLGRVN

SEQ ID NO: 19001 - protein, 7 aa, Artificial Sequence
  Synthetic
GVPASFY

SEQ ID NO: 19002 - protein, 7 aa, Artificial Sequence
  Synthetic
SNYETRF

SEQ ID NO: 19003 - protein, 7 aa, Artificial Sequence
  Synthetic
GYPGYAA

SEQ ID NO: 19004 - protein, 7 aa, Artificial Sequence
  Synthetic
GYPGFSS

SEQ ID NO: 19005 - protein, 7 aa, Artificial Sequence
  Synthetic
WQARQAN

SEQ ID NO: 19006 - protein, 7 aa, Artificial Sequence
  Synthetic
HGVRMTA

SEQ ID NO: 19007 - protein, 7 aa, Artificial Sequence
  Synthetic
NRPVIHQ

SEQ ID NO: 19008 - protein, 7 aa, Artificial Sequence
  Synthetic
EVSFGSA

SEQ ID NO: 19009 - protein, 7 aa, Artificial Sequence
  Synthetic
WVEYPNQ

SEQ ID NO: 19010 - protein, 7 aa, Artificial Sequence
  Synthetic
RLETMLY

SEQ ID NO: 19011 - protein, 7 aa, Artificial Sequence
  Synthetic
VLYQLPT

SEQ ID NO: 19012 - protein, 7 aa, Artificial Sequence
  Synthetic
DHAGARW

SEQ ID NO: 19013 - protein, 7 aa, Artificial Sequence
  Synthetic
SGHERWA

SEQ ID NO: 19014 - protein, 7 aa, Artificial Sequence
  Synthetic
LRESWAS

SEQ ID NO: 19015 - protein, 7 aa, Artificial Sequence
  Synthetic
SPGYRAD

SEQ ID NO: 19016 - protein, 7 aa, Artificial Sequence
  Synthetic
TFAGQSQ

SEQ ID NO: 19017 - protein, 7 aa, Artificial Sequence
  Synthetic
FFSLGAA

SEQ ID NO: 19018 - protein, 7 aa, Artificial Sequence
  Synthetic
ALVIYGA

SEQ ID NO: 19019 - protein, 7 aa, Artificial Sequence
  Synthetic
GLTFGSI

SEQ ID NO: 19020 - protein, 7 aa, Artificial Sequence
  Synthetic
VASGQYW

SEQ ID NO: 19021 - protein, 7 aa, Artificial Sequence
  Synthetic
TFHIASI

SEQ ID NO: 19022 - protein, 7 aa, Artificial Sequence
  Synthetic
RYMGDSQ

SEQ ID NO: 19023 - protein, 7 aa, Artificial Sequence
  Synthetic
SKRVDMG

SEQ ID NO: 19024 - protein, 7 aa, Artificial Sequence
  Synthetic
VGSLFRN

SEQ ID NO: 19025 - protein, 7 aa, Artificial Sequence
  Synthetic
LVAHPNR

SEQ ID NO: 19026 - protein, 7 aa, Artificial Sequence
  Synthetic
DSHKGNK

SEQ ID NO: 19027 - protein, 7 aa, Artificial Sequence
  Synthetic
RDPGRHG

SEQ ID NO: 19028 - protein, 7 aa, Artificial Sequence
  Synthetic
WSSNEGR

SEQ ID NO: 19029 - protein, 7 aa, Artificial Sequence
  Synthetic
LRNISSF

SEQ ID NO: 19030 - protein, 7 aa, Artificial Sequence
  Synthetic
GSQLGLW

SEQ ID NO: 19031 - protein, 7 aa, Artificial Sequence
  Synthetic
WATRGSA

SEQ ID NO: 19032 - protein, 7 aa, Artificial Sequence
  Synthetic
VKATWSS

SEQ ID NO: 19033 - protein, 7 aa, Artificial Sequence
  Synthetic
LMTNGWA

SEQ ID NO: 19034 - protein, 7 aa, Artificial Sequence
  Synthetic
VGASRWD

SEQ ID NO: 19035 - protein, 7 aa, Artificial Sequence
  Synthetic
DHGPRHM

SEQ ID NO: 19036 - protein, 7 aa, Artificial Sequence
  Synthetic
ARVGSLY

SEQ ID NO: 19037 - protein, 7 aa, Artificial Sequence
  Synthetic
GVADASW

SEQ ID NO: 19038 - protein, 7 aa, Artificial Sequence
  Synthetic
VRFVGSH

SEQ ID NO: 19039 - protein, 7 aa, Artificial Sequence
  Synthetic
GYDRGAW

SEQ ID NO: 19040 - protein, 7 aa, Artificial Sequence
  Synthetic
TWAQGSS

SEQ ID NO: 19041 - protein, 7 aa, Artificial Sequence
  Synthetic
NRFNLNL

SEQ ID NO: 19042 - protein, 7 aa, Artificial Sequence
  Synthetic
RGLGFSA

SEQ ID NO: 19043 - protein, 7 aa, Artificial Sequence
  Synthetic
SSDYNRW

SEQ ID NO: 19044 - protein, 7 aa, Artificial Sequence
  Synthetic
EVWPRNP

SEQ ID NO: 19045 - protein, 7 aa, Artificial Sequence
  Synthetic
ATVYEHW

SEQ ID NO: 19046 - protein, 7 aa, Artificial Sequence
  Synthetic
MNYGAAQ

SEQ ID NO: 19047 - protein, 7 aa, Artificial Sequence
  Synthetic
HGTTGFW

SEQ ID NO: 19048 - protein, 7 aa, Artificial Sequence
  Synthetic
VPLYRYD

SEQ ID NO: 19049 - protein, 7 aa, Artificial Sequence
  Synthetic
RLYGYGD

SEQ ID NO: 19050 - protein, 7 aa, Artificial Sequence
  Synthetic
WEKFGSS

SEQ ID NO: 19051 - protein, 7 aa, Artificial Sequence
  Synthetic
PGDRSWL

SEQ ID NO: 19052 - protein, 7 aa, Artificial Sequence
  Synthetic
EKSFSHW

SEQ ID NO: 19053 - protein, 7 aa, Artificial Sequence
  Synthetic
EVIHRTW

SEQ ID NO: 19054 - protein, 7 aa, Artificial Sequence
  Synthetic
LERGFAQ

SEQ ID NO: 19055 - protein, 7 aa, Artificial Sequence
  Synthetic
WIMGGSA

SEQ ID NO: 19056 - protein, 7 aa, Artificial Sequence
  Synthetic
PIAYHAA

SEQ ID NO: 19057 - protein, 7 aa, Artificial Sequence
  Synthetic
RVTTQTY

SEQ ID NO: 19058 - protein, 7 aa, Artificial Sequence
  Synthetic
HERERPR

SEQ ID NO: 19059 - protein, 7 aa, Artificial Sequence
  Synthetic
GAFRDFT

SEQ ID NO: 19060 - protein, 7 aa, Artificial Sequence
  Synthetic
PVGLLPY

SEQ ID NO: 19061 - protein, 7 aa, Artificial Sequence
  Synthetic
RNFKPDG

SEQ ID NO: 19062 - protein, 7 aa, Artificial Sequence
  Synthetic
DAYETRW

SEQ ID NO: 19063 - protein, 7 aa, Artificial Sequence
  Synthetic
RWVSESA

SEQ ID NO: 19064 - protein, 7 aa, Artificial Sequence
  Synthetic
RFTGDPS

SEQ ID NO: 19065 - protein, 7 aa, Artificial Sequence
  Synthetic
RLESSYW

SEQ ID NO: 19066 - protein, 7 aa, Artificial Sequence
  Synthetic
QPGSYGW

SEQ ID NO: 19067 - protein, 7 aa, Artificial Sequence
  Synthetic
RELSMRN

SEQ ID NO: 19068 - protein, 7 aa, Artificial Sequence
  Synthetic
FKEQWPR

SEQ ID NO: 19069 - protein, 7 aa, Artificial Sequence
  Synthetic
HDWQQRA

SEQ ID NO: 19070 - protein, 7 aa, Artificial Sequence
  Synthetic
RHPGYSV

SEQ ID NO: 19071 - protein, 7 aa, Artificial Sequence
  Synthetic
RHGKTEC

SEQ ID NO: 19072 - protein, 7 aa, Artificial Sequence
  Synthetic
MGMGLGR

SEQ ID NO: 19073 - protein, 7 aa, Artificial Sequence
  Synthetic
VNQPNHR

SEQ ID NO: 19074 - protein, 7 aa, Artificial Sequence
  Synthetic
GMRSSHQ

SEQ ID NO: 19075 - protein, 7 aa, Artificial Sequence
  Synthetic
NKLRALG

SEQ ID NO: 19076 - protein, 7 aa, Artificial Sequence
  Synthetic
VHANWAH

SEQ ID NO: 19077 - protein, 7 aa, Artificial Sequence
  Synthetic
FVSLPYT

SEQ ID NO: 19078 - protein, 7 aa, Artificial Sequence
  Synthetic
VDARIFH

SEQ ID NO: 19079 - protein, 7 aa, Artificial Sequence
  Synthetic
ILGGYHS

SEQ ID NO: 19080 - protein, 7 aa, Artificial Sequence
  Synthetic
SSYFGSA

SEQ ID NO: 19081 - protein, 7 aa, Artificial Sequence
  Synthetic
EREWAIS

SEQ ID NO: 19082 - protein, 7 aa, Artificial Sequence
  Synthetic
FREYPHY

SEQ ID NO: 19083 - protein, 7 aa, Artificial Sequence
  Synthetic
IRAGYAM

SEQ ID NO: 19084 - protein, 7 aa, Artificial Sequence
  Synthetic
RFTNDSS

SEQ ID NO: 19085 - protein, 7 aa, Artificial Sequence
  Synthetic
LLRLGST

SEQ ID NO: 19086 - protein, 7 aa, Artificial Sequence
  Synthetic
EWTRGSA

SEQ ID NO: 19087 - protein, 7 aa, Artificial Sequence
  Synthetic
HGPVGIR

SEQ ID NO: 19088 - protein, 7 aa, Artificial Sequence
  Synthetic
KHSPATS

SEQ ID NO: 19089 - protein, 7 aa, Artificial Sequence
  Synthetic
SNRAPER

SEQ ID NO: 19090 - protein, 7 aa, Artificial Sequence
  Synthetic
RERVARE

SEQ ID NO: 19091 - protein, 7 aa, Artificial Sequence
  Synthetic
ENLPWSY

SEQ ID NO: 19092 - protein, 7 aa, Artificial Sequence
  Synthetic
ERTRGSS

SEQ ID NO: 19093 - protein, 7 aa, Artificial Sequence
  Synthetic
MMQISAR

SEQ ID NO: 19094 - protein, 7 aa, Artificial Sequence
  Synthetic
GGDRGHW

SEQ ID NO: 19095 - protein, 7 aa, Artificial Sequence
  Synthetic
PVNKNGW

SEQ ID NO: 19096 - protein, 7 aa, Artificial Sequence
  Synthetic
RLASHGP

SEQ ID NO: 19097 - protein, 7 aa, Artificial Sequence
  Synthetic
LIEGWST

SEQ ID NO: 19098 - protein, 7 aa, Artificial Sequence
  Synthetic
GGWGGSS

SEQ ID NO: 19099 - protein, 7 aa, Artificial Sequence
  Synthetic
PLGSGFR

SEQ ID NO: 19100 - protein, 7 aa, Artificial Sequence
  Synthetic
THSGHLW

SEQ ID NO: 19101 - protein, 7 aa, Artificial Sequence
  Synthetic
HKIPVER

SEQ ID NO: 19102 - protein, 7 aa, Artificial Sequence
  Synthetic
GGHQGLW

SEQ ID NO: 19103 - protein, 7 aa, Artificial Sequence
  Synthetic
RAVGMDW

SEQ ID NO: 19104 - protein, 7 aa, Artificial Sequence
  Synthetic
MMGILGR

SEQ ID NO: 19105 - protein, 7 aa, Artificial Sequence
  Synthetic
TRLGGAQ

SEQ ID NO: 19106 - protein, 7 aa, Artificial Sequence
  Synthetic
RQMPENK

SEQ ID NO: 19107 - protein, 7 aa, Artificial Sequence
  Synthetic
VWREGRP

SEQ ID NO: 19108 - protein, 7 aa, Artificial Sequence
  Synthetic
ERPIPTR

SEQ ID NO: 19109 - protein, 7 aa, Artificial Sequence
  Synthetic
EYFAGSS

SEQ ID NO: 19110 - protein, 7 aa, Artificial Sequence
  Synthetic
IIPGYSI

SEQ ID NO: 19111 - protein, 7 aa, Artificial Sequence
  Synthetic
MNLGFSS

SEQ ID NO: 19112 - protein, 7 aa, Artificial Sequence
  Synthetic
AARTNGW

SEQ ID NO: 19113 - protein, 7 aa, Artificial Sequence
  Synthetic
DHTTNYW

SEQ ID NO: 19114 - protein, 7 aa, Artificial Sequence
  Synthetic
GEPVRWA

SEQ ID NO: 19115 - protein, 7 aa, Artificial Sequence
  Synthetic
VKTPGVW

SEQ ID NO: 19116 - protein, 7 aa, Artificial Sequence
  Synthetic
RVVMGYA

SEQ ID NO: 19117 - protein, 7 aa, Artificial Sequence
  Synthetic
SHVTDYR

SEQ ID NO: 19118 - protein, 7 aa, Artificial Sequence
  Synthetic
HNRASQN

SEQ ID NO: 19119 - protein, 7 aa, Artificial Sequence
  Synthetic
LEVHQIW

SEQ ID NO: 19120 - protein, 7 aa, Artificial Sequence
  Synthetic
LSGYTFG

SEQ ID NO: 19121 - protein, 7 aa, Artificial Sequence
  Synthetic
SFPGWAQ

SEQ ID NO: 19122 - protein, 7 aa, Artificial Sequence
  Synthetic
WGSLMSY

SEQ ID NO: 19123 - protein, 7 aa, Artificial Sequence
  Synthetic
NHVGMRL

SEQ ID NO: 19124 - protein, 7 aa, Artificial Sequence
  Synthetic
MPYHVPN

SEQ ID NO: 19125 - protein, 7 aa, Artificial Sequence
  Synthetic
WALLGAS

SEQ ID NO: 19126 - protein, 7 aa, Artificial Sequence
  Synthetic
FLARAER

SEQ ID NO: 19127 - protein, 7 aa, Artificial Sequence
  Synthetic
LYYAGMT

SEQ ID NO: 19128 - protein, 7 aa, Artificial Sequence
  Synthetic
SRQIHPP

SEQ ID NO: 19129 - protein, 7 aa, Artificial Sequence
  Synthetic
VERNTWS

SEQ ID NO: 19130 - protein, 7 aa, Artificial Sequence
  Synthetic
WTRWNVE

SEQ ID NO: 19131 - protein, 7 aa, Artificial Sequence
  Synthetic
HSFHLDL

SEQ ID NO: 19132 - protein, 7 aa, Artificial Sequence
  Synthetic
SKWGLYE

SEQ ID NO: 19133 - protein, 7 aa, Artificial Sequence
  Synthetic
RPNGWHE

SEQ ID NO: 19134 - protein, 7 aa, Artificial Sequence
  Synthetic
CFVYGSA

SEQ ID NO: 19135 - protein, 7 aa, Artificial Sequence
  Synthetic
TADLGRW

SEQ ID NO: 19136 - protein, 7 aa, Artificial Sequence
  Synthetic
YWGGFGD

SEQ ID NO: 19137 - protein, 7 aa, Artificial Sequence
  Synthetic
NKWELPV

SEQ ID NO: 19138 - protein, 7 aa, Artificial Sequence
  Synthetic
HSHGGLS

SEQ ID NO: 19139 - protein, 7 aa, Artificial Sequence
  Synthetic
GHSPGLW

SEQ ID NO: 19140 - protein, 7 aa, Artificial Sequence
  Synthetic
GLLRLVN

SEQ ID NO: 19141 - protein, 7 aa, Artificial Sequence
  Synthetic
EEFRGSA

SEQ ID NO: 19142 - protein, 7 aa, Artificial Sequence
  Synthetic
QGDTGRW

SEQ ID NO: 19143 - protein, 7 aa, Artificial Sequence
  Synthetic
RWSVDAA

SEQ ID NO: 19144 - protein, 7 aa, Artificial Sequence
  Synthetic
RGGLREP

SEQ ID NO: 19145 - protein, 7 aa, Artificial Sequence
  Synthetic
NLNNPAR

SEQ ID NO: 19146 - protein, 7 aa, Artificial Sequence
  Synthetic
QHVSDFR

SEQ ID NO: 19147 - protein, 7 aa, Artificial Sequence
  Synthetic
RFLNDAA

SEQ ID NO: 19148 - protein, 7 aa, Artificial Sequence
  Synthetic
DPNFARW

SEQ ID NO: 19149 - protein, 7 aa, Artificial Sequence
  Synthetic
FTGPPRS

SEQ ID NO: 19150 - protein, 7 aa, Artificial Sequence
  Synthetic
ERLMGAS

SEQ ID NO: 19151 - protein, 7 aa, Artificial Sequence
  Synthetic
LTHSGVW

SEQ ID NO: 19152 - protein, 7 aa, Artificial Sequence
  Synthetic
MRTAGHG

SEQ ID NO: 19153 - protein, 7 aa, Artificial Sequence
  Synthetic
RHIGNLG

SEQ ID NO: 19154 - protein, 7 aa, Artificial Sequence
  Synthetic
SILRGST

SEQ ID NO: 19155 - protein, 7 aa, Artificial Sequence
  Synthetic
AWSLGSS

SEQ ID NO: 19156 - protein, 7 aa, Artificial Sequence
  Synthetic
ERQFGAA

SEQ ID NO: 19157 - protein, 7 aa, Artificial Sequence
  Synthetic
LAVGWSS

SEQ ID NO: 19158 - protein, 7 aa, Artificial Sequence
  Synthetic
DVANGRW

SEQ ID NO: 19159 - protein, 7 aa, Artificial Sequence
  Synthetic
ETGAARW

SEQ ID NO: 19160 - protein, 7 aa, Artificial Sequence
  Synthetic
ARTSAER

SEQ ID NO: 19161 - protein, 7 aa, Artificial Sequence
  Synthetic
IGTRHVC

SEQ ID NO: 19162 - protein, 7 aa, Artificial Sequence
  Synthetic
HDEGHKR

SEQ ID NO: 19163 - protein, 7 aa, Artificial Sequence
  Synthetic
GHANWSA

SEQ ID NO: 19164 - protein, 7 aa, Artificial Sequence
  Synthetic
GTNYSGW

SEQ ID NO: 19165 - protein, 7 aa, Artificial Sequence
  Synthetic
GQKSSSM

SEQ ID NO: 19166 - protein, 7 aa, Artificial Sequence
  Synthetic
MRHVVVP

SEQ ID NO: 19167 - protein, 7 aa, Artificial Sequence
  Synthetic
HRSGFSQ

SEQ ID NO: 19168 - protein, 7 aa, Artificial Sequence
  Synthetic
RDTNAVR

SEQ ID NO: 19169 - protein, 7 aa, Artificial Sequence
  Synthetic
RWPGDAV

SEQ ID NO: 19170 - protein, 7 aa, Artificial Sequence
  Synthetic
RPLGHRD

SEQ ID NO: 19171 - protein, 7 aa, Artificial Sequence
  Synthetic
VPSEARW

SEQ ID NO: 19172 - protein, 7 aa, Artificial Sequence
  Synthetic
RPYDNVI

SEQ ID NO: 19173 - protein, 7 aa, Artificial Sequence
  Synthetic
GSLAHAR

SEQ ID NO: 19174 - protein, 7 aa, Artificial Sequence
  Synthetic
RRSIIDA

SEQ ID NO: 19175 - protein, 7 aa, Artificial Sequence
  Synthetic
HNPVWGS

SEQ ID NO: 19176 - protein, 7 aa, Artificial Sequence
  Synthetic
MPHRIMV

SEQ ID NO: 19177 - protein, 7 aa, Artificial Sequence
  Synthetic
IRSDVMR

SEQ ID NO: 19178 - protein, 7 aa, Artificial Sequence
  Synthetic
DNTSHRW

SEQ ID NO: 19179 - protein, 7 aa, Artificial Sequence
  Synthetic
ENDRRLW

SEQ ID NO: 19180 - protein, 7 aa, Artificial Sequence
  Synthetic
VYFAGSS

SEQ ID NO: 19181 - protein, 7 aa, Artificial Sequence
  Synthetic
QHAHWSA

SEQ ID NO: 19182 - protein, 7 aa, Artificial Sequence
  Synthetic
DRMGFSQ

SEQ ID NO: 19183 - protein, 7 aa, Artificial Sequence
  Synthetic
APNSGYW

SEQ ID NO: 19184 - protein, 7 aa, Artificial Sequence
  Synthetic
EPWTTYH

SEQ ID NO: 19185 - protein, 7 aa, Artificial Sequence
  Synthetic
DQVVRWA

SEQ ID NO: 19186 - protein, 7 aa, Artificial Sequence
  Synthetic
YNSLWPQ

SEQ ID NO: 19187 - protein, 7 aa, Artificial Sequence
  Synthetic
WDIERGF

SEQ ID NO: 19188 - protein, 7 aa, Artificial Sequence
  Synthetic
THWGGAS

SEQ ID NO: 19189 - protein, 7 aa, Artificial Sequence
  Synthetic
QRNDIGR

SEQ ID NO: 19190 - protein, 7 aa, Artificial Sequence
  Synthetic
DYGSARY

SEQ ID NO: 19191 - protein, 7 aa, Artificial Sequence
  Synthetic
PRMAQHL

SEQ ID NO: 19192 - protein, 7 aa, Artificial Sequence
  Synthetic
SNDYARY

SEQ ID NO: 19193 - protein, 7 aa, Artificial Sequence
  Synthetic
MRDGKFP

SEQ ID NO: 19194 - protein, 7 aa, Artificial Sequence
  Synthetic
VVRLDQW

SEQ ID NO: 19195 - protein, 7 aa, Artificial Sequence
  Synthetic
YVSLPHS

SEQ ID NO: 19196 - protein, 7 aa, Artificial Sequence
  Synthetic
QFVGDAS

SEQ ID NO: 19197 - protein, 7 aa, Artificial Sequence
  Synthetic
DVWAGSV

SEQ ID NO: 19198 - protein, 7 aa, Artificial Sequence
  Synthetic
DAMPGRW

SEQ ID NO: 19199 - protein, 7 aa, Artificial Sequence
  Synthetic
AGVGWAS

SEQ ID NO: 19200 - protein, 7 aa, Artificial Sequence
  Synthetic
SWSGQPM

SEQ ID NO: 19201 - protein, 7 aa, Artificial Sequence
  Synthetic
CAVAQTW

SEQ ID NO: 19202 - protein, 7 aa, Artificial Sequence
  Synthetic
TVAYLAS

SEQ ID NO: 19203 - protein, 7 aa, Artificial Sequence
  Synthetic
LVGWHGL

SEQ ID NO: 19204 - protein, 7 aa, Artificial Sequence
  Synthetic
RMQLDGK

SEQ ID NO: 19205 - protein, 7 aa, Artificial Sequence
  Synthetic
SASWSSA

SEQ ID NO: 19206 - protein, 7 aa, Artificial Sequence
  Synthetic
IITSAWN

SEQ ID NO: 19207 - protein, 7 aa, Artificial Sequence
  Synthetic
WQGTGRP

SEQ ID NO: 19208 - protein, 7 aa, Artificial Sequence
  Synthetic
RGGMMAL

SEQ ID NO: 19209 - protein, 7 aa, Artificial Sequence
  Synthetic
IRDLTAR

SEQ ID NO: 19210 - protein, 7 aa, Artificial Sequence
  Synthetic
RNYEGWA

SEQ ID NO: 19211 - protein, 7 aa, Artificial Sequence
  Synthetic
AFLGLSS

SEQ ID NO: 19212 - protein, 7 aa, Artificial Sequence
  Synthetic
THIGGVR

SEQ ID NO: 19213 - protein, 7 aa, Artificial Sequence
  Synthetic
VPFDLSR

SEQ ID NO: 19214 - protein, 7 aa, Artificial Sequence
  Synthetic
AYVRDLN

SEQ ID NO: 19215 - protein, 7 aa, Artificial Sequence
  Synthetic
SHDGQYW

SEQ ID NO: 19216 - protein, 7 aa, Artificial Sequence
  Synthetic
PGHGFSV

SEQ ID NO: 19217 - protein, 7 aa, Artificial Sequence
  Synthetic
ELWQGFS

SEQ ID NO: 19218 - protein, 7 aa, Artificial Sequence
  Synthetic
TPPWGSS

SEQ ID NO: 19219 - protein, 7 aa, Artificial Sequence
  Synthetic
YTIPEYR

SEQ ID NO: 19220 - protein, 7 aa, Artificial Sequence
  Synthetic
WMARSAV

SEQ ID NO: 19221 - protein, 7 aa, Artificial Sequence
  Synthetic
WASKGTV

SEQ ID NO: 19222 - protein, 7 aa, Artificial Sequence
  Synthetic
AWDKGYG

SEQ ID NO: 19223 - protein, 7 aa, Artificial Sequence
  Synthetic
QGAMRWD

SEQ ID NO: 19224 - protein, 7 aa, Artificial Sequence
  Synthetic
EKHSGVW

SEQ ID NO: 19225 - protein, 7 aa, Artificial Sequence
  Synthetic
ARNGESK

SEQ ID NO: 19226 - protein, 7 aa, Artificial Sequence
  Synthetic
NASGLHR

SEQ ID NO: 19227 - protein, 7 aa, Artificial Sequence
  Synthetic
RAGGGHF

SEQ ID NO: 19228 - protein, 7 aa, Artificial Sequence
  Synthetic
RGGAAPH

SEQ ID NO: 19229 - protein, 7 aa, Artificial Sequence
  Synthetic
GAEKFQR

SEQ ID NO: 19230 - protein, 7 aa, Artificial Sequence
  Synthetic
SRVGMAQ

SEQ ID NO: 19231 - protein, 7 aa, Artificial Sequence
  Synthetic
VRPYGSA

SEQ ID NO: 19232 - protein, 7 aa, Artificial Sequence
  Synthetic
NVVGWSS

SEQ ID NO: 19233 - protein, 7 aa, Artificial Sequence
  Synthetic
AADYMRY

SEQ ID NO: 19234 - protein, 7 aa, Artificial Sequence
  Synthetic
THTHGST

SEQ ID NO: 19235 - protein, 7 aa, Artificial Sequence
  Synthetic
SVYLGST

SEQ ID NO: 19236 - protein, 7 aa, Artificial Sequence
  Synthetic
VLRGYSA

SEQ ID NO: 19237 - protein, 7 aa, Artificial Sequence
  Synthetic
QVPGYSA

SEQ ID NO: 19238 - protein, 7 aa, Artificial Sequence
  Synthetic
PFIGMAA

SEQ ID NO: 19239 - protein, 7 aa, Artificial Sequence
  Synthetic
WINMYGE

SEQ ID NO: 19240 - protein, 7 aa, Artificial Sequence
  Synthetic
WHSLSTS

SEQ ID NO: 19241 - protein, 7 aa, Artificial Sequence
  Synthetic
GVTRTLY

SEQ ID NO: 19242 - protein, 7 aa, Artificial Sequence
  Synthetic
GVVGERW

SEQ ID NO: 19243 - protein, 7 aa, Artificial Sequence
  Synthetic
WRSAGST

SEQ ID NO: 19244 - protein, 7 aa, Artificial Sequence
  Synthetic
VGLGRWE

SEQ ID NO: 19245 - protein, 7 aa, Artificial Sequence
  Synthetic
RQYSYTD

SEQ ID NO: 19246 - protein, 7 aa, Artificial Sequence
  Synthetic
TNQWSAS

SEQ ID NO: 19247 - protein, 7 aa, Artificial Sequence
  Synthetic
MWVPSSS

SEQ ID NO: 19248 - protein, 7 aa, Artificial Sequence
  Synthetic
AKLGMAQ

SEQ ID NO: 19249 - protein, 7 aa, Artificial Sequence
  Synthetic
VSRDQLR

SEQ ID NO: 19250 - protein, 7 aa, Artificial Sequence
  Synthetic
VMSYHTH

SEQ ID NO: 19251 - protein, 7 aa, Artificial Sequence
  Synthetic
RGVNLDK

SEQ ID NO: 19252 - protein, 7 aa, Artificial Sequence
  Synthetic
ALVGYSF

SEQ ID NO: 19253 - protein, 7 aa, Artificial Sequence
  Synthetic
HMGDNRW

SEQ ID NO: 19254 - protein, 7 aa, Artificial Sequence
  Synthetic
DGNPGHW

SEQ ID NO: 19255 - protein, 7 aa, Artificial Sequence
  Synthetic
TKSPGPW

SEQ ID NO: 19256 - protein, 7 aa, Artificial Sequence
  Synthetic
PWPGAAT

SEQ ID NO: 19257 - protein, 7 aa, Artificial Sequence
  Synthetic
VSIGWSS

SEQ ID NO: 19258 - protein, 7 aa, Artificial Sequence
  Synthetic
CVGLYGC

SEQ ID NO: 19259 - protein, 7 aa, Artificial Sequence
  Synthetic
FQPGGFW

SEQ ID NO: 19260 - protein, 7 aa, Artificial Sequence
  Synthetic
LVWGAVE

SEQ ID NO: 19261 - protein, 7 aa, Artificial Sequence
  Synthetic
WHTLAVK

SEQ ID NO: 19262 - protein, 7 aa, Artificial Sequence
  Synthetic
WEIERGY

SEQ ID NO: 19263 - protein, 7 aa, Artificial Sequence
  Synthetic
WASYGAA

SEQ ID NO: 19264 - protein, 7 aa, Artificial Sequence
  Synthetic
EVVRLHN

SEQ ID NO: 19265 - protein, 7 aa, Artificial Sequence
  Synthetic
VRPGDWS

SEQ ID NO: 19266 - protein, 7 aa, Artificial Sequence
  Synthetic
NSVHPIR

SEQ ID NO: 19267 - protein, 7 aa, Artificial Sequence
  Synthetic
RGGISHM

SEQ ID NO: 19268 - protein, 7 aa, Artificial Sequence
  Synthetic
WPRANSP

SEQ ID NO: 19269 - protein, 7 aa, Artificial Sequence
  Synthetic
VSHHYPK

SEQ ID NO: 19270 - protein, 7 aa, Artificial Sequence
  Synthetic
WNLVDGF

SEQ ID NO: 19271 - protein, 7 aa, Artificial Sequence
  Synthetic
SATKSMW

SEQ ID NO: 19272 - protein, 7 aa, Artificial Sequence
  Synthetic
PNVSNMW

SEQ ID NO: 19273 - protein, 7 aa, Artificial Sequence
  Synthetic
VNHGWAS

SEQ ID NO: 19274 - protein, 7 aa, Artificial Sequence
  Synthetic
STTTSYW

SEQ ID NO: 19275 - protein, 7 aa, Artificial Sequence
  Synthetic
VYHGFSQ

SEQ ID NO: 19276 - protein, 7 aa, Artificial Sequence
  Synthetic
KYAGMSS

SEQ ID NO: 19277 - protein, 7 aa, Artificial Sequence
  Synthetic
PEWGAAQ

SEQ ID NO: 19278 - protein, 7 aa, Artificial Sequence
  Synthetic
DGNMARW

SEQ ID NO: 19279 - protein, 7 aa, Artificial Sequence
  Synthetic
GDTNLEW

SEQ ID NO: 19280 - protein, 7 aa, Artificial Sequence
  Synthetic
RDYDLRH

SEQ ID NO: 19281 - protein, 7 aa, Artificial Sequence
  Synthetic
GIDLGRW

SEQ ID NO: 19282 - protein, 7 aa, Artificial Sequence
  Synthetic
DSNDGRW

SEQ ID NO: 19283 - protein, 7 aa, Artificial Sequence
  Synthetic
RIELLPY

SEQ ID NO: 19284 - protein, 7 aa, Artificial Sequence
  Synthetic
RYIPDAS

SEQ ID NO: 19285 - protein, 7 aa, Artificial Sequence
  Synthetic
VYFSGSA

SEQ ID NO: 19286 - protein, 7 aa, Artificial Sequence
  Synthetic
WGSLETL

SEQ ID NO: 19287 - protein, 7 aa, Artificial Sequence
  Synthetic
WGALERH

SEQ ID NO: 19288 - protein, 7 aa, Artificial Sequence
  Synthetic
VWHSGSS

SEQ ID NO: 19289 - protein, 7 aa, Artificial Sequence
  Synthetic
WSSWTTA

SEQ ID NO: 19290 - protein, 7 aa, Artificial Sequence
  Synthetic
LLEGWAS

SEQ ID NO: 19291 - protein, 7 aa, Artificial Sequence
  Synthetic
QRVVLVS

SEQ ID NO: 19292 - protein, 7 aa, Artificial Sequence
  Synthetic
DARNWHT

SEQ ID NO: 19293 - protein, 7 aa, Artificial Sequence
  Synthetic
ASHGTLW

SEQ ID NO: 19294 - protein, 7 aa, Artificial Sequence
  Synthetic
KQYALPS

SEQ ID NO: 19295 - protein, 7 aa, Artificial Sequence
  Synthetic
RFPELSR

SEQ ID NO: 19296 - protein, 7 aa, Artificial Sequence
  Synthetic
RHMNTNA

SEQ ID NO: 19297 - protein, 7 aa, Artificial Sequence
  Synthetic
NNEHTYW

SEQ ID NO: 19298 - protein, 7 aa, Artificial Sequence
  Synthetic
EEWRGAT

SEQ ID NO: 19299 - protein, 7 aa, Artificial Sequence
  Synthetic
ESWGGSA

SEQ ID NO: 19300 - protein, 7 aa, Artificial Sequence
  Synthetic
SFVGDYR

SEQ ID NO: 19301 - protein, 7 aa, Artificial Sequence
  Synthetic
MYEGFSQ

SEQ ID NO: 19302 - protein, 7 aa, Artificial Sequence
  Synthetic
HKSLYGL

SEQ ID NO: 19303 - protein, 7 aa, Artificial Sequence
  Synthetic
SFAGYAS

SEQ ID NO: 19304 - protein, 7 aa, Artificial Sequence
  Synthetic
LRVPRPD

SEQ ID NO: 19305 - protein, 7 aa, Artificial Sequence
  Synthetic
PPQSGVW

SEQ ID NO: 19306 - protein, 7 aa, Artificial Sequence
  Synthetic
KGPGAGW

SEQ ID NO: 19307 - protein, 7 aa, Artificial Sequence
  Synthetic
RIHSPGA

SEQ ID NO: 19308 - protein, 7 aa, Artificial Sequence
  Synthetic
HRPDIGR

SEQ ID NO: 19309 - protein, 7 aa, Artificial Sequence
  Synthetic
FIGDNRW

SEQ ID NO: 19310 - protein, 7 aa, Artificial Sequence
  Synthetic
NRFQGST

SEQ ID NO: 19311 - protein, 7 aa, Artificial Sequence
  Synthetic
GALLHVR

SEQ ID NO: 19312 - protein, 7 aa, Artificial Sequence
  Synthetic
LYPGHSM

SEQ ID NO: 19313 - protein, 7 aa, Artificial Sequence
  Synthetic
INQGWST

SEQ ID NO: 19314 - protein, 7 aa, Artificial Sequence
  Synthetic
SLDYAGW

SEQ ID NO: 19315 - protein, 7 aa, Artificial Sequence
  Synthetic
MGVGFSS

SEQ ID NO: 19316 - protein, 7 aa, Artificial Sequence
  Synthetic
KGEHLVR

SEQ ID NO: 19317 - protein, 7 aa, Artificial Sequence
  Synthetic
SYVPQSA

SEQ ID NO: 19318 - protein, 7 aa, Artificial Sequence
  Synthetic
WATGGSS

SEQ ID NO: 19319 - protein, 7 aa, Artificial Sequence
  Synthetic
PVWGQVG

SEQ ID NO: 19320 - protein, 7 aa, Artificial Sequence
  Synthetic
RSAASAH

SEQ ID NO: 19321 - protein, 7 aa, Artificial Sequence
  Synthetic
QNEYARY

SEQ ID NO: 19322 - protein, 7 aa, Artificial Sequence
  Synthetic
WSVSGYG

SEQ ID NO: 19323 - protein, 7 aa, Artificial Sequence
  Synthetic
NGHRERV

SEQ ID NO: 19324 - protein, 7 aa, Artificial Sequence
  Synthetic
RTVDHMR

SEQ ID NO: 19325 - protein, 7 aa, Artificial Sequence
  Synthetic
WKALPGV

SEQ ID NO: 19326 - protein, 7 aa, Artificial Sequence
  Synthetic
WDLRGGF

SEQ ID NO: 19327 - protein, 7 aa, Artificial Sequence
  Synthetic
FATGFSS

SEQ ID NO: 19328 - protein, 7 aa, Artificial Sequence
  Synthetic
RLVDHGK

SEQ ID NO: 19329 - protein, 7 aa, Artificial Sequence
  Synthetic
RWAGGAP

SEQ ID NO: 19330 - protein, 7 aa, Artificial Sequence
  Synthetic
ARVDMRF

SEQ ID NO: 19331 - protein, 7 aa, Artificial Sequence
  Synthetic
LRAGTIY

SEQ ID NO: 19332 - protein, 7 aa, Artificial Sequence
  Synthetic
MARYGAQ

SEQ ID NO: 19333 - protein, 7 aa, Artificial Sequence
  Synthetic
GNHGKGY

SEQ ID NO: 19334 - protein, 7 aa, Artificial Sequence
  Synthetic
EWAKIGR

SEQ ID NO: 19335 - protein, 7 aa, Artificial Sequence
  Synthetic
DTLTNRW

SEQ ID NO: 19336 - protein, 7 aa, Artificial Sequence
  Synthetic
WGMLPEK

SEQ ID NO: 19337 - protein, 7 aa, Artificial Sequence
  Synthetic
VAYSPRG

SEQ ID NO: 19338 - protein, 7 aa, Artificial Sequence
  Synthetic
TGPASHW

SEQ ID NO: 19339 - protein, 7 aa, Artificial Sequence
  Synthetic
SVVMSGW

SEQ ID NO: 19340 - protein, 7 aa, Artificial Sequence
  Synthetic
FRAAQQG

SEQ ID NO: 19341 - protein, 7 aa, Artificial Sequence
  Synthetic
TGDRPMR

SEQ ID NO: 19342 - protein, 7 aa, Artificial Sequence
  Synthetic
DAGVARW

SEQ ID NO: 19343 - protein, 7 aa, Artificial Sequence
  Synthetic
ARYMGSV

SEQ ID NO: 19344 - protein, 7 aa, Artificial Sequence
  Synthetic
GSDVGRW

SEQ ID NO: 19345 - protein, 7 aa, Artificial Sequence
  Synthetic
LLLRESL

SEQ ID NO: 19346 - protein, 7 aa, Artificial Sequence
  Synthetic
HSGMQTR

SEQ ID NO: 19347 - protein, 7 aa, Artificial Sequence
  Synthetic
IARLGYA

SEQ ID NO: 19348 - protein, 7 aa, Artificial Sequence
  Synthetic
ARPYDHA

SEQ ID NO: 19349 - protein, 7 aa, Artificial Sequence
  Synthetic
PSEYSGW

SEQ ID NO: 19350 - protein, 7 aa, Artificial Sequence
  Synthetic
GDFVGAW

SEQ ID NO: 19351 - protein, 7 aa, Artificial Sequence
  Synthetic
TPMHTGR

SEQ ID NO: 19352 - protein, 7 aa, Artificial Sequence
  Synthetic
WVARGAA

SEQ ID NO: 19353 - protein, 7 aa, Artificial Sequence
  Synthetic
HPTFGYA

SEQ ID NO: 19354 - protein, 7 aa, Artificial Sequence
  Synthetic
VPYGYGS

SEQ ID NO: 19355 - protein, 7 aa, Artificial Sequence
  Synthetic
TMWGGST

SEQ ID NO: 19356 - protein, 7 aa, Artificial Sequence
  Synthetic
REFAGSW

SEQ ID NO: 19357 - protein, 7 aa, Artificial Sequence
  Synthetic
EHWGAAS

SEQ ID NO: 19358 - protein, 7 aa, Artificial Sequence
  Synthetic
NIWGEVV

SEQ ID NO: 19359 - protein, 7 aa, Artificial Sequence
  Synthetic
DGEYMRW

SEQ ID NO: 19360 - protein, 7 aa, Artificial Sequence
  Synthetic
DVLYGSS

SEQ ID NO: 19361 - protein, 7 aa, Artificial Sequence
  Synthetic
EVMGGRW

SEQ ID NO: 19362 - protein, 7 aa, Artificial Sequence
  Synthetic
MPVHAAR

SEQ ID NO: 19363 - protein, 7 aa, Artificial Sequence
  Synthetic
VPNRSGW

SEQ ID NO: 19364 - protein, 7 aa, Artificial Sequence
  Synthetic
TEKWAYS

SEQ ID NO: 19365 - protein, 7 aa, Artificial Sequence
  Synthetic
GNRPPDR

SEQ ID NO: 19366 - protein, 7 aa, Artificial Sequence
  Synthetic
PVIASHW

SEQ ID NO: 19367 - protein, 7 aa, Artificial Sequence
  Synthetic
RSQFNDW

SEQ ID NO: 19368 - protein, 7 aa, Artificial Sequence
  Synthetic
IDTSVWN

SEQ ID NO: 19369 - protein, 7 aa, Artificial Sequence
  Synthetic
GGLVRWD

SEQ ID NO: 19370 - protein, 7 aa, Artificial Sequence
  Synthetic
GIWQGST

SEQ ID NO: 19371 - protein, 7 aa, Artificial Sequence
  Synthetic
MQGPVRM

SEQ ID NO: 19372 - protein, 7 aa, Artificial Sequence
  Synthetic
LKVGSVY

SEQ ID NO: 19373 - protein, 7 aa, Artificial Sequence
  Synthetic
DSRWVAH

SEQ ID NO: 19374 - protein, 7 aa, Artificial Sequence
  Synthetic
LVSQGFR

SEQ ID NO: 19375 - protein, 7 aa, Artificial Sequence
  Synthetic
RAERHGG

SEQ ID NO: 19376 - protein, 7 aa, Artificial Sequence
  Synthetic
YSMRTER

SEQ ID NO: 19377 - protein, 7 aa, Artificial Sequence
  Synthetic
MEQQRWA

SEQ ID NO: 19378 - protein, 7 aa, Artificial Sequence
  Synthetic
RAGVLER

SEQ ID NO: 19379 - protein, 7 aa, Artificial Sequence
  Synthetic
INIHRPH

SEQ ID NO: 19380 - protein, 7 aa, Artificial Sequence
  Synthetic
RGDAALR

SEQ ID NO: 19381 - protein, 7 aa, Artificial Sequence
  Synthetic
MKPGWST

SEQ ID NO: 19382 - protein, 7 aa, Artificial Sequence
  Synthetic
CPAYSAA

SEQ ID NO: 19383 - protein, 7 aa, Artificial Sequence
  Synthetic
TMLGYAT

SEQ ID NO: 19384 - protein, 7 aa, Artificial Sequence
  Synthetic
YTVANGY

SEQ ID NO: 19385 - protein, 7 aa, Artificial Sequence
  Synthetic
FVYGAHL

SEQ ID NO: 19386 - protein, 7 aa, Artificial Sequence
  Synthetic
QLPSQYY

SEQ ID NO: 19387 - protein, 7 aa, Artificial Sequence
  Synthetic
IPRRIDT

SEQ ID NO: 19388 - protein, 7 aa, Artificial Sequence
  Synthetic
LWSLGEP

SEQ ID NO: 19389 - protein, 7 aa, Artificial Sequence
  Synthetic
GADVGPW

SEQ ID NO: 19390 - protein, 7 aa, Artificial Sequence
  Synthetic
KREGRDF

SEQ ID NO: 19391 - protein, 7 aa, Artificial Sequence
  Synthetic
DRKLVQL

SEQ ID NO: 19392 - protein, 7 aa, Artificial Sequence
  Synthetic
RPLQNDR

SEQ ID NO: 19393 - protein, 7 aa, Artificial Sequence
  Synthetic
SSREALR

SEQ ID NO: 19394 - protein, 7 aa, Artificial Sequence
  Synthetic
WVTHGSV

SEQ ID NO: 19395 - protein, 7 aa, Artificial Sequence
  Synthetic
TLISGYR

SEQ ID NO: 19396 - protein, 7 aa, Artificial Sequence
  Synthetic
LRDLGSR

SEQ ID NO: 19397 - protein, 7 aa, Artificial Sequence
  Synthetic
ARHGFSS

SEQ ID NO: 19398 - protein, 7 aa, Artificial Sequence
  Synthetic
SHIGHSW

SEQ ID NO: 19399 - protein, 7 aa, Artificial Sequence
  Synthetic
RSIVESW

SEQ ID NO: 19400 - protein, 7 aa, Artificial Sequence
  Synthetic
GVHVGHW

SEQ ID NO: 19401 - protein, 7 aa, Artificial Sequence
  Synthetic
SYRQGAA

SEQ ID NO: 19402 - protein, 7 aa, Artificial Sequence
  Synthetic
QTYLGYA

SEQ ID NO: 19403 - protein, 7 aa, Artificial Sequence
  Synthetic
EDWHRSS

SEQ ID NO: 19404 - protein, 7 aa, Artificial Sequence
  Synthetic
FASYGSQ

SEQ ID NO: 19405 - protein, 7 aa, Artificial Sequence
  Synthetic
SYYTGSS

SEQ ID NO: 19406 - protein, 7 aa, Artificial Sequence
  Synthetic
LYPAGSS

SEQ ID NO: 19407 - protein, 7 aa, Artificial Sequence
  Synthetic
PVNDARW

SEQ ID NO: 19408 - protein, 7 aa, Artificial Sequence
  Synthetic
PMNSGLW

SEQ ID NO: 19409 - protein, 7 aa, Artificial Sequence
  Synthetic
GGSVGPW

SEQ ID NO: 19410 - protein, 7 aa, Artificial Sequence
  Synthetic
VVESQYY

SEQ ID NO: 19411 - protein, 7 aa, Artificial Sequence
  Synthetic
FAQGFST

SEQ ID NO: 19412 - protein, 7 aa, Artificial Sequence
  Synthetic
KTSAEFW

SEQ ID NO: 19413 - protein, 7 aa, Artificial Sequence
  Synthetic
LATGYAQ

SEQ ID NO: 19414 - protein, 7 aa, Artificial Sequence
  Synthetic
HNQLQSR

SEQ ID NO: 19415 - protein, 7 aa, Artificial Sequence
  Synthetic
AVTHGSA

SEQ ID NO: 19416 - protein, 7 aa, Artificial Sequence
  Synthetic
REWQSER

SEQ ID NO: 19417 - protein, 7 aa, Artificial Sequence
  Synthetic
DGIVVRW

SEQ ID NO: 19418 - protein, 7 aa, Artificial Sequence
  Synthetic
RQHADSK

SEQ ID NO: 19419 - protein, 7 aa, Artificial Sequence
  Synthetic
VAHGWAS

SEQ ID NO: 19420 - protein, 7 aa, Artificial Sequence
  Synthetic
DITYKGW

SEQ ID NO: 19421 - protein, 7 aa, Artificial Sequence
  Synthetic
FPTHKGA

SEQ ID NO: 19422 - protein, 7 aa, Artificial Sequence
  Synthetic
ALIHGGW

SEQ ID NO: 19423 - protein, 7 aa, Artificial Sequence
  Synthetic
EKYQGST

SEQ ID NO: 19424 - protein, 7 aa, Artificial Sequence
  Synthetic
FPSDNRW

SEQ ID NO: 19425 - protein, 7 aa, Artificial Sequence
  Synthetic
KHSLSAV

SEQ ID NO: 19426 - protein, 7 aa, Artificial Sequence
  Synthetic
RGGLHSC

SEQ ID NO: 19427 - protein, 7 aa, Artificial Sequence
  Synthetic
AMAGWSA

SEQ ID NO: 19428 - protein, 7 aa, Artificial Sequence
  Synthetic
EVAYGSS

SEQ ID NO: 19429 - protein, 7 aa, Artificial Sequence
  Synthetic
VYRGGAQ

SEQ ID NO: 19430 - protein, 7 aa, Artificial Sequence
  Synthetic
HSVGSIY

SEQ ID NO: 19431 - protein, 7 aa, Artificial Sequence
  Synthetic
NDGSSRW

SEQ ID NO: 19432 - protein, 7 aa, Artificial Sequence
  Synthetic
YEWRGAA

SEQ ID NO: 19433 - protein, 7 aa, Artificial Sequence
  Synthetic
GHAAGAW

SEQ ID NO: 19434 - protein, 7 aa, Artificial Sequence
  Synthetic
KTVGQSW

SEQ ID NO: 19435 - protein, 7 aa, Artificial Sequence
  Synthetic
RASPSHH

SEQ ID NO: 19436 - protein, 7 aa, Artificial Sequence
  Synthetic
PNRPEGR

SEQ ID NO: 19437 - protein, 7 aa, Artificial Sequence
  Synthetic
NGRLGQH

SEQ ID NO: 19438 - protein, 7 aa, Artificial Sequence
  Synthetic
LRETAMR

SEQ ID NO: 19439 - protein, 7 aa, Artificial Sequence
  Synthetic
RPNGRDY

SEQ ID NO: 19440 - protein, 7 aa, Artificial Sequence
  Synthetic
CYPQQMC

SEQ ID NO: 19441 - protein, 7 aa, Artificial Sequence
  Synthetic
SAASFNG

SEQ ID NO: 19442 - protein, 7 aa, Artificial Sequence
  Synthetic
MDLMPTG

SEQ ID NO: 19443 - protein, 7 aa, Artificial Sequence
  Synthetic
LRPIPQH

SEQ ID NO: 19444 - protein, 7 aa, Artificial Sequence
  Synthetic
EHVMGFR

SEQ ID NO: 19445 - protein, 7 aa, Artificial Sequence
  Synthetic
VYHSIAL

SEQ ID NO: 19446 - protein, 7 aa, Artificial Sequence
  Synthetic
DVLNMRF

SEQ ID NO: 19447 - protein, 7 aa, Artificial Sequence
  Synthetic
TFRGSAS

SEQ ID NO: 19448 - protein, 7 aa, Artificial Sequence
  Synthetic
ENKGWSS

SEQ ID NO: 19449 - protein, 7 aa, Artificial Sequence
  Synthetic
VNEYAYF

SEQ ID NO: 19450 - protein, 7 aa, Artificial Sequence
  Synthetic
DNWKLPI

SEQ ID NO: 19451 - protein, 7 aa, Artificial Sequence
  Synthetic
AYVAHSS

SEQ ID NO: 19452 - protein, 7 aa, Artificial Sequence
  Synthetic
GGYEGVW

SEQ ID NO: 19453 - protein, 7 aa, Artificial Sequence
  Synthetic
LNYGGSQ

SEQ ID NO: 19454 - protein, 7 aa, Artificial Sequence
  Synthetic
LTHGAAQ

SEQ ID NO: 19455 - protein, 7 aa, Artificial Sequence
  Synthetic
EWIGSAS

SEQ ID NO: 19456 - protein, 7 aa, Artificial Sequence
  Synthetic
WHLERGY

SEQ ID NO: 19457 - protein, 7 aa, Artificial Sequence
  Synthetic
HLGPGSK

SEQ ID NO: 19458 - protein, 7 aa, Artificial Sequence
  Synthetic
LRTGYSS

SEQ ID NO: 19459 - protein, 7 aa, Artificial Sequence
  Synthetic
MRGNVVI

SEQ ID NO: 19460 - protein, 7 aa, Artificial Sequence
  Synthetic
LHLGFST

SEQ ID NO: 19461 - protein, 7 aa, Artificial Sequence
  Synthetic
HKLLEVR

SEQ ID NO: 19462 - protein, 7 aa, Artificial Sequence
  Synthetic
LRIGYAA

SEQ ID NO: 19463 - protein, 7 aa, Artificial Sequence
  Synthetic
AGGRPLL

SEQ ID NO: 19464 - protein, 7 aa, Artificial Sequence
  Synthetic
RATSSMH

SEQ ID NO: 19465 - protein, 7 aa, Artificial Sequence
  Synthetic
RLSAHPH

SEQ ID NO: 19466 - protein, 7 aa, Artificial Sequence
  Synthetic
RNEVLSR

SEQ ID NO: 19467 - protein, 7 aa, Artificial Sequence
  Synthetic
ERVLATR

SEQ ID NO: 19468 - protein, 7 aa, Artificial Sequence
  Synthetic
MRNGSER

SEQ ID NO: 19469 - protein, 7 aa, Artificial Sequence
  Synthetic
HMAVNHK

SEQ ID NO: 19470 - protein, 7 aa, Artificial Sequence
  Synthetic
RQLEAQK

SEQ ID NO: 19471 - protein, 7 aa, Artificial Sequence
  Synthetic
WTTLGSS

SEQ ID NO: 19472 - protein, 7 aa, Artificial Sequence
  Synthetic
WSVSAGH

SEQ ID NO: 19473 - protein, 7 aa, Artificial Sequence
  Synthetic
GTDLARW

SEQ ID NO: 19474 - protein, 7 aa, Artificial Sequence
  Synthetic
RGENMWK

SEQ ID NO: 19475 - protein, 7 aa, Artificial Sequence
  Synthetic
RFLSDHA

SEQ ID NO: 19476 - protein, 7 aa, Artificial Sequence
  Synthetic
RDWGAAQ

SEQ ID NO: 19477 - protein, 7 aa, Artificial Sequence
  Synthetic
MVSGWAQ

SEQ ID NO: 19478 - protein, 7 aa, Artificial Sequence
  Synthetic
EYLGGSS

SEQ ID NO: 19479 - protein, 7 aa, Artificial Sequence
  Synthetic
ATIGWSS

SEQ ID NO: 19480 - protein, 7 aa, Artificial Sequence
  Synthetic
GRIVLQM

SEQ ID NO: 19481 - protein, 7 aa, Artificial Sequence
  Synthetic
GAANFSW

SEQ ID NO: 19482 - protein, 7 aa, Artificial Sequence
  Synthetic
YKSLPYV

SEQ ID NO: 19483 - protein, 7 aa, Artificial Sequence
  Synthetic
IRYEGST

SEQ ID NO: 19484 - protein, 7 aa, Artificial Sequence
  Synthetic
GLSEGRW

SEQ ID NO: 19485 - protein, 7 aa, Artificial Sequence
  Synthetic
WEVTSGF

SEQ ID NO: 19486 - protein, 7 aa, Artificial Sequence
  Synthetic
WAHMGSS

SEQ ID NO: 19487 - protein, 7 aa, Artificial Sequence
  Synthetic
AFPGSAA

SEQ ID NO: 19488 - protein, 7 aa, Artificial Sequence
  Synthetic
TKSITCT

SEQ ID NO: 19489 - protein, 7 aa, Artificial Sequence
  Synthetic
YPKSSER

SEQ ID NO: 19490 - protein, 7 aa, Artificial Sequence
  Synthetic
PNRPERA

SEQ ID NO: 19491 - protein, 7 aa, Artificial Sequence
  Synthetic
SSANPAR

SEQ ID NO: 19492 - protein, 7 aa, Artificial Sequence
  Synthetic
NKWTIRE

SEQ ID NO: 19493 - protein, 7 aa, Artificial Sequence
  Synthetic
SQAHYSS

SEQ ID NO: 19494 - protein, 7 aa, Artificial Sequence
  Synthetic
WAIAVGY

SEQ ID NO: 19495 - protein, 7 aa, Artificial Sequence
  Synthetic
KDVYAHW

SEQ ID NO: 19496 - protein, 7 aa, Artificial Sequence
  Synthetic
WGYRMSD

SEQ ID NO: 19497 - protein, 7 aa, Artificial Sequence
  Synthetic
SSHGFST

SEQ ID NO: 19498 - protein, 7 aa, Artificial Sequence
  Synthetic
NELRPGK

SEQ ID NO: 19499 - protein, 7 aa, Artificial Sequence
  Synthetic
MTRGYAG

SEQ ID NO: 19500 - protein, 7 aa, Artificial Sequence
  Synthetic
AREYSYS

SEQ ID NO: 19501 - protein, 7 aa, Artificial Sequence
  Synthetic
RMAVSNH

SEQ ID NO: 19502 - protein, 7 aa, Artificial Sequence
  Synthetic
LFERVGR

SEQ ID NO: 19503 - protein, 7 aa, Artificial Sequence
  Synthetic
WNQWGSA

SEQ ID NO: 19504 - protein, 7 aa, Artificial Sequence
  Synthetic
LQVGGAM

SEQ ID NO: 19505 - protein, 7 aa, Artificial Sequence
  Synthetic
EGWMGAQ

SEQ ID NO: 19506 - protein, 7 aa, Artificial Sequence
  Synthetic
VGDRPCR

SEQ ID NO: 19507 - protein, 7 aa, Artificial Sequence
  Synthetic
PVYAAYA

SEQ ID NO: 19508 - protein, 7 aa, Artificial Sequence
  Synthetic
VHPYSST

SEQ ID NO: 19509 - protein, 7 aa, Artificial Sequence
  Synthetic
ERRHADL

SEQ ID NO: 19510 - protein, 7 aa, Artificial Sequence
  Synthetic
GMHMGAW

SEQ ID NO: 19511 - protein, 7 aa, Artificial Sequence
  Synthetic
FKAGYAT

SEQ ID NO: 19512 - protein, 7 aa, Artificial Sequence
  Synthetic
EWHAGAS

SEQ ID NO: 19513 - protein, 7 aa, Artificial Sequence
  Synthetic
SIYERMF

SEQ ID NO: 19514 - protein, 7 aa, Artificial Sequence
  Synthetic
DRETRWA

SEQ ID NO: 19515 - protein, 7 aa, Artificial Sequence
  Synthetic
APQWSIG

SEQ ID NO: 19516 - protein, 7 aa, Artificial Sequence
  Synthetic
SVRLLAY

SEQ ID NO: 19517 - protein, 7 aa, Artificial Sequence
  Synthetic
PHLGYSA

SEQ ID NO: 19518 - protein, 7 aa, Artificial Sequence
  Synthetic
PWSNNIL

SEQ ID NO: 19519 - protein, 7 aa, Artificial Sequence
  Synthetic
LPHRTMF

SEQ ID NO: 19520 - protein, 7 aa, Artificial Sequence
  Synthetic
VHRNLGS

SEQ ID NO: 19521 - protein, 7 aa, Artificial Sequence
  Synthetic
GSQPSWN

SEQ ID NO: 19522 - protein, 7 aa, Artificial Sequence
  Synthetic
FVIGERL

SEQ ID NO: 19523 - protein, 7 aa, Artificial Sequence
  Synthetic
GERAQGR

SEQ ID NO: 19524 - protein, 7 aa, Artificial Sequence
  Synthetic
LIPRGSV

SEQ ID NO: 19525 - protein, 7 aa, Artificial Sequence
  Synthetic
WGTLAGM

SEQ ID NO: 19526 - protein, 7 aa, Artificial Sequence
  Synthetic
TTIGRGW

SEQ ID NO: 19527 - protein, 7 aa, Artificial Sequence
  Synthetic
RTGEKQW

SEQ ID NO: 19528 - protein, 7 aa, Artificial Sequence
  Synthetic
EPNWSSA

SEQ ID NO: 19529 - protein, 7 aa, Artificial Sequence
  Synthetic
LAYGGFH

SEQ ID NO: 19530 - protein, 7 aa, Artificial Sequence
  Synthetic
ERYAAYA

SEQ ID NO: 19531 - protein, 7 aa, Artificial Sequence
  Synthetic
HHLGPPR

SEQ ID NO: 19532 - protein, 7 aa, Artificial Sequence
  Synthetic
YVTLPRV

SEQ ID NO: 19533 - protein, 7 aa, Artificial Sequence
  Synthetic
AKFGYST

SEQ ID NO: 19534 - protein, 7 aa, Artificial Sequence
  Synthetic
ARYQEHW

SEQ ID NO: 19535 - protein, 7 aa, Artificial Sequence
  Synthetic
RYNGDAA

SEQ ID NO: 19536 - protein, 7 aa, Artificial Sequence
  Synthetic
TVRYEAS

SEQ ID NO: 19537 - protein, 7 aa, Artificial Sequence
  Synthetic
FGVLASL

SEQ ID NO: 19538 - protein, 7 aa, Artificial Sequence
  Synthetic
SVFLGSA

SEQ ID NO: 19539 - protein, 7 aa, Artificial Sequence
  Synthetic
MSTGGFW

SEQ ID NO: 19540 - protein, 7 aa, Artificial Sequence
  Synthetic
GFSLSGY

SEQ ID NO: 19541 - protein, 7 aa, Artificial Sequence
  Synthetic
WDLGGSR

SEQ ID NO: 19542 - protein, 7 aa, Artificial Sequence
  Synthetic
WAGMGSS

SEQ ID NO: 19543 - protein, 7 aa, Artificial Sequence
  Synthetic
TAEWKYG

SEQ ID NO: 19544 - protein, 7 aa, Artificial Sequence
  Synthetic
QAPMRYT

SEQ ID NO: 19545 - protein, 7 aa, Artificial Sequence
  Synthetic
LYISGSL

SEQ ID NO: 19546 - protein, 7 aa, Artificial Sequence
  Synthetic
RRDVSAA

SEQ ID NO: 19547 - protein, 7 aa, Artificial Sequence
  Synthetic
SWGALER

SEQ ID NO: 19548 - protein, 7 aa, Artificial Sequence
  Synthetic
PPVVLRD

SEQ ID NO: 19549 - protein, 7 aa, Artificial Sequence
  Synthetic
SDPEKRY

SEQ ID NO: 19550 - protein, 7 aa, Artificial Sequence
  Synthetic
DAGGSRW

SEQ ID NO: 19551 - protein, 7 aa, Artificial Sequence
  Synthetic
WGVARMG

SEQ ID NO: 19552 - protein, 7 aa, Artificial Sequence
  Synthetic
SRMGYSA

SEQ ID NO: 19553 - protein, 7 aa, Artificial Sequence
  Synthetic
PMNPHRA

SEQ ID NO: 19554 - protein, 7 aa, Artificial Sequence
  Synthetic
VQVRLIN

SEQ ID NO: 19555 - protein, 7 aa, Artificial Sequence
  Synthetic
EGHPGAW

SEQ ID NO: 19556 - protein, 7 aa, Artificial Sequence
  Synthetic
EIKWQSS

SEQ ID NO: 19557 - protein, 7 aa, Artificial Sequence
  Synthetic
TWHGSAA

SEQ ID NO: 19558 - protein, 7 aa, Artificial Sequence
  Synthetic
KFFGDHS

SEQ ID NO: 19559 - protein, 7 aa, Artificial Sequence
  Synthetic
AFSIRQV

SEQ ID NO: 19560 - protein, 7 aa, Artificial Sequence
  Synthetic
NRPGFSQ

SEQ ID NO: 19561 - protein, 7 aa, Artificial Sequence
  Synthetic
APIHNTW

SEQ ID NO: 19562 - protein, 7 aa, Artificial Sequence
  Synthetic
DWVRGST

SEQ ID NO: 19563 - protein, 7 aa, Artificial Sequence
  Synthetic
LIRNMSS

SEQ ID NO: 19564 - protein, 7 aa, Artificial Sequence
  Synthetic
EILAGFR

SEQ ID NO: 19565 - protein, 7 aa, Artificial Sequence
  Synthetic
YASWVEG

SEQ ID NO: 19566 - protein, 7 aa, Artificial Sequence
  Synthetic
EKAHLLR

SEQ ID NO: 19567 - protein, 7 aa, Artificial Sequence
  Synthetic
EVGSSRW

SEQ ID NO: 19568 - protein, 7 aa, Artificial Sequence
  Synthetic
VYIGLSS

SEQ ID NO: 19569 - protein, 7 aa, Artificial Sequence
  Synthetic
PYLPAVH

SEQ ID NO: 19570 - protein, 7 aa, Artificial Sequence
  Synthetic
LLAGMAQ

SEQ ID NO: 19571 - protein, 7 aa, Artificial Sequence
  Synthetic
WSPQSPR

SEQ ID NO: 19572 - protein, 7 aa, Artificial Sequence
  Synthetic
SAIGYST

SEQ ID NO: 19573 - protein, 7 aa, Artificial Sequence
  Synthetic
AGDPGRW

SEQ ID NO: 19574 - protein, 7 aa, Artificial Sequence
  Synthetic
QFYEGAR

SEQ ID NO: 19575 - protein, 7 aa, Artificial Sequence
  Synthetic
AQRDSLR

SEQ ID NO: 19576 - protein, 7 aa, Artificial Sequence
  Synthetic
RMPSGRD

SEQ ID NO: 19577 - protein, 7 aa, Artificial Sequence
  Synthetic
HGIGGVK

SEQ ID NO: 19578 - protein, 7 aa, Artificial Sequence
  Synthetic
DSGVSRW

SEQ ID NO: 19579 - protein, 7 aa, Artificial Sequence
  Synthetic
IEAWTAA

SEQ ID NO: 19580 - protein, 7 aa, Artificial Sequence
  Synthetic
AHSLSSW

SEQ ID NO: 19581 - protein, 7 aa, Artificial Sequence
  Synthetic
LWSGGAM

SEQ ID NO: 19582 - protein, 7 aa, Artificial Sequence
  Synthetic
MRANAHS

SEQ ID NO: 19583 - protein, 7 aa, Artificial Sequence
  Synthetic
WMQAYSD

SEQ ID NO: 19584 - protein, 7 aa, Artificial Sequence
  Synthetic
WMLGGSG

SEQ ID NO: 19585 - protein, 7 aa, Artificial Sequence
  Synthetic
QFAGFST

SEQ ID NO: 19586 - protein, 7 aa, Artificial Sequence
  Synthetic
STPFLSS

SEQ ID NO: 19587 - protein, 7 aa, Artificial Sequence
  Synthetic
FGSGWSH

SEQ ID NO: 19588 - protein, 7 aa, Artificial Sequence
  Synthetic
DPNVARW

SEQ ID NO: 19589 - protein, 7 aa, Artificial Sequence
  Synthetic
VPRMEAR

SEQ ID NO: 19590 - protein, 7 aa, Artificial Sequence
  Synthetic
LLRHDGK

SEQ ID NO: 19591 - protein, 7 aa, Artificial Sequence
  Synthetic
MMRMSAH

SEQ ID NO: 19592 - protein, 7 aa, Artificial Sequence
  Synthetic
HAGMMNK

SEQ ID NO: 19593 - protein, 7 aa, Artificial Sequence
  Synthetic
VFHVQAI

SEQ ID NO: 19594 - protein, 7 aa, Artificial Sequence
  Synthetic
RGGSWAA

SEQ ID NO: 19595 - protein, 7 aa, Artificial Sequence
  Synthetic
RWRGGEE

SEQ ID NO: 19596 - protein, 7 aa, Artificial Sequence
  Synthetic
MRVPMAS

SEQ ID NO: 19597 - protein, 7 aa, Artificial Sequence
  Synthetic
RGVMVSH

SEQ ID NO: 19598 - protein, 7 aa, Artificial Sequence
  Synthetic
ELHWGSS

SEQ ID NO: 19599 - protein, 7 aa, Artificial Sequence
  Synthetic
TIVGRMC

SEQ ID NO: 19600 - protein, 7 aa, Artificial Sequence
  Synthetic
APHSGAW

SEQ ID NO: 19601 - protein, 7 aa, Artificial Sequence
  Synthetic
SRWGMGE

SEQ ID NO: 19602 - protein, 7 aa, Artificial Sequence
  Synthetic
REFEIPY

SEQ ID NO: 19603 - protein, 7 aa, Artificial Sequence
  Synthetic
HERLYSS

SEQ ID NO: 19604 - protein, 7 aa, Artificial Sequence
  Synthetic
AYSYGSS

SEQ ID NO: 19605 - protein, 7 aa, Artificial Sequence
  Synthetic
INYSASL

SEQ ID NO: 19606 - protein, 7 aa, Artificial Sequence
  Synthetic
HMLHGSA

SEQ ID NO: 19607 - protein, 7 aa, Artificial Sequence
  Synthetic
DVPWQIR

SEQ ID NO: 19608 - protein, 7 aa, Artificial Sequence
  Synthetic
GAVAQFW

SEQ ID NO: 19609 - protein, 7 aa, Artificial Sequence
  Synthetic
VAVNWHV

SEQ ID NO: 19610 - protein, 7 aa, Artificial Sequence
  Synthetic
DLKYAGW

SEQ ID NO: 19611 - protein, 7 aa, Artificial Sequence
  Synthetic
HRTNPGV

SEQ ID NO: 19612 - protein, 7 aa, Artificial Sequence
  Synthetic
WLVPSDR

SEQ ID NO: 19613 - protein, 7 aa, Artificial Sequence
  Synthetic
LRAGTSQ

SEQ ID NO: 19614 - protein, 7 aa, Artificial Sequence
  Synthetic
RMGPSAV

SEQ ID NO: 19615 - protein, 7 aa, Artificial Sequence
  Synthetic
TGERSGR

SEQ ID NO: 19616 - protein, 7 aa, Artificial Sequence
  Synthetic
HRERPSL

SEQ ID NO: 19617 - protein, 7 aa, Artificial Sequence
  Synthetic
NNFGAQR

SEQ ID NO: 19618 - protein, 7 aa, Artificial Sequence
  Synthetic
PLPQYGW

SEQ ID NO: 19619 - protein, 7 aa, Artificial Sequence
  Synthetic
SALFLSS

SEQ ID NO: 19620 - protein, 7 aa, Artificial Sequence
  Synthetic
QRHLGST

SEQ ID NO: 19621 - protein, 7 aa, Artificial Sequence
  Synthetic
SGVTAYW

SEQ ID NO: 19622 - protein, 7 aa, Artificial Sequence
  Synthetic
NVWGGSV

SEQ ID NO: 19623 - protein, 7 aa, Artificial Sequence
  Synthetic
WGLMIKT

SEQ ID NO: 19624 - protein, 7 aa, Artificial Sequence
  Synthetic
GDNRGTW

SEQ ID NO: 19625 - protein, 7 aa, Artificial Sequence
  Synthetic
PWHSGSA

SEQ ID NO: 19626 - protein, 7 aa, Artificial Sequence
  Synthetic
HQRHAVA

SEQ ID NO: 19627 - protein, 7 aa, Artificial Sequence
  Synthetic
NMREAMR

SEQ ID NO: 19628 - protein, 7 aa, Artificial Sequence
  Synthetic
GGNSLPR

SEQ ID NO: 19629 - protein, 7 aa, Artificial Sequence
  Synthetic
PPIILAK

SEQ ID NO: 19630 - protein, 7 aa, Artificial Sequence
  Synthetic
SPSWAIG

SEQ ID NO: 19631 - protein, 7 aa, Artificial Sequence
  Synthetic
DFRMGAS

SEQ ID NO: 19632 - protein, 7 aa, Artificial Sequence
  Synthetic
ERYSLDR

SEQ ID NO: 19633 - protein, 7 aa, Artificial Sequence
  Synthetic
LGSLEFY

SEQ ID NO: 19634 - protein, 7 aa, Artificial Sequence
  Synthetic
NAMGRHI

SEQ ID NO: 19635 - protein, 7 aa, Artificial Sequence
  Synthetic
MYEGSWS

SEQ ID NO: 19636 - protein, 7 aa, Artificial Sequence
  Synthetic
SITMHGW

SEQ ID NO: 19637 - protein, 7 aa, Artificial Sequence
  Synthetic
KKGDRDG

SEQ ID NO: 19638 - protein, 7 aa, Artificial Sequence
  Synthetic
EWKRNLP

SEQ ID NO: 19639 - protein, 7 aa, Artificial Sequence
  Synthetic
FLHREVL

SEQ ID NO: 19640 - protein, 7 aa, Artificial Sequence
  Synthetic
HGAVPQK

SEQ ID NO: 19641 - protein, 7 aa, Artificial Sequence
  Synthetic
LVQHGYN

SEQ ID NO: 19642 - protein, 7 aa, Artificial Sequence
  Synthetic
VPNSSRW

SEQ ID NO: 19643 - protein, 7 aa, Artificial Sequence
  Synthetic
NLKGCTK

SEQ ID NO: 19644 - protein, 7 aa, Artificial Sequence
  Synthetic
RNGGEAR

SEQ ID NO: 19645 - protein, 7 aa, Artificial Sequence
  Synthetic
RYSLGPV

SEQ ID NO: 19646 - protein, 7 aa, Artificial Sequence
  Synthetic
KALGFSM

SEQ ID NO: 19647 - protein, 7 aa, Artificial Sequence
  Synthetic
WSALGSA

SEQ ID NO: 19648 - protein, 7 aa, Artificial Sequence
  Synthetic
RQEQLVR

SEQ ID NO: 19649 - protein, 7 aa, Artificial Sequence
  Synthetic
PRIAGRN

SEQ ID NO: 19650 - protein, 7 aa, Artificial Sequence
  Synthetic
GGGLNQK

SEQ ID NO: 19651 - protein, 7 aa, Artificial Sequence
  Synthetic
PRVGAIY

SEQ ID NO: 19652 - protein, 7 aa, Artificial Sequence
  Synthetic
TIVGFST

SEQ ID NO: 19653 - protein, 7 aa, Artificial Sequence
  Synthetic
AKGQHSI

SEQ ID NO: 19654 - protein, 7 aa, Artificial Sequence
  Synthetic
KLGPHSG

SEQ ID NO: 19655 - protein, 7 aa, Artificial Sequence
  Synthetic
LAFRGAS

SEQ ID NO: 19656 - protein, 7 aa, Artificial Sequence
  Synthetic
SRVVGEL

SEQ ID NO: 19657 - protein, 7 aa, Artificial Sequence
  Synthetic
DTDRARW

SEQ ID NO: 19658 - protein, 7 aa, Artificial Sequence
  Synthetic
FVFGETL

SEQ ID NO: 19659 - protein, 7 aa, Artificial Sequence
  Synthetic
DAWHGSS

SEQ ID NO: 19660 - protein, 7 aa, Artificial Sequence
  Synthetic
GLINWSF

SEQ ID NO: 19661 - protein, 7 aa, Artificial Sequence
  Synthetic
GASKGPW

SEQ ID NO: 19662 - protein, 7 aa, Artificial Sequence
  Synthetic
SKWEVQF

SEQ ID NO: 19663 - protein, 7 aa, Artificial Sequence
  Synthetic
MWGGMST

SEQ ID NO: 19664 - protein, 7 aa, Artificial Sequence
  Synthetic
RVVGDSA

SEQ ID NO: 19665 - protein, 7 aa, Artificial Sequence
  Synthetic
LQTWASS

SEQ ID NO: 19666 - protein, 7 aa, Artificial Sequence
  Synthetic
LLTVAVE

SEQ ID NO: 19667 - protein, 7 aa, Artificial Sequence
  Synthetic
ISVSSSG

SEQ ID NO: 19668 - protein, 7 aa, Artificial Sequence
  Synthetic
HRLLGAA

SEQ ID NO: 19669 - protein, 7 aa, Artificial Sequence
  Synthetic
RPQLLPY

SEQ ID NO: 19670 - protein, 7 aa, Artificial Sequence
  Synthetic
ILSGYSL

SEQ ID NO: 19671 - protein, 7 aa, Artificial Sequence
  Synthetic
AMYTGQW

SEQ ID NO: 19672 - protein, 7 aa, Artificial Sequence
  Synthetic
VWPAGST

SEQ ID NO: 19673 - protein, 7 aa, Artificial Sequence
  Synthetic
SFNYKVS

SEQ ID NO: 19674 - protein, 7 aa, Artificial Sequence
  Synthetic
PAPYVSA

SEQ ID NO: 19675 - protein, 7 aa, Artificial Sequence
  Synthetic
LYLNFSA

SEQ ID NO: 19676 - protein, 7 aa, Artificial Sequence
  Synthetic
HAGFAGW

SEQ ID NO: 19677 - protein, 7 aa, Artificial Sequence
  Synthetic
LKHTDGR

SEQ ID NO: 19678 - protein, 7 aa, Artificial Sequence
  Synthetic
LRPVSDR

SEQ ID NO: 19679 - protein, 7 aa, Artificial Sequence
  Synthetic
RVMGNER

SEQ ID NO: 19680 - protein, 7 aa, Artificial Sequence
  Synthetic
RRVDMSG

SEQ ID NO: 19681 - protein, 7 aa, Artificial Sequence
  Synthetic
AIPLYGA

SEQ ID NO: 19682 - protein, 7 aa, Artificial Sequence
  Synthetic
SWKLGLD

SEQ ID NO: 19683 - protein, 7 aa, Artificial Sequence
  Synthetic
FEYLRGV

SEQ ID NO: 19684 - protein, 7 aa, Artificial Sequence
  Synthetic
LVGHGSS

SEQ ID NO: 19685 - protein, 7 aa, Artificial Sequence
  Synthetic
GVWGSLA

SEQ ID NO: 19686 - protein, 7 aa, Artificial Sequence
  Synthetic
QFHGAAS

SEQ ID NO: 19687 - protein, 7 aa, Artificial Sequence
  Synthetic
FDTLPAG

SEQ ID NO: 19688 - protein, 7 aa, Artificial Sequence
  Synthetic
PHNSAYY

SEQ ID NO: 19689 - protein, 7 aa, Artificial Sequence
  Synthetic
QWRDAQL

SEQ ID NO: 19690 - protein, 7 aa, Artificial Sequence
  Synthetic
GWGTGHH

SEQ ID NO: 19691 - protein, 7 aa, Artificial Sequence
  Synthetic
WGYHPNS

SEQ ID NO: 19692 - protein, 7 aa, Artificial Sequence
  Synthetic
GGKHLAN

SEQ ID NO: 19693 - protein, 7 aa, Artificial Sequence
  Synthetic
DYQGFSV

SEQ ID NO: 19694 - protein, 7 aa, Artificial Sequence
  Synthetic
NRNEALK

SEQ ID NO: 19695 - protein, 7 aa, Artificial Sequence
  Synthetic
QAVYGSA

SEQ ID NO: 19696 - protein, 7 aa, Artificial Sequence
  Synthetic
LKQHGST

SEQ ID NO: 19697 - protein, 7 aa, Artificial Sequence
  Synthetic
NHRLLGH

SEQ ID NO: 19698 - protein, 7 aa, Artificial Sequence
  Synthetic
THRPNVC

SEQ ID NO: 19699 - protein, 7 aa, Artificial Sequence
  Synthetic
GHSFWKE

SEQ ID NO: 19700 - protein, 7 aa, Artificial Sequence
  Synthetic
SEYHGSS

SEQ ID NO: 19701 - protein, 7 aa, Artificial Sequence
  Synthetic
VTRTYPV

SEQ ID NO: 19702 - protein, 7 aa, Artificial Sequence
  Synthetic
MTDLQRW

SEQ ID NO: 19703 - protein, 7 aa, Artificial Sequence
  Synthetic
RVLDASR

SEQ ID NO: 19704 - protein, 7 aa, Artificial Sequence
  Synthetic
PIDAARY

SEQ ID NO: 19705 - protein, 7 aa, Artificial Sequence
  Synthetic
ERVGYSV

SEQ ID NO: 19706 - protein, 7 aa, Artificial Sequence
  Synthetic
IGNYAGW

SEQ ID NO: 19707 - protein, 7 aa, Artificial Sequence
  Synthetic
KNSNQER

SEQ ID NO: 19708 - protein, 7 aa, Artificial Sequence
  Synthetic
FPQGSWN

SEQ ID NO: 19709 - protein, 7 aa, Artificial Sequence
  Synthetic
WRDNHQW

SEQ ID NO: 19710 - protein, 7 aa, Artificial Sequence
  Synthetic
GLRQFGQ

SEQ ID NO: 19711 - protein, 7 aa, Artificial Sequence
  Synthetic
WTLGGGH

SEQ ID NO: 19712 - protein, 7 aa, Artificial Sequence
  Synthetic
WREHFSS

SEQ ID NO: 19713 - protein, 7 aa, Artificial Sequence
  Synthetic
RNVGSIY

SEQ ID NO: 19714 - protein, 7 aa, Artificial Sequence
  Synthetic
SYNLKVF

SEQ ID NO: 19715 - protein, 7 aa, Artificial Sequence
  Synthetic
GLSQTMW

SEQ ID NO: 19716 - protein, 7 aa, Artificial Sequence
  Synthetic
WGLDTGW

SEQ ID NO: 19717 - protein, 7 aa, Artificial Sequence
  Synthetic
SPHESRW

SEQ ID NO: 19718 - protein, 7 aa, Artificial Sequence
  Synthetic
SAMHYSS

SEQ ID NO: 19719 - protein, 7 aa, Artificial Sequence
  Synthetic
GYGGWSM

SEQ ID NO: 19720 - protein, 7 aa, Artificial Sequence
  Synthetic
TIMRQWD

SEQ ID NO: 19721 - protein, 7 aa, Artificial Sequence
  Synthetic
MTYKGWE

SEQ ID NO: 19722 - protein, 7 aa, Artificial Sequence
  Synthetic
KEFRLPQ

SEQ ID NO: 19723 - protein, 7 aa, Artificial Sequence
  Synthetic
LLKYGST

SEQ ID NO: 19724 - protein, 7 aa, Artificial Sequence
  Synthetic
FAVEGSR

SEQ ID NO: 19725 - protein, 7 aa, Artificial Sequence
  Synthetic
EKWGQSQ

SEQ ID NO: 19726 - protein, 7 aa, Artificial Sequence
  Synthetic
RFDLRWD

SEQ ID NO: 19727 - protein, 7 aa, Artificial Sequence
  Synthetic
DVAHGSS

SEQ ID NO: 19728 - protein, 7 aa, Artificial Sequence
  Synthetic
LTQGYSQ

SEQ ID NO: 19729 - protein, 7 aa, Artificial Sequence
  Synthetic
VPYRVNV

SEQ ID NO: 19730 - protein, 7 aa, Artificial Sequence
  Synthetic
VYVPAAQ

SEQ ID NO: 19731 - protein, 7 aa, Artificial Sequence
  Synthetic
PHKNPPG

SEQ ID NO: 19732 - protein, 7 aa, Artificial Sequence
  Synthetic
DGASMRF

SEQ ID NO: 19733 - protein, 7 aa, Artificial Sequence
  Synthetic
LFVGHSS

SEQ ID NO: 19734 - protein, 7 aa, Artificial Sequence
  Synthetic
QWDRSLH

SEQ ID NO: 19735 - protein, 7 aa, Artificial Sequence
  Synthetic
LHAQRNC

SEQ ID NO: 19736 - protein, 7 aa, Artificial Sequence
  Synthetic
SRPAWHE

SEQ ID NO: 19737 - protein, 7 aa, Artificial Sequence
  Synthetic
WVLGTPH

SEQ ID NO: 19738 - protein, 7 aa, Artificial Sequence
  Synthetic
RRVGDAS

SEQ ID NO: 19739 - protein, 7 aa, Artificial Sequence
  Synthetic
SNDFARY

SEQ ID NO: 19740 - protein, 7 aa, Artificial Sequence
  Synthetic
MTGEYRW

SEQ ID NO: 19741 - protein, 7 aa, Artificial Sequence
  Synthetic
IFPGGSM

SEQ ID NO: 19742 - protein, 7 aa, Artificial Sequence
  Synthetic
EEWRGSQ

SEQ ID NO: 19743 - protein, 7 aa, Artificial Sequence
  Synthetic
VLQVMSL

SEQ ID NO: 19744 - protein, 7 aa, Artificial Sequence
  Synthetic
ERLMGAA

SEQ ID NO: 19745 - protein, 7 aa, Artificial Sequence
  Synthetic
RRQDGAG

SEQ ID NO: 19746 - protein, 7 aa, Artificial Sequence
  Synthetic
GPTWNHT

SEQ ID NO: 19747 - protein, 7 aa, Artificial Sequence
  Synthetic
RSVNESR

SEQ ID NO: 19748 - protein, 7 aa, Artificial Sequence
  Synthetic
MAPRHLF

SEQ ID NO: 19749 - protein, 7 aa, Artificial Sequence
  Synthetic
KPGRDYV

SEQ ID NO: 19750 - protein, 7 aa, Artificial Sequence
  Synthetic
ARNHQNP

SEQ ID NO: 19751 - protein, 7 aa, Artificial Sequence
  Synthetic
MGLHIVR

SEQ ID NO: 19752 - protein, 7 aa, Artificial Sequence
  Synthetic
SQGIKGH

SEQ ID NO: 19753 - protein, 7 aa, Artificial Sequence
  Synthetic
SRHVLPS

SEQ ID NO: 19754 - protein, 7 aa, Artificial Sequence
  Synthetic
EEYRLPM

SEQ ID NO: 19755 - protein, 7 aa, Artificial Sequence
  Synthetic
NRWHEVG

SEQ ID NO: 19756 - protein, 7 aa, Artificial Sequence
  Synthetic
GPWGYAN

SEQ ID NO: 19757 - protein, 7 aa, Artificial Sequence
  Synthetic
SYYGSSS

SEQ ID NO: 19758 - protein, 7 aa, Artificial Sequence
  Synthetic
DHKFHFS

SEQ ID NO: 19759 - protein, 7 aa, Artificial Sequence
  Synthetic
AFFTGSS

SEQ ID NO: 19760 - protein, 7 aa, Artificial Sequence
  Synthetic
QAMALLG

SEQ ID NO: 19761 - protein, 7 aa, Artificial Sequence
  Synthetic
LETGSAV

SEQ ID NO: 19762 - protein, 7 aa, Artificial Sequence
  Synthetic
RRLVEAG

SEQ ID NO: 19763 - protein, 7 aa, Artificial Sequence
  Synthetic
RHMIHSG

SEQ ID NO: 19764 - protein, 7 aa, Artificial Sequence
  Synthetic
GHGNRGL

SEQ ID NO: 19765 - protein, 7 aa, Artificial Sequence
  Synthetic
HGNPGRL

SEQ ID NO: 19766 - protein, 7 aa, Artificial Sequence
  Synthetic
MDLTNRW

SEQ ID NO: 19767 - protein, 7 aa, Artificial Sequence
  Synthetic
IRQVETK

SEQ ID NO: 19768 - protein, 7 aa, Artificial Sequence
  Synthetic
STIAAHW

SEQ ID NO: 19769 - protein, 7 aa, Artificial Sequence
  Synthetic
HMMPAAR

SEQ ID NO: 19770 - protein, 7 aa, Artificial Sequence
  Synthetic
GGYLLSS

SEQ ID NO: 19771 - protein, 7 aa, Artificial Sequence
  Synthetic
MWTSGAS

SEQ ID NO: 19772 - protein, 7 aa, Artificial Sequence
  Synthetic
VRPTGVW

SEQ ID NO: 19773 - protein, 7 aa, Artificial Sequence
  Synthetic
PYHGAAA

SEQ ID NO: 19774 - protein, 7 aa, Artificial Sequence
  Synthetic
PKIAASW

SEQ ID NO: 19775 - protein, 7 aa, Artificial Sequence
  Synthetic
IVSYGSA

SEQ ID NO: 19776 - protein, 7 aa, Artificial Sequence
  Synthetic
PYVNFSA

SEQ ID NO: 19777 - protein, 7 aa, Artificial Sequence
  Synthetic
ENRAWSV

SEQ ID NO: 19778 - protein, 7 aa, Artificial Sequence
  Synthetic
AYERFPK

SEQ ID NO: 19779 - protein, 7 aa, Artificial Sequence
  Synthetic
GVPWDRA

SEQ ID NO: 19780 - protein, 7 aa, Artificial Sequence
  Synthetic
YVNLYGI

SEQ ID NO: 19781 - protein, 7 aa, Artificial Sequence
  Synthetic
DSQVGRW

SEQ ID NO: 19782 - protein, 7 aa, Artificial Sequence
  Synthetic
GIWGSVS

SEQ ID NO: 19783 - protein, 7 aa, Artificial Sequence
  Synthetic
WGFPEHG

SEQ ID NO: 19784 - protein, 7 aa, Artificial Sequence
  Synthetic
WDLRYSV

SEQ ID NO: 19785 - protein, 7 aa, Artificial Sequence
  Synthetic
NGGHSPR

SEQ ID NO: 19786 - protein, 7 aa, Artificial Sequence
  Synthetic
NNRPLHL

SEQ ID NO: 19787 - protein, 7 aa, Artificial Sequence
  Synthetic
RPPSISW

SEQ ID NO: 19788 - protein, 7 aa, Artificial Sequence
  Synthetic
RQGGHNV

SEQ ID NO: 19789 - protein, 7 aa, Artificial Sequence
  Synthetic
GTRMASC

SEQ ID NO: 19790 - protein, 7 aa, Artificial Sequence
  Synthetic
HTNVVGR

SEQ ID NO: 19791 - protein, 7 aa, Artificial Sequence
  Synthetic
EAWRRDG

SEQ ID NO: 19792 - protein, 7 aa, Artificial Sequence
  Synthetic
CQRLGSS

SEQ ID NO: 19793 - protein, 7 aa, Artificial Sequence
  Synthetic
RFLGDTA

SEQ ID NO: 19794 - protein, 7 aa, Artificial Sequence
  Synthetic
LGKPHSQ

SEQ ID NO: 19795 - protein, 7 aa, Artificial Sequence
  Synthetic
WGMLNNG

SEQ ID NO: 19796 - protein, 7 aa, Artificial Sequence
  Synthetic
HLQKHGQ

SEQ ID NO: 19797 - protein, 7 aa, Artificial Sequence
  Synthetic
NNFHEAR

SEQ ID NO: 19798 - protein, 7 aa, Artificial Sequence
  Synthetic
WKMRLDG

SEQ ID NO: 19799 - protein, 7 aa, Artificial Sequence
  Synthetic
SREGWST

SEQ ID NO: 19800 - protein, 7 aa, Artificial Sequence
  Synthetic
RGHSADH

SEQ ID NO: 19801 - protein, 7 aa, Artificial Sequence
  Synthetic
GWNLRTP

SEQ ID NO: 19802 - protein, 7 aa, Artificial Sequence
  Synthetic
LVPSWSS

SEQ ID NO: 19803 - protein, 7 aa, Artificial Sequence
  Synthetic
GADWSSR

SEQ ID NO: 19804 - protein, 7 aa, Artificial Sequence
  Synthetic
IQVGEYW

SEQ ID NO: 19805 - protein, 7 aa, Artificial Sequence
  Synthetic
RAFDLNF

SEQ ID NO: 19806 - protein, 7 aa, Artificial Sequence
  Synthetic
LPTSWSP

SEQ ID NO: 19807 - protein, 7 aa, Artificial Sequence
  Synthetic
LYVPQSA

SEQ ID NO: 19808 - protein, 7 aa, Artificial Sequence
  Synthetic
FSYNGAQ

SEQ ID NO: 19809 - protein, 7 aa, Artificial Sequence
  Synthetic
VPRGDGW

SEQ ID NO: 19810 - protein, 7 aa, Artificial Sequence
  Synthetic
HANIVSR

SEQ ID NO: 19811 - protein, 7 aa, Artificial Sequence
  Synthetic
PANGGRW

SEQ ID NO: 19812 - protein, 7 aa, Artificial Sequence
  Synthetic
TWDRGAS

SEQ ID NO: 19813 - protein, 7 aa, Artificial Sequence
  Synthetic
GLTASLW

SEQ ID NO: 19814 - protein, 7 aa, Artificial Sequence
  Synthetic
SITMGSW

SEQ ID NO: 19815 - protein, 7 aa, Artificial Sequence
  Synthetic
YLNFYGA

SEQ ID NO: 19816 - protein, 7 aa, Artificial Sequence
  Synthetic
ESYKMAF

SEQ ID NO: 19817 - protein, 7 aa, Artificial Sequence
  Synthetic
IKHLVGA

SEQ ID NO: 19818 - protein, 7 aa, Artificial Sequence
  Synthetic
QHTWDRP

SEQ ID NO: 19819 - protein, 7 aa, Artificial Sequence
  Synthetic
SRPSLTV

SEQ ID NO: 19820 - protein, 7 aa, Artificial Sequence
  Synthetic
LPYSLPV

SEQ ID NO: 19821 - protein, 7 aa, Artificial Sequence
  Synthetic
ELTGSRW

SEQ ID NO: 19822 - protein, 7 aa, Artificial Sequence
  Synthetic
VPVWRLP

SEQ ID NO: 19823 - protein, 7 aa, Artificial Sequence
  Synthetic
PYVPSAH

SEQ ID NO: 19824 - protein, 7 aa, Artificial Sequence
  Synthetic
LRQGMSQ

SEQ ID NO: 19825 - protein, 7 aa, Artificial Sequence
  Synthetic
LAHTGWN

SEQ ID NO: 19826 - protein, 7 aa, Artificial Sequence
  Synthetic
LVSTQTW

SEQ ID NO: 19827 - protein, 7 aa, Artificial Sequence
  Synthetic
GRAEGRW

SEQ ID NO: 19828 - protein, 7 aa, Artificial Sequence
  Synthetic
TYYGGSH

SEQ ID NO: 19829 - protein, 7 aa, Artificial Sequence
  Synthetic
VTRGFST

SEQ ID NO: 19830 - protein, 7 aa, Artificial Sequence
  Synthetic
DKPWMST

SEQ ID NO: 19831 - protein, 7 aa, Artificial Sequence
  Synthetic
MFYQGQA

SEQ ID NO: 19832 - protein, 7 aa, Artificial Sequence
  Synthetic
EWPGDAS

SEQ ID NO: 19833 - protein, 7 aa, Artificial Sequence
  Synthetic
CYPAGAC

SEQ ID NO: 19834 - protein, 7 aa, Artificial Sequence
  Synthetic
WEFHGSS

SEQ ID NO: 19835 - protein, 7 aa, Artificial Sequence
  Synthetic
QASNWHN

SEQ ID NO: 19836 - protein, 7 aa, Artificial Sequence
  Synthetic
VGTPGRW

SEQ ID NO: 19837 - protein, 7 aa, Artificial Sequence
  Synthetic
GGVNQGR

SEQ ID NO: 19838 - protein, 7 aa, Artificial Sequence
  Synthetic
KRDVERN

SEQ ID NO: 19839 - protein, 7 aa, Artificial Sequence
  Synthetic
WYATNLG

SEQ ID NO: 19840 - protein, 7 aa, Artificial Sequence
  Synthetic
ERQRIIA

SEQ ID NO: 19841 - protein, 7 aa, Artificial Sequence
  Synthetic
KWVTTDH

SEQ ID NO: 19842 - protein, 7 aa, Artificial Sequence
  Synthetic
GWRVQHD

SEQ ID NO: 19843 - protein, 7 aa, Artificial Sequence
  Synthetic
TETPKPR

SEQ ID NO: 19844 - protein, 7 aa, Artificial Sequence
  Synthetic
GSQGRAW

SEQ ID NO: 19845 - protein, 7 aa, Artificial Sequence
  Synthetic
RGNDVTR

SEQ ID NO: 19846 - protein, 7 aa, Artificial Sequence
  Synthetic
GLRQELR

SEQ ID NO: 19847 - protein, 7 aa, Artificial Sequence
  Synthetic
RLVRVDH

SEQ ID NO: 19848 - protein, 7 aa, Artificial Sequence
  Synthetic
KTHGLSS

SEQ ID NO: 19849 - protein, 7 aa, Artificial Sequence
  Synthetic
YLVRGLG

SEQ ID NO: 19850 - protein, 7 aa, Artificial Sequence
  Synthetic
SHIYSSS

SEQ ID NO: 19851 - protein, 7 aa, Artificial Sequence
  Synthetic
GINEKPS

SEQ ID NO: 19852 - protein, 7 aa, Artificial Sequence
  Synthetic
SESIGRW

SEQ ID NO: 19853 - protein, 7 aa, Artificial Sequence
  Synthetic
FYDGYSS

SEQ ID NO: 19854 - protein, 7 aa, Artificial Sequence
  Synthetic
PAHAGPW

SEQ ID NO: 19855 - protein, 7 aa, Artificial Sequence
  Synthetic
LQRWESM

SEQ ID NO: 19856 - protein, 7 aa, Artificial Sequence
  Synthetic
TFIPAVH

SEQ ID NO: 19857 - protein, 7 aa, Artificial Sequence
  Synthetic
RYPGHSS

SEQ ID NO: 19858 - protein, 7 aa, Artificial Sequence
  Synthetic
LYPGQSS

SEQ ID NO: 19859 - protein, 7 aa, Artificial Sequence
  Synthetic
RFLGDML

SEQ ID NO: 19860 - protein, 7 aa, Artificial Sequence
  Synthetic
RATGQNW

SEQ ID NO: 19861 - protein, 7 aa, Artificial Sequence
  Synthetic
GMGIHNR

SEQ ID NO: 19862 - protein, 7 aa, Artificial Sequence
  Synthetic
IRIGGAS

SEQ ID NO: 19863 - protein, 7 aa, Artificial Sequence
  Synthetic
GAHVGGR

SEQ ID NO: 19864 - protein, 7 aa, Artificial Sequence
  Synthetic
FVLGYSS

SEQ ID NO: 19865 - protein, 7 aa, Artificial Sequence
  Synthetic
KGHGMVP

SEQ ID NO: 19866 - protein, 7 aa, Artificial Sequence
  Synthetic
PIIPAGW

SEQ ID NO: 19867 - protein, 7 aa, Artificial Sequence
  Synthetic
GWRHALD

SEQ ID NO: 19868 - protein, 7 aa, Artificial Sequence
  Synthetic
RGIESVR

SEQ ID NO: 19869 - protein, 7 aa, Artificial Sequence
  Synthetic
HFVNQGK

SEQ ID NO: 19870 - protein, 7 aa, Artificial Sequence
  Synthetic
GALLHIK

SEQ ID NO: 19871 - protein, 7 aa, Artificial Sequence
  Synthetic
EFFLGAT

SEQ ID NO: 19872 - protein, 7 aa, Artificial Sequence
  Synthetic
FASWVQK

SEQ ID NO: 19873 - protein, 7 aa, Artificial Sequence
  Synthetic
FGALAGY

SEQ ID NO: 19874 - protein, 7 aa, Artificial Sequence
  Synthetic
ARVILSA

SEQ ID NO: 19875 - protein, 7 aa, Artificial Sequence
  Synthetic
QFHGGAA

SEQ ID NO: 19876 - protein, 7 aa, Artificial Sequence
  Synthetic
FGVLEGL

SEQ ID NO: 19877 - protein, 7 aa, Artificial Sequence
  Synthetic
LKSYGSS

SEQ ID NO: 19878 - protein, 7 aa, Artificial Sequence
  Synthetic
DVSSSRW

SEQ ID NO: 19879 - protein, 7 aa, Artificial Sequence
  Synthetic
AAVIQHW

SEQ ID NO: 19880 - protein, 7 aa, Artificial Sequence
  Synthetic
ARVNPEW

SEQ ID NO: 19881 - protein, 7 aa, Artificial Sequence
  Synthetic
KPARPMG

SEQ ID NO: 19882 - protein, 7 aa, Artificial Sequence
  Synthetic
GRTSNCC

SEQ ID NO: 19883 - protein, 7 aa, Artificial Sequence
  Synthetic
RQNNAHN

SEQ ID NO: 19884 - protein, 7 aa, Artificial Sequence
  Synthetic
QRGGGVN

SEQ ID NO: 19885 - protein, 7 aa, Artificial Sequence
  Synthetic
LVYSQVT

SEQ ID NO: 19886 - protein, 7 aa, Artificial Sequence
  Synthetic
RLQHGPV

SEQ ID NO: 19887 - protein, 7 aa, Artificial Sequence
  Synthetic
VWVHGAA

SEQ ID NO: 19888 - protein, 7 aa, Artificial Sequence
  Synthetic
RGLPENR

SEQ ID NO: 19889 - protein, 7 aa, Artificial Sequence
  Synthetic
KPQRIDV

SEQ ID NO: 19890 - protein, 7 aa, Artificial Sequence
  Synthetic
LVFQGAS

SEQ ID NO: 19891 - protein, 7 aa, Artificial Sequence
  Synthetic
VMRGMSS

SEQ ID NO: 19892 - protein, 7 aa, Artificial Sequence
  Synthetic
MAWNGSS

SEQ ID NO: 19893 - protein, 7 aa, Artificial Sequence
  Synthetic
RWTGEAS

SEQ ID NO: 19894 - protein, 7 aa, Artificial Sequence
  Synthetic
NSYLGST

SEQ ID NO: 19895 - protein, 7 aa, Artificial Sequence
  Synthetic
ANSWNSW

SEQ ID NO: 19896 - protein, 7 aa, Artificial Sequence
  Synthetic
RAGFGDW

SEQ ID NO: 19897 - protein, 7 aa, Artificial Sequence
  Synthetic
SFDLRLV

SEQ ID NO: 19898 - protein, 7 aa, Artificial Sequence
  Synthetic
VLVGRSG

SEQ ID NO: 19899 - protein, 7 aa, Artificial Sequence
  Synthetic
AWGTFGE

SEQ ID NO: 19900 - protein, 7 aa, Artificial Sequence
  Synthetic
YGLYIST

SEQ ID NO: 19901 - protein, 7 aa, Artificial Sequence
  Synthetic
RTAAADR

SEQ ID NO: 19902 - protein, 7 aa, Artificial Sequence
  Synthetic
NPGGRAH

SEQ ID NO: 19903 - protein, 7 aa, Artificial Sequence
  Synthetic
VHGTWHA

SEQ ID NO: 19904 - protein, 7 aa, Artificial Sequence
  Synthetic
RTHMPSV

SEQ ID NO: 19905 - protein, 7 aa, Artificial Sequence
  Synthetic
AHPQHPR

SEQ ID NO: 19906 - protein, 7 aa, Artificial Sequence
  Synthetic
SSPSHTF

SEQ ID NO: 19907 - protein, 7 aa, Artificial Sequence
  Synthetic
STVRNGW

SEQ ID NO: 19908 - protein, 7 aa, Artificial Sequence
  Synthetic
RWEGEGR

SEQ ID NO: 19909 - protein, 7 aa, Artificial Sequence
  Synthetic
WLAGFSA

SEQ ID NO: 19910 - protein, 7 aa, Artificial Sequence
  Synthetic
SNANMVR

SEQ ID NO: 19911 - protein, 7 aa, Artificial Sequence
  Synthetic
VAERARL

SEQ ID NO: 19912 - protein, 7 aa, Artificial Sequence
  Synthetic
HLLRGYA

SEQ ID NO: 19913 - protein, 7 aa, Artificial Sequence
  Synthetic
SFNAARL

SEQ ID NO: 19914 - protein, 7 aa, Artificial Sequence
  Synthetic
WYEHGSS

SEQ ID NO: 19915 - protein, 7 aa, Artificial Sequence
  Synthetic
WSVSAGY

SEQ ID NO: 19916 - protein, 7 aa, Artificial Sequence
  Synthetic
WSAVHGY

SEQ ID NO: 19917 - protein, 7 aa, Artificial Sequence
  Synthetic
WPRSVSS

SEQ ID NO: 19918 - protein, 7 aa, Artificial Sequence
  Synthetic
RMLYPGG

SEQ ID NO: 19919 - protein, 7 aa, Artificial Sequence
  Synthetic
LFVAMSS

SEQ ID NO: 19920 - protein, 7 aa, Artificial Sequence
  Synthetic
RVTMGFN

SEQ ID NO: 19921 - protein, 7 aa, Artificial Sequence
  Synthetic
GSSPGVW

SEQ ID NO: 19922 - protein, 7 aa, Artificial Sequence
  Synthetic
VDSWNRI

SEQ ID NO: 19923 - protein, 7 aa, Artificial Sequence
  Synthetic
EHHSPGW

SEQ ID NO: 19924 - protein, 7 aa, Artificial Sequence
  Synthetic
SLHWKAD

SEQ ID NO: 19925 - protein, 7 aa, Artificial Sequence
  Synthetic
AFYSGSH

SEQ ID NO: 19926 - protein, 7 aa, Artificial Sequence
  Synthetic
GGDVSRW

SEQ ID NO: 19927 - protein, 7 aa, Artificial Sequence
  Synthetic
KYEREIV

SEQ ID NO: 19928 - protein, 7 aa, Artificial Sequence
  Synthetic
GYGSSSW

SEQ ID NO: 19929 - protein, 7 aa, Artificial Sequence
  Synthetic
LWSGAST

SEQ ID NO: 19930 - protein, 7 aa, Artificial Sequence
  Synthetic
LMEYGSS

SEQ ID NO: 19931 - protein, 7 aa, Artificial Sequence
  Synthetic
VEVGSVY

SEQ ID NO: 19932 - protein, 7 aa, Artificial Sequence
  Synthetic
LMMGYAS

SEQ ID NO: 19933 - protein, 7 aa, Artificial Sequence
  Synthetic
LYQLGST

SEQ ID NO: 19934 - protein, 7 aa, Artificial Sequence
  Synthetic
TDYSRWS

SEQ ID NO: 19935 - protein, 7 aa, Artificial Sequence
  Synthetic
YMLPGPA

SEQ ID NO: 19936 - protein, 7 aa, Artificial Sequence
  Synthetic
QFYGSAM

SEQ ID NO: 19937 - protein, 7 aa, Artificial Sequence
  Synthetic
LYLNGST

SEQ ID NO: 19938 - protein, 7 aa, Artificial Sequence
  Synthetic
SERLLPY

SEQ ID NO: 19939 - protein, 7 aa, Artificial Sequence
  Synthetic
WGTLEVY

SEQ ID NO: 19940 - protein, 7 aa, Artificial Sequence
  Synthetic
RLTVTDW

SEQ ID NO: 19941 - protein, 7 aa, Artificial Sequence
  Synthetic
TQPSIWA

SEQ ID NO: 19942 - protein, 7 aa, Artificial Sequence
  Synthetic
LSRGLSQ

SEQ ID NO: 19943 - protein, 7 aa, Artificial Sequence
  Synthetic
LNYSLSM

SEQ ID NO: 19944 - protein, 7 aa, Artificial Sequence
  Synthetic
LTMANHK

SEQ ID NO: 19945 - protein, 7 aa, Artificial Sequence
  Synthetic
AGVGWST

SEQ ID NO: 19946 - protein, 7 aa, Artificial Sequence
  Synthetic
PPNSGAW

SEQ ID NO: 19947 - protein, 7 aa, Artificial Sequence
  Synthetic
RLANNGW

SEQ ID NO: 19948 - protein, 7 aa, Artificial Sequence
  Synthetic
WSGQTLR

SEQ ID NO: 19949 - protein, 7 aa, Artificial Sequence
  Synthetic
WNRVGSV

SEQ ID NO: 19950 - protein, 7 aa, Artificial Sequence
  Synthetic
ISDPPRK

SEQ ID NO: 19951 - protein, 7 aa, Artificial Sequence
  Synthetic
HRTKIEL

SEQ ID NO: 19952 - protein, 7 aa, Artificial Sequence
  Synthetic
VGQFLMR

SEQ ID NO: 19953 - protein, 7 aa, Artificial Sequence
  Synthetic
MSHGRII

SEQ ID NO: 19954 - protein, 7 aa, Artificial Sequence
  Synthetic
HELRAIK

SEQ ID NO: 19955 - protein, 7 aa, Artificial Sequence
  Synthetic
RGIMASV

SEQ ID NO: 19956 - protein, 7 aa, Artificial Sequence
  Synthetic
GLRVEGR

SEQ ID NO: 19957 - protein, 7 aa, Artificial Sequence
  Synthetic
PLHMGYS

SEQ ID NO: 19958 - protein, 7 aa, Artificial Sequence
  Synthetic
GGVAGHW

SEQ ID NO: 19959 - protein, 7 aa, Artificial Sequence
  Synthetic
EEHRFPR

SEQ ID NO: 19960 - protein, 7 aa, Artificial Sequence
  Synthetic
SVESRWA

SEQ ID NO: 19961 - protein, 7 aa, Artificial Sequence
  Synthetic
DPPITWR

SEQ ID NO: 19962 - protein, 7 aa, Artificial Sequence
  Synthetic
HLTACVG

SEQ ID NO: 19963 - protein, 7 aa, Artificial Sequence
  Synthetic
RYVGDSS

SEQ ID NO: 19964 - protein, 7 aa, Artificial Sequence
  Synthetic
SQVGFSS

SEQ ID NO: 19965 - protein, 7 aa, Artificial Sequence
  Synthetic
WRRVDDP

SEQ ID NO: 19966 - protein, 7 aa, Artificial Sequence
  Synthetic
QPPYTTW

SEQ ID NO: 19967 - protein, 7 aa, Artificial Sequence
  Synthetic
LHLGQSS

SEQ ID NO: 19968 - protein, 7 aa, Artificial Sequence
  Synthetic
AVRNPER

SEQ ID NO: 19969 - protein, 7 aa, Artificial Sequence
  Synthetic
HNENKNK

SEQ ID NO: 19970 - protein, 7 aa, Artificial Sequence
  Synthetic
FLHGYSE

SEQ ID NO: 19971 - protein, 7 aa, Artificial Sequence
  Synthetic
GGVFMSS

SEQ ID NO: 19972 - protein, 7 aa, Artificial Sequence
  Synthetic
VVDYTGW

SEQ ID NO: 19973 - protein, 7 aa, Artificial Sequence
  Synthetic
VGMRLGY

SEQ ID NO: 19974 - protein, 7 aa, Artificial Sequence
  Synthetic
RNDTSTR

SEQ ID NO: 19975 - protein, 7 aa, Artificial Sequence
  Synthetic
EFMRGSS

SEQ ID NO: 19976 - protein, 7 aa, Artificial Sequence
  Synthetic
RGGAGRE

SEQ ID NO: 19977 - protein, 7 aa, Artificial Sequence
  Synthetic
IRGGHPP

SEQ ID NO: 19978 - protein, 7 aa, Artificial Sequence
  Synthetic
APLHQGK

SEQ ID NO: 19979 - protein, 7 aa, Artificial Sequence
  Synthetic
WTAHGSM

SEQ ID NO: 19980 - protein, 7 aa, Artificial Sequence
  Synthetic
WSLDNGH

SEQ ID NO: 19981 - protein, 7 aa, Artificial Sequence
  Synthetic
LRVGWAS

SEQ ID NO: 19982 - protein, 7 aa, Artificial Sequence
  Synthetic
GRASNDK

SEQ ID NO: 19983 - protein, 7 aa, Artificial Sequence
  Synthetic
NRTGVER

SEQ ID NO: 19984 - protein, 7 aa, Artificial Sequence
  Synthetic
LSHGQSR

SEQ ID NO: 19985 - protein, 7 aa, Artificial Sequence
  Synthetic
FVPGFSS

SEQ ID NO: 19986 - protein, 7 aa, Artificial Sequence
  Synthetic
SHFGGAS

SEQ ID NO: 19987 - protein, 7 aa, Artificial Sequence
  Synthetic
SVANYHT

SEQ ID NO: 19988 - protein, 7 aa, Artificial Sequence
  Synthetic
RHCGAPC

SEQ ID NO: 19989 - protein, 7 aa, Artificial Sequence
  Synthetic
NPTVYHV

SEQ ID NO: 19990 - protein, 7 aa, Artificial Sequence
  Synthetic
SGAIRWD

SEQ ID NO: 19991 - protein, 7 aa, Artificial Sequence
  Synthetic
LAWAGAQ

SEQ ID NO: 19992 - protein, 7 aa, Artificial Sequence
  Synthetic
DYKWVAQ

SEQ ID NO: 19993 - protein, 7 aa, Artificial Sequence
  Synthetic
GFGTFAY

SEQ ID NO: 19994 - protein, 7 aa, Artificial Sequence
  Synthetic
YTVLTFP

SEQ ID NO: 19995 - protein, 7 aa, Artificial Sequence
  Synthetic
RVDSQFW

SEQ ID NO: 19996 - protein, 7 aa, Artificial Sequence
  Synthetic
PVRPGPW

SEQ ID NO: 19997 - protein, 7 aa, Artificial Sequence
  Synthetic
FGVLSMV

SEQ ID NO: 19998 - protein, 7 aa, Artificial Sequence
  Synthetic
YGSLSMY

SEQ ID NO: 19999 - protein, 7 aa, Artificial Sequence
  Synthetic
EHWGAAR

SEQ ID NO: 20000 - protein, 7 aa, Artificial Sequence
  Synthetic
TMAQWSS

SEQ ID NO: 20001 - protein, 7 aa, Artificial Sequence
  Synthetic
PSWGTSS

SEQ ID NO: 20002 - protein, 7 aa, Artificial Sequence
  Synthetic
ERYNQSM

SEQ ID NO: 20003 - protein, 7 aa, Artificial Sequence
  Synthetic
GGQKVHG

SEQ ID NO: 20004 - protein, 7 aa, Artificial Sequence
  Synthetic
LIPGFSL

SEQ ID NO: 20005 - protein, 7 aa, Artificial Sequence
  Synthetic
DGAASRF

SEQ ID NO: 20006 - protein, 7 aa, Artificial Sequence
  Synthetic
LHYSGAQ

SEQ ID NO: 20007 - protein, 7 aa, Artificial Sequence
  Synthetic
WPVLSAN

SEQ ID NO: 20008 - protein, 7 aa, Artificial Sequence
  Synthetic
PQHGGVW

SEQ ID NO: 20009 - protein, 7 aa, Artificial Sequence
  Synthetic
ARGSPRD

SEQ ID NO: 20010 - protein, 7 aa, Artificial Sequence
  Synthetic
GNFNTAK

SEQ ID NO: 20011 - protein, 7 aa, Artificial Sequence
  Synthetic
VVRGYAS

SEQ ID NO: 20012 - protein, 7 aa, Artificial Sequence
  Synthetic
EVTGSLW

SEQ ID NO: 20013 - protein, 7 aa, Artificial Sequence
  Synthetic
RTDMAHW

SEQ ID NO: 20014 - protein, 7 aa, Artificial Sequence
  Synthetic
MRRDGRE

SEQ ID NO: 20015 - protein, 7 aa, Artificial Sequence
  Synthetic
NNRAYQG

SEQ ID NO: 20016 - protein, 7 aa, Artificial Sequence
  Synthetic
VERPLGR

SEQ ID NO: 20017 - protein, 7 aa, Artificial Sequence
  Synthetic
GRGLGLA

SEQ ID NO: 20018 - protein, 7 aa, Artificial Sequence
  Synthetic
LGAGLLR

SEQ ID NO: 20019 - protein, 7 aa, Artificial Sequence
  Synthetic
RSEANPK

SEQ ID NO: 20020 - protein, 7 aa, Artificial Sequence
  Synthetic
AGRPARE

SEQ ID NO: 20021 - protein, 7 aa, Artificial Sequence
  Synthetic
WSEYSRG

SEQ ID NO: 20022 - protein, 7 aa, Artificial Sequence
  Synthetic
TMYRGSI

SEQ ID NO: 20023 - protein, 7 aa, Artificial Sequence
  Synthetic
LIGRGFQ

SEQ ID NO: 20024 - protein, 7 aa, Artificial Sequence
  Synthetic
QSPDKPW

SEQ ID NO: 20025 - protein, 7 aa, Artificial Sequence
  Synthetic
RFEGGKN

SEQ ID NO: 20026 - protein, 7 aa, Artificial Sequence
  Synthetic
YSGAVLR

SEQ ID NO: 20027 - protein, 7 aa, Artificial Sequence
  Synthetic
DLHGHVF

SEQ ID NO: 20028 - protein, 7 aa, Artificial Sequence
  Synthetic
GWRTDPA

SEQ ID NO: 20029 - protein, 7 aa, Artificial Sequence
  Synthetic
PTWGATS

SEQ ID NO: 20030 - protein, 7 aa, Artificial Sequence
  Synthetic
LPFHVGD

SEQ ID NO: 20031 - protein, 7 aa, Artificial Sequence
  Synthetic
IYAGYAD

SEQ ID NO: 20032 - protein, 7 aa, Artificial Sequence
  Synthetic
GSTRHMS

SEQ ID NO: 20033 - protein, 7 aa, Artificial Sequence
  Synthetic
HRLGGST

SEQ ID NO: 20034 - protein, 7 aa, Artificial Sequence
  Synthetic
WGLVTGY

SEQ ID NO: 20035 - protein, 7 aa, Artificial Sequence
  Synthetic
ERSGMSQ

SEQ ID NO: 20036 - protein, 7 aa, Artificial Sequence
  Synthetic
FRSPSGA

SEQ ID NO: 20037 - protein, 7 aa, Artificial Sequence
  Synthetic
PHTPGAW

SEQ ID NO: 20038 - protein, 7 aa, Artificial Sequence
  Synthetic
KDDYSYY

SEQ ID NO: 20039 - protein, 7 aa, Artificial Sequence
  Synthetic
YSVASGY

SEQ ID NO: 20040 - protein, 7 aa, Artificial Sequence
  Synthetic
ERLGQAR

SEQ ID NO: 20041 - protein, 7 aa, Artificial Sequence
  Synthetic
MVHGYSS

SEQ ID NO: 20042 - protein, 7 aa, Artificial Sequence
  Synthetic
RIAEGMR

SEQ ID NO: 20043 - protein, 7 aa, Artificial Sequence
  Synthetic
RYVTAGP

SEQ ID NO: 20044 - protein, 7 aa, Artificial Sequence
  Synthetic
EHKTAYW

SEQ ID NO: 20045 - protein, 7 aa, Artificial Sequence
  Synthetic
SRVGYAA

SEQ ID NO: 20046 - protein, 7 aa, Artificial Sequence
  Synthetic
RQANVMH

SEQ ID NO: 20047 - protein, 7 aa, Artificial Sequence
  Synthetic
SDNGLWY

SEQ ID NO: 20048 - protein, 7 aa, Artificial Sequence
  Synthetic
LASEIRW

SEQ ID NO: 20049 - protein, 7 aa, Artificial Sequence
  Synthetic
NKFAGAH

SEQ ID NO: 20050 - protein, 7 aa, Artificial Sequence
  Synthetic
AREIMAR

SEQ ID NO: 20051 - protein, 7 aa, Artificial Sequence
  Synthetic
RDMTTPR

SEQ ID NO: 20052 - protein, 7 aa, Artificial Sequence
  Synthetic
STHSSYW

SEQ ID NO: 20053 - protein, 7 aa, Artificial Sequence
  Synthetic
GHSWSAS

SEQ ID NO: 20054 - protein, 7 aa, Artificial Sequence
  Synthetic
YGSLMIH

SEQ ID NO: 20055 - protein, 7 aa, Artificial Sequence
  Synthetic
EKFSGVW

SEQ ID NO: 20056 - protein, 7 aa, Artificial Sequence
  Synthetic
PIVRLLN

SEQ ID NO: 20057 - protein, 7 aa, Artificial Sequence
  Synthetic
DHVGFAY

SEQ ID NO: 20058 - protein, 7 aa, Artificial Sequence
  Synthetic
MPWRPVP

SEQ ID NO: 20059 - protein, 7 aa, Artificial Sequence
  Synthetic
RMSTAER

SEQ ID NO: 20060 - protein, 7 aa, Artificial Sequence
  Synthetic
LLRGYAA

SEQ ID NO: 20061 - protein, 7 aa, Artificial Sequence
  Synthetic
RLQGARD

SEQ ID NO: 20062 - protein, 7 aa, Artificial Sequence
  Synthetic
AGRGFSS

SEQ ID NO: 20063 - protein, 7 aa, Artificial Sequence
  Synthetic
RDMTRFV

SEQ ID NO: 20064 - protein, 7 aa, Artificial Sequence
  Synthetic
GWNGRGP

SEQ ID NO: 20065 - protein, 7 aa, Artificial Sequence
  Synthetic
KFKVEII

SEQ ID NO: 20066 - protein, 7 aa, Artificial Sequence
  Synthetic
RDWHPNA

SEQ ID NO: 20067 - protein, 7 aa, Artificial Sequence
  Synthetic
HGGKSMS

SEQ ID NO: 20068 - protein, 7 aa, Artificial Sequence
  Synthetic
NYVPSGS

SEQ ID NO: 20069 - protein, 7 aa, Artificial Sequence
  Synthetic
YPHTATK

SEQ ID NO: 20070 - protein, 7 aa, Artificial Sequence
  Synthetic
KNQVWGP

SEQ ID NO: 20071 - protein, 7 aa, Artificial Sequence
  Synthetic
KNLHAVQ

SEQ ID NO: 20072 - protein, 7 aa, Artificial Sequence
  Synthetic
HGRNMIA

SEQ ID NO: 20073 - protein, 7 aa, Artificial Sequence
  Synthetic
ERALGSA

SEQ ID NO: 20074 - protein, 7 aa, Artificial Sequence
  Synthetic
YVGLPAV

SEQ ID NO: 20075 - protein, 7 aa, Artificial Sequence
  Synthetic
MQWASAQ

SEQ ID NO: 20076 - protein, 7 aa, Artificial Sequence
  Synthetic
MEHSGRW

SEQ ID NO: 20077 - protein, 7 aa, Artificial Sequence
  Synthetic
YLAGFHA

SEQ ID NO: 20078 - protein, 7 aa, Artificial Sequence
  Synthetic
RVPGFSS

SEQ ID NO: 20079 - protein, 7 aa, Artificial Sequence
  Synthetic
GADTGRW

SEQ ID NO: 20080 - protein, 7 aa, Artificial Sequence
  Synthetic
MSHKLDR

SEQ ID NO: 20081 - protein, 7 aa, Artificial Sequence
  Synthetic
LYASWAS

SEQ ID NO: 20082 - protein, 7 aa, Artificial Sequence
  Synthetic
LGYTSFN

SEQ ID NO: 20083 - protein, 7 aa, Artificial Sequence
  Synthetic
HSLLGST

SEQ ID NO: 20084 - protein, 7 aa, Artificial Sequence
  Synthetic
WKLGSGF

SEQ ID NO: 20085 - protein, 7 aa, Artificial Sequence
  Synthetic
WGYPVVD

SEQ ID NO: 20086 - protein, 7 aa, Artificial Sequence
  Synthetic
MFSYASS

SEQ ID NO: 20087 - protein, 7 aa, Artificial Sequence
  Synthetic
PITRHHD

SEQ ID NO: 20088 - protein, 7 aa, Artificial Sequence
  Synthetic
GNRNWGA

SEQ ID NO: 20089 - protein, 7 aa, Artificial Sequence
  Synthetic
WTMRGSA

SEQ ID NO: 20090 - protein, 7 aa, Artificial Sequence
  Synthetic
THHGYSV

SEQ ID NO: 20091 - protein, 7 aa, Artificial Sequence
  Synthetic
GLQRQWD

SEQ ID NO: 20092 - protein, 7 aa, Artificial Sequence
  Synthetic
IWDHGPA

SEQ ID NO: 20093 - protein, 7 aa, Artificial Sequence
  Synthetic
AFLGGAA

SEQ ID NO: 20094 - protein, 7 aa, Artificial Sequence
  Synthetic
HHVASGK

SEQ ID NO: 20095 - protein, 7 aa, Artificial Sequence
  Synthetic
HNRTGAG

SEQ ID NO: 20096 - protein, 7 aa, Artificial Sequence
  Synthetic
GDYRNLL

SEQ ID NO: 20097 - protein, 7 aa, Artificial Sequence
  Synthetic
VSYSRGL

SEQ ID NO: 20098 - protein, 7 aa, Artificial Sequence
  Synthetic
GEYRAFH

SEQ ID NO: 20099 - protein, 7 aa, Artificial Sequence
  Synthetic
LAHTHSW

SEQ ID NO: 20100 - protein, 7 aa, Artificial Sequence
  Synthetic
YGVLSMT

SEQ ID NO: 20101 - protein, 7 aa, Artificial Sequence
  Synthetic
FVNWGRD

SEQ ID NO: 20102 - protein, 7 aa, Artificial Sequence
  Synthetic
PGFNVMW

SEQ ID NO: 20103 - protein, 7 aa, Artificial Sequence
  Synthetic
VDYTGNW

SEQ ID NO: 20104 - protein, 7 aa, Artificial Sequence
  Synthetic
TMVGWSA

SEQ ID NO: 20105 - protein, 7 aa, Artificial Sequence
  Synthetic
LQFRGAT

SEQ ID NO: 20106 - protein, 7 aa, Artificial Sequence
  Synthetic
RATDGTR

SEQ ID NO: 20107 - protein, 7 aa, Artificial Sequence
  Synthetic
RVQARDN

SEQ ID NO: 20108 - protein, 7 aa, Artificial Sequence
  Synthetic
RELHNNW

SEQ ID NO: 20109 - protein, 7 aa, Artificial Sequence
  Synthetic
SAVGYSS

SEQ ID NO: 20110 - protein, 7 aa, Artificial Sequence
  Synthetic
NRADLAR

SEQ ID NO: 20111 - protein, 7 aa, Artificial Sequence
  Synthetic
AWSRDHG

SEQ ID NO: 20112 - protein, 7 aa, Artificial Sequence
  Synthetic
GRETGVW

SEQ ID NO: 20113 - protein, 7 aa, Artificial Sequence
  Synthetic
HRSAQQL

SEQ ID NO: 20114 - protein, 7 aa, Artificial Sequence
  Synthetic
RFADGVK

SEQ ID NO: 20115 - protein, 7 aa, Artificial Sequence
  Synthetic
ETGRLTW

SEQ ID NO: 20116 - protein, 7 aa, Artificial Sequence
  Synthetic
GEHNGRW

SEQ ID NO: 20117 - protein, 7 aa, Artificial Sequence
  Synthetic
SMFKGST

SEQ ID NO: 20118 - protein, 7 aa, Artificial Sequence
  Synthetic
EWVPSAS

SEQ ID NO: 20119 - protein, 7 aa, Artificial Sequence
  Synthetic
VRSFGSA

SEQ ID NO: 20120 - protein, 7 aa, Artificial Sequence
  Synthetic
APVWKLD

SEQ ID NO: 20121 - protein, 7 aa, Artificial Sequence
  Synthetic
FERFYSS

SEQ ID NO: 20122 - protein, 7 aa, Artificial Sequence
  Synthetic
FGSLSAV

SEQ ID NO: 20123 - protein, 7 aa, Artificial Sequence
  Synthetic
WELYERI

SEQ ID NO: 20124 - protein, 7 aa, Artificial Sequence
  Synthetic
GAWAGSS

SEQ ID NO: 20125 - protein, 7 aa, Artificial Sequence
  Synthetic
HLGSGPK

SEQ ID NO: 20126 - protein, 7 aa, Artificial Sequence
  Synthetic
RGHGNAG

SEQ ID NO: 20127 - protein, 7 aa, Artificial Sequence
  Synthetic
MERMVRL

SEQ ID NO: 20128 - protein, 7 aa, Artificial Sequence
  Synthetic
FGKAGMG

SEQ ID NO: 20129 - protein, 7 aa, Artificial Sequence
  Synthetic
GGEPRWS

SEQ ID NO: 20130 - protein, 7 aa, Artificial Sequence
  Synthetic
RGYTDSW

SEQ ID NO: 20131 - protein, 7 aa, Artificial Sequence
  Synthetic
GLHDGRW

SEQ ID NO: 20132 - protein, 7 aa, Artificial Sequence
  Synthetic
KPMHERM

SEQ ID NO: 20133 - protein, 7 aa, Artificial Sequence
  Synthetic
FLPNWSS

SEQ ID NO: 20134 - protein, 7 aa, Artificial Sequence
  Synthetic
CRYQGAS

SEQ ID NO: 20135 - protein, 7 aa, Artificial Sequence
  Synthetic
PRPEFSA

SEQ ID NO: 20136 - protein, 7 aa, Artificial Sequence
  Synthetic
RYAQDSS

SEQ ID NO: 20137 - protein, 7 aa, Artificial Sequence
  Synthetic
GMHAGSW

SEQ ID NO: 20138 - protein, 7 aa, Artificial Sequence
  Synthetic
VHYQGSS

SEQ ID NO: 20139 - protein, 7 aa, Artificial Sequence
  Synthetic
MVQHSHW

SEQ ID NO: 20140 - protein, 7 aa, Artificial Sequence
  Synthetic
EGLPWTY

SEQ ID NO: 20141 - protein, 7 aa, Artificial Sequence
  Synthetic
AGVGSVY

SEQ ID NO: 20142 - protein, 7 aa, Artificial Sequence
  Synthetic
GYIGGSS

SEQ ID NO: 20143 - protein, 7 aa, Artificial Sequence
  Synthetic
YENFRYS

SEQ ID NO: 20144 - protein, 7 aa, Artificial Sequence
  Synthetic
RAYDLNP

SEQ ID NO: 20145 - protein, 7 aa, Artificial Sequence
  Synthetic
ESAWSHH

SEQ ID NO: 20146 - protein, 7 aa, Artificial Sequence
  Synthetic
GVNLGRW

SEQ ID NO: 20147 - protein, 7 aa, Artificial Sequence
  Synthetic
EVGYGSA

SEQ ID NO: 20148 - protein, 7 aa, Artificial Sequence
  Synthetic
TALLYSA

SEQ ID NO: 20149 - protein, 7 aa, Artificial Sequence
  Synthetic
PPYDAGR

SEQ ID NO: 20150 - protein, 7 aa, Artificial Sequence
  Synthetic
PDFNRNW

SEQ ID NO: 20151 - protein, 7 aa, Artificial Sequence
  Synthetic
EWPGRAS

SEQ ID NO: 20152 - protein, 7 aa, Artificial Sequence
  Synthetic
PMTHGTW

SEQ ID NO: 20153 - protein, 7 aa, Artificial Sequence
  Synthetic
ALNDARW

SEQ ID NO: 20154 - protein, 7 aa, Artificial Sequence
  Synthetic
ARLVEGR

SEQ ID NO: 20155 - protein, 7 aa, Artificial Sequence
  Synthetic
MRAPYWE

SEQ ID NO: 20156 - protein, 7 aa, Artificial Sequence
  Synthetic
LFSMGSS

SEQ ID NO: 20157 - protein, 7 aa, Artificial Sequence
  Synthetic
FDKQTFR

SEQ ID NO: 20158 - protein, 7 aa, Artificial Sequence
  Synthetic
SRQFDFV

SEQ ID NO: 20159 - protein, 7 aa, Artificial Sequence
  Synthetic
SARFMSA

SEQ ID NO: 20160 - protein, 7 aa, Artificial Sequence
  Synthetic
PVIVLSA

SEQ ID NO: 20161 - protein, 7 aa, Artificial Sequence
  Synthetic
WGPARQG

SEQ ID NO: 20162 - protein, 7 aa, Artificial Sequence
  Synthetic
WANYGSS

SEQ ID NO: 20163 - protein, 7 aa, Artificial Sequence
  Synthetic
PRYGSSS

SEQ ID NO: 20164 - protein, 7 aa, Artificial Sequence
  Synthetic
DFRSPGW

SEQ ID NO: 20165 - protein, 7 aa, Artificial Sequence
  Synthetic
AGGPWKG

SEQ ID NO: 20166 - protein, 7 aa, Artificial Sequence
  Synthetic
RYSLNGG

SEQ ID NO: 20167 - protein, 7 aa, Artificial Sequence
  Synthetic
EHGSNRW

SEQ ID NO: 20168 - protein, 7 aa, Artificial Sequence
  Synthetic
WVVGTHH

SEQ ID NO: 20169 - protein, 7 aa, Artificial Sequence
  Synthetic
WNSHPDR

SEQ ID NO: 20170 - protein, 7 aa, Artificial Sequence
  Synthetic
GTHPSYY

SEQ ID NO: 20171 - protein, 7 aa, Artificial Sequence
  Synthetic
PPGHDWR

SEQ ID NO: 20172 - protein, 7 aa, Artificial Sequence
  Synthetic
TFSEHRW

SEQ ID NO: 20173 - protein, 7 aa, Artificial Sequence
  Synthetic
MGHAPAR

SEQ ID NO: 20174 - protein, 7 aa, Artificial Sequence
  Synthetic
AGSSRWD

SEQ ID NO: 20175 - protein, 7 aa, Artificial Sequence
  Synthetic
HPYRLTD

SEQ ID NO: 20176 - protein, 7 aa, Artificial Sequence
  Synthetic
LMRFEAS

SEQ ID NO: 20177 - protein, 7 aa, Artificial Sequence
  Synthetic
SGSPGRW

SEQ ID NO: 20178 - protein, 7 aa, Artificial Sequence
  Synthetic
ERFQGSS

SEQ ID NO: 20179 - protein, 7 aa, Artificial Sequence
  Synthetic
VSEWSYH

SEQ ID NO: 20180 - protein, 7 aa, Artificial Sequence
  Synthetic
TTIGYSS

SEQ ID NO: 20181 - protein, 7 aa, Artificial Sequence
  Synthetic
WGYVGSG

SEQ ID NO: 20182 - protein, 7 aa, Artificial Sequence
  Synthetic
LETWNRA

SEQ ID NO: 20183 - protein, 7 aa, Artificial Sequence
  Synthetic
GRQGAAN

SEQ ID NO: 20184 - protein, 7 aa, Artificial Sequence
  Synthetic
WTPEMKR

SEQ ID NO: 20185 - protein, 7 aa, Artificial Sequence
  Synthetic
WTKQEGY

SEQ ID NO: 20186 - protein, 7 aa, Artificial Sequence
  Synthetic
ALYSLPT

SEQ ID NO: 20187 - protein, 7 aa, Artificial Sequence
  Synthetic
TEPWASS

SEQ ID NO: 20188 - protein, 7 aa, Artificial Sequence
  Synthetic
GVNRGLF

SEQ ID NO: 20189 - protein, 7 aa, Artificial Sequence
  Synthetic
KTIHTER

SEQ ID NO: 20190 - protein, 7 aa, Artificial Sequence
  Synthetic
MKGVPSH

SEQ ID NO: 20191 - protein, 7 aa, Artificial Sequence
  Synthetic
HGQGRHE

SEQ ID NO: 20192 - protein, 7 aa, Artificial Sequence
  Synthetic
MHHYVSQ

SEQ ID NO: 20193 - protein, 7 aa, Artificial Sequence
  Synthetic
NRVFGAS

SEQ ID NO: 20194 - protein, 7 aa, Artificial Sequence
  Synthetic
YAYLGAA

SEQ ID NO: 20195 - protein, 7 aa, Artificial Sequence
  Synthetic
GRVCIGC

SEQ ID NO: 20196 - protein, 7 aa, Artificial Sequence
  Synthetic
VGYRLAP

SEQ ID NO: 20197 - protein, 7 aa, Artificial Sequence
  Synthetic
LVYKGSQ

SEQ ID NO: 20198 - protein, 7 aa, Artificial Sequence
  Synthetic
PVWGGTS

SEQ ID NO: 20199 - protein, 7 aa, Artificial Sequence
  Synthetic
LYPAHSS

SEQ ID NO: 20200 - protein, 7 aa, Artificial Sequence
  Synthetic
MGYLMSS

SEQ ID NO: 20201 - protein, 7 aa, Artificial Sequence
  Synthetic
MWIGNAA

SEQ ID NO: 20202 - protein, 7 aa, Artificial Sequence
  Synthetic
QLLRGFG

SEQ ID NO: 20203 - protein, 7 aa, Artificial Sequence
  Synthetic
DGVHWAF

SEQ ID NO: 20204 - protein, 7 aa, Artificial Sequence
  Synthetic
TDHGYSS

SEQ ID NO: 20205 - protein, 7 aa, Artificial Sequence
  Synthetic
ERLGYSS

SEQ ID NO: 20206 - protein, 7 aa, Artificial Sequence
  Synthetic
VYPNAYF

SEQ ID NO: 20207 - protein, 7 aa, Artificial Sequence
  Synthetic
EVWSGSV

SEQ ID NO: 20208 - protein, 7 aa, Artificial Sequence
  Synthetic
DVWLGAS

SEQ ID NO: 20209 - protein, 7 aa, Artificial Sequence
  Synthetic
DVNTARW

SEQ ID NO: 20210 - protein, 7 aa, Artificial Sequence
  Synthetic
GTIRLIN

SEQ ID NO: 20211 - protein, 7 aa, Artificial Sequence
  Synthetic
PCGTCSS

SEQ ID NO: 20212 - protein, 7 aa, Artificial Sequence
  Synthetic
RDFDAFR

SEQ ID NO: 20213 - protein, 7 aa, Artificial Sequence
  Synthetic
LEWGQAY

SEQ ID NO: 20214 - protein, 7 aa, Artificial Sequence
  Synthetic
WGLFASS

SEQ ID NO: 20215 - protein, 7 aa, Artificial Sequence
  Synthetic
QLHTGAW

SEQ ID NO: 20216 - protein, 7 aa, Artificial Sequence
  Synthetic
LWSGAST

SEQ ID NO: 20217 - protein, 7 aa, Artificial Sequence
  Synthetic
AQIMLVK

SEQ ID NO: 20218 - protein, 7 aa, Artificial Sequence
  Synthetic
HNNYALY

SEQ ID NO: 20219 - protein, 7 aa, Artificial Sequence
  Synthetic
MRTWVSE

SEQ ID NO: 20220 - protein, 7 aa, Artificial Sequence
  Synthetic
VGVLYRS

SEQ ID NO: 20221 - protein, 7 aa, Artificial Sequence
  Synthetic
YLAGFNG

SEQ ID NO: 20222 - protein, 7 aa, Artificial Sequence
  Synthetic
GAREAAR

SEQ ID NO: 20223 - protein, 7 aa, Artificial Sequence
  Synthetic
FRALVQS

SEQ ID NO: 20224 - protein, 7 aa, Artificial Sequence
  Synthetic
RKMEGVY

SEQ ID NO: 20225 - protein, 7 aa, Artificial Sequence
  Synthetic
RQKPDGA

SEQ ID NO: 20226 - protein, 7 aa, Artificial Sequence
  Synthetic
WVHGGAS

SEQ ID NO: 20227 - protein, 7 aa, Artificial Sequence
  Synthetic
VVLQRFA

SEQ ID NO: 20228 - protein, 7 aa, Artificial Sequence
  Synthetic
TNVTSMW

SEQ ID NO: 20229 - protein, 7 aa, Artificial Sequence
  Synthetic
MKGPRDY

SEQ ID NO: 20230 - protein, 7 aa, Artificial Sequence
  Synthetic
VSLGMQW

SEQ ID NO: 20231 - protein, 7 aa, Artificial Sequence
  Synthetic
MAIMGSS

SEQ ID NO: 20232 - protein, 7 aa, Artificial Sequence
  Synthetic
PHGAAMW

SEQ ID NO: 20233 - protein, 7 aa, Artificial Sequence
  Synthetic
DRWHLDS

SEQ ID NO: 20234 - protein, 7 aa, Artificial Sequence
  Synthetic
LMRYGQT

SEQ ID NO: 20235 - protein, 7 aa, Artificial Sequence
  Synthetic
LRREPKD

SEQ ID NO: 20236 - protein, 7 aa, Artificial Sequence
  Synthetic
LNPHWSS

SEQ ID NO: 20237 - protein, 7 aa, Artificial Sequence
  Synthetic
MRWEGSS

SEQ ID NO: 20238 - protein, 7 aa, Artificial Sequence
  Synthetic
ESVRTLW

SEQ ID NO: 20239 - protein, 7 aa, Artificial Sequence
  Synthetic
AYPGTSS

SEQ ID NO: 20240 - protein, 7 aa, Artificial Sequence
  Synthetic
YGSLAAF

SEQ ID NO: 20241 - protein, 7 aa, Artificial Sequence
  Synthetic
VLVGYNV

SEQ ID NO: 20242 - protein, 7 aa, Artificial Sequence
  Synthetic
FDSRFSS

SEQ ID NO: 20243 - protein, 7 aa, Artificial Sequence
  Synthetic
DVYRGSS

SEQ ID NO: 20244 - protein, 7 aa, Artificial Sequence
  Synthetic
TNQVWGA

SEQ ID NO: 20245 - protein, 7 aa, Artificial Sequence
  Synthetic
THPTDYY

SEQ ID NO: 20246 - protein, 7 aa, Artificial Sequence
  Synthetic
MYDLYRP

SEQ ID NO: 20247 - protein, 7 aa, Artificial Sequence
  Synthetic
IATYGSS

SEQ ID NO: 20248 - protein, 7 aa, Artificial Sequence
  Synthetic
FSSLFSH

SEQ ID NO: 20249 - protein, 7 aa, Artificial Sequence
  Synthetic
WALKTGF

SEQ ID NO: 20250 - protein, 7 aa, Artificial Sequence
  Synthetic
WQGNGRP

SEQ ID NO: 20251 - protein, 7 aa, Artificial Sequence
  Synthetic
SGPREWT

SEQ ID NO: 20252 - protein, 7 aa, Artificial Sequence
  Synthetic
LFAHGSA

SEQ ID NO: 20253 - protein, 7 aa, Artificial Sequence
  Synthetic
SSGSWAY

SEQ ID NO: 20254 - protein, 7 aa, Artificial Sequence
  Synthetic
PIGGSFR

SEQ ID NO: 20255 - protein, 7 aa, Artificial Sequence
  Synthetic
PRSFGSA

SEQ ID NO: 20256 - protein, 7 aa, Artificial Sequence
  Synthetic
RFATTNN

SEQ ID NO: 20257 - protein, 7 aa, Artificial Sequence
  Synthetic
SWHGLER

SEQ ID NO: 20258 - protein, 7 aa, Artificial Sequence
  Synthetic
STYGQGW

SEQ ID NO: 20259 - protein, 7 aa, Artificial Sequence
  Synthetic
WFPGGAS

SEQ ID NO: 20260 - protein, 7 aa, Artificial Sequence
  Synthetic
HAQDLRR

SEQ ID NO: 20261 - protein, 7 aa, Artificial Sequence
  Synthetic
MGSRGGA

SEQ ID NO: 20262 - protein, 7 aa, Artificial Sequence
  Synthetic
WVYGTDV

SEQ ID NO: 20263 - protein, 7 aa, Artificial Sequence
  Synthetic
WVGLPNL

SEQ ID NO: 20264 - protein, 7 aa, Artificial Sequence
  Synthetic
WRSTGTL

SEQ ID NO: 20265 - protein, 7 aa, Artificial Sequence
  Synthetic
ERQHNWI

SEQ ID NO: 20266 - protein, 7 aa, Artificial Sequence
  Synthetic
LRQHWAD

SEQ ID NO: 20267 - protein, 7 aa, Artificial Sequence
  Synthetic
IYHPNLG

SEQ ID NO: 20268 - protein, 7 aa, Artificial Sequence
  Synthetic
MVGFGSS

SEQ ID NO: 20269 - protein, 7 aa, Artificial Sequence
  Synthetic
PVWGTGT

SEQ ID NO: 20270 - protein, 7 aa, Artificial Sequence
  Synthetic
LRGTEWA

SEQ ID NO: 20271 - protein, 7 aa, Artificial Sequence
  Synthetic
EVKFYSS

SEQ ID NO: 20272 - protein, 7 aa, Artificial Sequence
  Synthetic
GDPPGRW

SEQ ID NO: 20273 - protein, 7 aa, Artificial Sequence
  Synthetic
SHPHFSS

SEQ ID NO: 20274 - protein, 7 aa, Artificial Sequence
  Synthetic
LHSLLSS

SEQ ID NO: 20275 - protein, 7 aa, Artificial Sequence
  Synthetic
DRSWGAH

SEQ ID NO: 20276 - protein, 7 aa, Artificial Sequence
  Synthetic
VSPVWSS

SEQ ID NO: 20277 - protein, 7 aa, Artificial Sequence
  Synthetic
PLVPERR

SEQ ID NO: 20278 - protein, 7 aa, Artificial Sequence
  Synthetic
RGDRMVF

SEQ ID NO: 20279 - protein, 7 aa, Artificial Sequence
  Synthetic
VALSGHW

SEQ ID NO: 20280 - protein, 7 aa, Artificial Sequence
  Synthetic
WRLGGSA

SEQ ID NO: 20281 - protein, 7 aa, Artificial Sequence
  Synthetic
FKYSIGG

SEQ ID NO: 20282 - protein, 7 aa, Artificial Sequence
  Synthetic
VRGYGSS

SEQ ID NO: 20283 - protein, 7 aa, Artificial Sequence
  Synthetic
LAEGLWN

SEQ ID NO: 20284 - protein, 7 aa, Artificial Sequence
  Synthetic
RMDGDKR

SEQ ID NO: 20285 - protein, 7 aa, Artificial Sequence
  Synthetic
TLGETRW

SEQ ID NO: 20286 - protein, 7 aa, Artificial Sequence
  Synthetic
WYLGGSG

SEQ ID NO: 20287 - protein, 7 aa, Artificial Sequence
  Synthetic
RFSGPPL

SEQ ID NO: 20288 - protein, 7 aa, Artificial Sequence
  Synthetic
VRIQLQA

SEQ ID NO: 20289 - protein, 7 aa, Artificial Sequence
  Synthetic
GADSARY

SEQ ID NO: 20290 - protein, 7 aa, Artificial Sequence
  Synthetic
WASHTPK

SEQ ID NO: 20291 - protein, 7 aa, Artificial Sequence
  Synthetic
RLTIEGR

SEQ ID NO: 20292 - protein, 7 aa, Artificial Sequence
  Synthetic
RLINHAI

SEQ ID NO: 20293 - protein, 7 aa, Artificial Sequence
  Synthetic
SRVGLSQ

SEQ ID NO: 20294 - protein, 7 aa, Artificial Sequence
  Synthetic
LYSLGYP

SEQ ID NO: 20295 - protein, 7 aa, Artificial Sequence
  Synthetic
VRQWSMD

SEQ ID NO: 20296 - protein, 7 aa, Artificial Sequence
  Synthetic
GRIPSYS

SEQ ID NO: 20297 - protein, 7 aa, Artificial Sequence
  Synthetic
PFTIRAI

SEQ ID NO: 20298 - protein, 7 aa, Artificial Sequence
  Synthetic
TSHATWN

SEQ ID NO: 20299 - protein, 7 aa, Artificial Sequence
  Synthetic
AQRAGSW

SEQ ID NO: 20300 - protein, 7 aa, Artificial Sequence
  Synthetic
GTRETYW

SEQ ID NO: 20301 - protein, 7 aa, Artificial Sequence
  Synthetic
VEYHGSA

SEQ ID NO: 20302 - protein, 7 aa, Artificial Sequence
  Synthetic
LERWPRE

SEQ ID NO: 20303 - protein, 7 aa, Artificial Sequence
  Synthetic
KQVILSN

SEQ ID NO: 20304 - protein, 7 aa, Artificial Sequence
  Synthetic
NTVVRWE

SEQ ID NO: 20305 - protein, 7 aa, Artificial Sequence
  Synthetic
LTFSVGM

SEQ ID NO: 20306 - protein, 7 aa, Artificial Sequence
  Synthetic
RWEREAS

SEQ ID NO: 20307 - protein, 7 aa, Artificial Sequence
  Synthetic
GGWGMSS

SEQ ID NO: 20308 - protein, 7 aa, Artificial Sequence
  Synthetic
PVELSWK

SEQ ID NO: 20309 - protein, 7 aa, Artificial Sequence
  Synthetic
TRAKSEG

SEQ ID NO: 20310 - protein, 7 aa, Artificial Sequence
  Synthetic
PRLTMER

SEQ ID NO: 20311 - protein, 7 aa, Artificial Sequence
  Synthetic
RAHNMMT

SEQ ID NO: 20312 - protein, 7 aa, Artificial Sequence
  Synthetic
VMLRGSA

SEQ ID NO: 20313 - protein, 7 aa, Artificial Sequence
  Synthetic
IATSGWN

SEQ ID NO: 20314 - protein, 7 aa, Artificial Sequence
  Synthetic
RDAHHQW

SEQ ID NO: 20315 - protein, 7 aa, Artificial Sequence
  Synthetic
HPALRNV

SEQ ID NO: 20316 - protein, 7 aa, Artificial Sequence
  Synthetic
WERTSGY

SEQ ID NO: 20317 - protein, 7 aa, Artificial Sequence
  Synthetic
RMHSTLA

SEQ ID NO: 20318 - protein, 7 aa, Artificial Sequence
  Synthetic
ARLQRDA

SEQ ID NO: 20319 - protein, 7 aa, Artificial Sequence
  Synthetic
RGAEHPW

SEQ ID NO: 20320 - protein, 7 aa, Artificial Sequence
  Synthetic
RNVLHHP

SEQ ID NO: 20321 - protein, 7 aa, Artificial Sequence
  Synthetic
MVEWRPD

SEQ ID NO: 20322 - protein, 7 aa, Artificial Sequence
  Synthetic
GLRLDIR

SEQ ID NO: 20323 - protein, 7 aa, Artificial Sequence
  Synthetic
YMRQAGS

SEQ ID NO: 20324 - protein, 7 aa, Artificial Sequence
  Synthetic
VGSHYPW

SEQ ID NO: 20325 - protein, 7 aa, Artificial Sequence
  Synthetic
EAAGARY

SEQ ID NO: 20326 - protein, 7 aa, Artificial Sequence
  Synthetic
NGYQGGW

SEQ ID NO: 20327 - protein, 7 aa, Artificial Sequence
  Synthetic
RNEMRGL

SEQ ID NO: 20328 - protein, 7 aa, Artificial Sequence
  Synthetic
RDGPKPW

SEQ ID NO: 20329 - protein, 7 aa, Artificial Sequence
  Synthetic
RGDARGT

SEQ ID NO: 20330 - protein, 7 aa, Artificial Sequence
  Synthetic
WNIDRGY

SEQ ID NO: 20331 - protein, 7 aa, Artificial Sequence
  Synthetic
GHTVGTW

SEQ ID NO: 20332 - protein, 7 aa, Artificial Sequence
  Synthetic
RLFGMSQ

SEQ ID NO: 20333 - protein, 7 aa, Artificial Sequence
  Synthetic
GYATDYW

SEQ ID NO: 20334 - protein, 7 aa, Artificial Sequence
  Synthetic
DRTPSMW

SEQ ID NO: 20335 - protein, 7 aa, Artificial Sequence
  Synthetic
ERVYAIS

SEQ ID NO: 20336 - protein, 7 aa, Artificial Sequence
  Synthetic
ERAGYSA

SEQ ID NO: 20337 - protein, 7 aa, Artificial Sequence
  Synthetic
RQYDLGS

SEQ ID NO: 20338 - protein, 7 aa, Artificial Sequence
  Synthetic
MIYGGSL

SEQ ID NO: 20339 - protein, 7 aa, Artificial Sequence
  Synthetic
AYPAQSQ

SEQ ID NO: 20340 - protein, 7 aa, Artificial Sequence
  Synthetic
FSPGFSS

SEQ ID NO: 20341 - protein, 7 aa, Artificial Sequence
  Synthetic
RHANPSM

SEQ ID NO: 20342 - protein, 7 aa, Artificial Sequence
  Synthetic
LRSNAHP

SEQ ID NO: 20343 - protein, 7 aa, Artificial Sequence
  Synthetic
GAKGWVM

SEQ ID NO: 20344 - protein, 7 aa, Artificial Sequence
  Synthetic
VRDHPSR

SEQ ID NO: 20345 - protein, 7 aa, Artificial Sequence
  Synthetic
LMVRGSS

SEQ ID NO: 20346 - protein, 7 aa, Artificial Sequence
  Synthetic
GVYMGSS

SEQ ID NO: 20347 - protein, 7 aa, Artificial Sequence
  Synthetic
NDAWRRD

SEQ ID NO: 20348 - protein, 7 aa, Artificial Sequence
  Synthetic
QHVGYSS

SEQ ID NO: 20349 - protein, 7 aa, Artificial Sequence
  Synthetic
IGSPGAW

SEQ ID NO: 20350 - protein, 7 aa, Artificial Sequence
  Synthetic
DRTVGSW

SEQ ID NO: 20351 - protein, 7 aa, Artificial Sequence
  Synthetic
RVYDLRP

SEQ ID NO: 20352 - protein, 7 aa, Artificial Sequence
  Synthetic
LKFGLSS

SEQ ID NO: 20353 - protein, 7 aa, Artificial Sequence
  Synthetic
VPVTVRY

SEQ ID NO: 20354 - protein, 7 aa, Artificial Sequence
  Synthetic
DPVNRWH

SEQ ID NO: 20355 - protein, 7 aa, Artificial Sequence
  Synthetic
SWLGSAT

SEQ ID NO: 20356 - protein, 7 aa, Artificial Sequence
  Synthetic
PVIVLTA

SEQ ID NO: 20357 - protein, 7 aa, Artificial Sequence
  Synthetic
VQYTRFD

SEQ ID NO: 20358 - protein, 7 aa, Artificial Sequence
  Synthetic
EGSVVRW

SEQ ID NO: 20359 - protein, 7 aa, Artificial Sequence
  Synthetic
RGLSEGK

SEQ ID NO: 20360 - protein, 7 aa, Artificial Sequence
  Synthetic
SLKGLTE

SEQ ID NO: 20361 - protein, 7 aa, Artificial Sequence
  Synthetic
RPPNSFH

SEQ ID NO: 20362 - protein, 7 aa, Artificial Sequence
  Synthetic
RESRGLY

SEQ ID NO: 20363 - protein, 7 aa, Artificial Sequence
  Synthetic
RLPEKHH

SEQ ID NO: 20364 - protein, 7 aa, Artificial Sequence
  Synthetic
VKNFPVI

SEQ ID NO: 20365 - protein, 7 aa, Artificial Sequence
  Synthetic
FKSLVHG

SEQ ID NO: 20366 - protein, 7 aa, Artificial Sequence
  Synthetic
RYAGTGP

SEQ ID NO: 20367 - protein, 7 aa, Artificial Sequence
  Synthetic
MDNSSRW

SEQ ID NO: 20368 - protein, 7 aa, Artificial Sequence
  Synthetic
LLGEARW

SEQ ID NO: 20369 - protein, 7 aa, Artificial Sequence
  Synthetic
MVVVRSM

SEQ ID NO: 20370 - protein, 7 aa, Artificial Sequence
  Synthetic
FGSLSRV

SEQ ID NO: 20371 - protein, 7 aa, Artificial Sequence
  Synthetic
STNDGRW

SEQ ID NO: 20372 - protein, 7 aa, Artificial Sequence
  Synthetic
WGSLHGG

SEQ ID NO: 20373 - protein, 7 aa, Artificial Sequence
  Synthetic
LPIVLTN

SEQ ID NO: 20374 - protein, 7 aa, Artificial Sequence
  Synthetic
HNGKGHA

SEQ ID NO: 20375 - protein, 7 aa, Artificial Sequence
  Synthetic
GARLTDR

SEQ ID NO: 20376 - protein, 7 aa, Artificial Sequence
  Synthetic
KHMGHLM

SEQ ID NO: 20377 - protein, 7 aa, Artificial Sequence
  Synthetic
TVSTGRW

SEQ ID NO: 20378 - protein, 7 aa, Artificial Sequence
  Synthetic
WSSLGSA

SEQ ID NO: 20379 - protein, 7 aa, Artificial Sequence
  Synthetic
RGAHLLT

SEQ ID NO: 20380 - protein, 7 aa, Artificial Sequence
  Synthetic
VDGVYRW

SEQ ID NO: 20381 - protein, 7 aa, Artificial Sequence
  Synthetic
TYRGSST

SEQ ID NO: 20382 - protein, 7 aa, Artificial Sequence
  Synthetic
VNLSLRE

SEQ ID NO: 20383 - protein, 7 aa, Artificial Sequence
  Synthetic
VLVSTLG

SEQ ID NO: 20384 - protein, 7 aa, Artificial Sequence
  Synthetic
RERHQAG

SEQ ID NO: 20385 - protein, 7 aa, Artificial Sequence
  Synthetic
GDRSWSV

SEQ ID NO: 20386 - protein, 7 aa, Artificial Sequence
  Synthetic
GERPGLW

SEQ ID NO: 20387 - protein, 7 aa, Artificial Sequence
  Synthetic
LMHNFSM

SEQ ID NO: 20388 - protein, 7 aa, Artificial Sequence
  Synthetic
PHGAPKL

SEQ ID NO: 20389 - protein, 7 aa, Artificial Sequence
  Synthetic
PVRTSGW

SEQ ID NO: 20390 - protein, 7 aa, Artificial Sequence
  Synthetic
FKGEMGR

SEQ ID NO: 20391 - protein, 7 aa, Artificial Sequence
  Synthetic
GMEIGRW

SEQ ID NO: 20392 - protein, 7 aa, Artificial Sequence
  Synthetic
DHLAARW

SEQ ID NO: 20393 - protein, 7 aa, Artificial Sequence
  Synthetic
YTLSPWN

SEQ ID NO: 20394 - protein, 7 aa, Artificial Sequence
  Synthetic
YTVSAGW

SEQ ID NO: 20395 - protein, 7 aa, Artificial Sequence
  Synthetic
RVDTQHW

SEQ ID NO: 20396 - protein, 7 aa, Artificial Sequence
  Synthetic
ELGTGRW

SEQ ID NO: 20397 - protein, 7 aa, Artificial Sequence
  Synthetic
ASYVNQW

SEQ ID NO: 20398 - protein, 7 aa, Artificial Sequence
  Synthetic
QKLGDWA

SEQ ID NO: 20399 - protein, 7 aa, Artificial Sequence
  Synthetic
GRGAVPN

SEQ ID NO: 20400 - protein, 7 aa, Artificial Sequence
  Synthetic
FTKQVHG

SEQ ID NO: 20401 - protein, 7 aa, Artificial Sequence
  Synthetic
WGNPAKG

SEQ ID NO: 20402 - protein, 7 aa, Artificial Sequence
  Synthetic
SNQWSSS

SEQ ID NO: 20403 - protein, 7 aa, Artificial Sequence
  Synthetic
RGHNYQD

SEQ ID NO: 20404 - protein, 7 aa, Artificial Sequence
  Synthetic
HRSVDRV

SEQ ID NO: 20405 - protein, 7 aa, Artificial Sequence
  Synthetic
CGGKVHS

SEQ ID NO: 20406 - protein, 7 aa, Artificial Sequence
  Synthetic
LWNGMDL

SEQ ID NO: 20407 - protein, 7 aa, Artificial Sequence
  Synthetic
EPWNRHS

SEQ ID NO: 20408 - protein, 7 aa, Artificial Sequence
  Synthetic
AHREGSR

SEQ ID NO: 20409 - protein, 7 aa, Artificial Sequence
  Synthetic
KGGPLRD

SEQ ID NO: 20410 - protein, 7 aa, Artificial Sequence
  Synthetic
VHEINHP

SEQ ID NO: 20411 - protein, 7 aa, Artificial Sequence
  Synthetic
RMSEKGA

SEQ ID NO: 20412 - protein, 7 aa, Artificial Sequence
  Synthetic
EYGRGFS

SEQ ID NO: 20413 - protein, 7 aa, Artificial Sequence
  Synthetic
SFRGGSS

SEQ ID NO: 20414 - protein, 7 aa, Artificial Sequence
  Synthetic
DMRVGSW

SEQ ID NO: 20415 - protein, 7 aa, Artificial Sequence
  Synthetic
EIRWGAS

SEQ ID NO: 20416 - protein, 7 aa, Artificial Sequence
  Synthetic
YWGGVSQ

SEQ ID NO: 20417 - protein, 7 aa, Artificial Sequence
  Synthetic
DANRQAR

SEQ ID NO: 20418 - protein, 7 aa, Artificial Sequence
  Synthetic
TWREHGT

SEQ ID NO: 20419 - protein, 7 aa, Artificial Sequence
  Synthetic
YAYGAKL

SEQ ID NO: 20420 - protein, 7 aa, Artificial Sequence
  Synthetic
SFGLHSV

SEQ ID NO: 20421 - protein, 7 aa, Artificial Sequence
  Synthetic
LYDSSRW

SEQ ID NO: 20422 - protein, 7 aa, Artificial Sequence
  Synthetic
MPVLRLP

SEQ ID NO: 20423 - protein, 7 aa, Artificial Sequence
  Synthetic
TRTCTPC

SEQ ID NO: 20424 - protein, 7 aa, Artificial Sequence
  Synthetic
EHYRKEY

SEQ ID NO: 20425 - protein, 7 aa, Artificial Sequence
  Synthetic
DRPIRGT

SEQ ID NO: 20426 - protein, 7 aa, Artificial Sequence
  Synthetic
DKVWGVV

SEQ ID NO: 20427 - protein, 7 aa, Artificial Sequence
  Synthetic
MMAYDRA

SEQ ID NO: 20428 - protein, 7 aa, Artificial Sequence
  Synthetic
FHHDKPK

SEQ ID NO: 20429 - protein, 7 aa, Artificial Sequence
  Synthetic
RQNASHS

SEQ ID NO: 20430 - protein, 7 aa, Artificial Sequence
  Synthetic
SRVEHGW

SEQ ID NO: 20431 - protein, 7 aa, Artificial Sequence
  Synthetic
IRGATGP

SEQ ID NO: 20432 - protein, 7 aa, Artificial Sequence
  Synthetic
HMIRPLA

SEQ ID NO: 20433 - protein, 7 aa, Artificial Sequence
  Synthetic
RGLGYSS

SEQ ID NO: 20434 - protein, 7 aa, Artificial Sequence
  Synthetic
EPMYSYS

SEQ ID NO: 20435 - protein, 7 aa, Artificial Sequence
  Synthetic
QHTNTWT

SEQ ID NO: 20436 - protein, 7 aa, Artificial Sequence
  Synthetic
RPEWRSD

SEQ ID NO: 20437 - protein, 7 aa, Artificial Sequence
  Synthetic
QFHGSSQ

SEQ ID NO: 20438 - protein, 7 aa, Artificial Sequence
  Synthetic
SSSWDRV

SEQ ID NO: 20439 - protein, 7 aa, Artificial Sequence
  Synthetic
FVIGAKY

SEQ ID NO: 20440 - protein, 7 aa, Artificial Sequence
  Synthetic
ERNGWSS

SEQ ID NO: 20441 - protein, 7 aa, Artificial Sequence
  Synthetic
WEARHGY

SEQ ID NO: 20442 - protein, 7 aa, Artificial Sequence
  Synthetic
GSSPGLW

SEQ ID NO: 20443 - protein, 7 aa, Artificial Sequence
  Synthetic
VYNGSVY

SEQ ID NO: 20444 - protein, 7 aa, Artificial Sequence
  Synthetic
DFSHPHR

SEQ ID NO: 20445 - protein, 7 aa, Artificial Sequence
  Synthetic
RGNPGAP

SEQ ID NO: 20446 - protein, 7 aa, Artificial Sequence
  Synthetic
NHGGRTG

SEQ ID NO: 20447 - DNA, 21 bp, Artificial Sequence
  Synthetic
actgtgccgttggggtctgcg

SEQ ID NO: 20448 - DNA, 21 bp, Artificial Sequence
  Synthetic
ggtctgctggtgggttatggt

SEQ ID NO: 20449 - DNA, 21 bp, Artificial Sequence
  Synthetic
gggtctgagattgggaggtgg

SEQ ID NO: 20450 - DNA, 21 bp, Artificial Sequence
  Synthetic
ggtgagcatgctggggtttgg

SEQ ID NO: 20451 - DNA, 21 bp, Artificial Sequence
  Synthetic
ggtgggagtttttggaaggag

SEQ ID NO: 20452 - DNA, 21 bp, Artificial Sequence
  Synthetic
gtgttgattgggagggtgggt

SEQ ID NO: 20453 - DNA, 21 bp, Artificial Sequence
  Synthetic
atgtatgggggtggttcgact

SEQ ID NO: 20454 - DNA, 21 bp, Artificial Sequence
  Synthetic
ggtgtgggggaggggaggtgg

SEQ ID NO: 20455 - DNA, 21 bp, Artificial Sequence
  Synthetic
ccgcgtattggttatagtgct

SEQ ID NO: 20456 - DNA, 21 bp, Artificial Sequence
  Synthetic
ccttggcctggtagtagtgtt

SEQ ID NO: 20457 - DNA, 21 bp, Artificial Sequence
  Synthetic
aggtgggagcgggatgcggcg

SEQ ID NO: 20458 - DNA, 21 bp, Artificial Sequence
  Synthetic
agtgttccgtatatggcttcg

SEQ ID NO: 20459 - DNA, 21 bp, Artificial Sequence
  Synthetic
ttgaagtatgggcttagttct

SEQ ID NO: 20460 - DNA, 21 bp, Artificial Sequence
  Synthetic
gggcctcatccggggcagtgg

SEQ ID NO: 20461 - DNA, 21 bp, Artificial Sequence
  Synthetic
aagccgaattctggtgtttgg

SEQ ID NO: 20462 - DNA, 21 bp, Artificial Sequence
  Synthetic
ttgaagctggggtatagtact

SEQ ID NO: 20463 - DNA, 21 bp, Artificial Sequence
  Synthetic
cttaggctgggtggtgctcag

SEQ ID NO: 20464 - DNA, 21 bp, Artificial Sequence
  Synthetic
gatgagtggaggggttcgagt

SEQ ID NO: 20465 - DNA, 21 bp, Artificial Sequence
  Synthetic
cgggctcctgggtatagtatg

SEQ ID NO: 20466 - DNA, 21 bp, Artificial Sequence
  Synthetic
tggccgttgcttatgaaggat

SEQ ID NO: 20467 - DNA, 21 bp, Artificial Sequence
  Synthetic
gggaatgatacggggcgttgg

SEQ ID NO: 20468 - DNA, 21 bp, Artificial Sequence
  Synthetic
ccgtggcagggggctgctagt

SEQ ID NO: 20469 - DNA, 21 bp, Artificial Sequence
  Synthetic
gagcggagtcatttttctagt

SEQ ID NO: 20470 - DNA, 21 bp, Artificial Sequence
  Synthetic
ggtcctgtggaggggcggtgg

SEQ ID NO: 20471 - DNA, 21 bp, Artificial Sequence
  Synthetic
agtgagtggaaggggtcggcg

SEQ ID NO: 20472 - DNA, 21 bp, Artificial Sequence
  Synthetic
tgggcgcttgggggttcgact

SEQ ID NO: 20473 - DNA, 21 bp, Artificial Sequence
  Synthetic
ctgaattatggtcatagtcag

SEQ ID NO: 20474 - DNA, 21 bp, Artificial Sequence
  Synthetic
aggtttgctggtgattcggtt

SEQ ID NO: 20475 - DNA, 21 bp, Artificial Sequence
  Synthetic
attcggattgctgagtctagt

SEQ ID NO: 20476 - DNA, 21 bp, Artificial Sequence
  Synthetic
gtgttggggtttaggcttggg

SEQ ID NO: 20477 - DNA, 21 bp, Artificial Sequence
  Synthetic
ccgcatcctcatatgagtgct

SEQ ID NO: 20478 - DNA, 21 bp, Artificial Sequence
  Synthetic
gctgggatgccggggccgtgg

SEQ ID NO: 20479 - DNA, 21 bp, Artificial Sequence
  Synthetic
cctaggattggtgcggcgcag

SEQ ID NO: 20480 - DNA, 21 bp, Artificial Sequence
  Synthetic
gttaagtatcatgttgatgtt

SEQ ID NO: 20481 - DNA, 21 bp, Artificial Sequence
  Synthetic
gtgttggttggtcgtcagggg

SEQ ID NO: 20482 - DNA, 21 bp, Artificial Sequence
  Synthetic
gggacgtctctgggtccttgg

SEQ ID NO: 20483 - DNA, 21 bp, Artificial Sequence
  Synthetic
ggtgatgtgattggtaggtgg

SEQ ID NO: 20484 - DNA, 21 bp, Artificial Sequence
  Synthetic
gattataggttgggttctacg

SEQ ID NO: 20485 - DNA, 21 bp, Artificial Sequence
  Synthetic
ttggctgttgggcagatttgg

SEQ ID NO: 20486 - DNA, 21 bp, Artificial Sequence
  Synthetic
attatgcgggggtatgctgtg

SEQ ID NO: 20487 - DNA, 21 bp, Artificial Sequence
  Synthetic
ttgcttattcatgggtcgagt

SEQ ID NO: 20488 - DNA, 21 bp, Artificial Sequence
  Synthetic
cttcgggcgggttattcggtt

SEQ ID NO: 20489 - DNA, 21 bp, Artificial Sequence
  Synthetic
atggtgggttttggttcttcg

SEQ ID NO: 20490 - DNA, 21 bp, Artificial Sequence
  Synthetic
gctggttataatagttcttat

SEQ ID NO: 20491 - DNA, 21 bp, Artificial Sequence
  Synthetic
gctgcgtttaagcttccgact

SEQ ID NO: 20492 - DNA, 21 bp, Artificial Sequence
  Synthetic
gagaagcagtatttttcggcg

SEQ ID NO: 20493 - DNA, 21 bp, Artificial Sequence
  Synthetic
gatggttgggctgggagtagt

SEQ ID NO: 20494 - DNA, 21 bp, Artificial Sequence
  Synthetic
ttgtcgatgggtttttcgcag

SEQ ID NO: 20495 - DNA, 21 bp, Artificial Sequence
  Synthetic
cttattctgaaggcgtttcct

SEQ ID NO: 20496 - DNA, 21 bp, Artificial Sequence
  Synthetic
tggtctattggtagggagggg

SEQ ID NO: 20497 - DNA, 21 bp, Artificial Sequence
  Synthetic
gtgaggtttgagggtgctagt

SEQ ID NO: 20498 - DNA, 21 bp, Artificial Sequence
  Synthetic
gtgattcctggtatgtcgcag

SEQ ID NO: 20499 - DNA, 21 bp, Artificial Sequence
  Synthetic
gctcgggagtatgggtctacg

SEQ ID NO: 20500 - DNA, 21 bp, Artificial Sequence
  Synthetic
tggctgcttagtgaggggtat

SEQ ID NO: 20501 - DNA, 21 bp, Artificial Sequence
  Synthetic
cttagggctggtactgtttat

SEQ ID NO: 20502 - DNA, 21 bp, Artificial Sequence
  Synthetic
ggggttcatcctggggtgtgg

SEQ ID NO: 20503 - DNA, 21 bp, Artificial Sequence
  Synthetic
ccgtttccggggtttagtgct

SEQ ID NO: 20504 - DNA, 21 bp, Artificial Sequence
  Synthetic
gatggtagtagtaggtggaat

SEQ ID NO: 20505 - DNA, 21 bp, Artificial Sequence
  Synthetic
gaggcgaggggttggagtacg

SEQ ID NO: 20506 - DNA, 21 bp, Artificial Sequence
  Synthetic
ccgagggttaattatagtgct

SEQ ID NO: 20507 - DNA, 21 bp, Artificial Sequence
  Synthetic
ttttcgcatgggtatagtact

SEQ ID NO: 20508 - DNA, 21 bp, Artificial Sequence
  Synthetic
gagggttttgggaggtctcag

SEQ ID NO: 20509 - DNA, 21 bp, Artificial Sequence
  Synthetic
attgatcggggttattcggtt

SEQ ID NO: 20510 - DNA, 21 bp, Artificial Sequence
  Synthetic
ccgtatactcatatggcgtcg

SEQ ID NO: 20511 - DNA, 21 bp, Artificial Sequence
  Synthetic
atgattacgttggggagtgct

SEQ ID NO: 20512 - DNA, 21 bp, Artificial Sequence
  Synthetic
tatcgggtgcttgggagtgct

SEQ ID NO: 20513 - DNA, 21 bp, Artificial Sequence
  Synthetic
gatgcgaggtggagtgctgcg

SEQ ID NO: 20514 - DNA, 21 bp, Artificial Sequence
  Synthetic
gagacgtggagggggagtgtt

SEQ ID NO: 20515 - DNA, 21 bp, Artificial Sequence
  Synthetic
cttaagcctgggtgggctcag

SEQ ID NO: 20516 - DNA, 21 bp, Artificial Sequence
  Synthetic
tatgttagtcttcctaaggtt

SEQ ID NO: 20517 - DNA, 21 bp, Artificial Sequence
  Synthetic
ttgtatccgggtttgagtagt

SEQ ID NO: 20518 - DNA, 21 bp, Artificial Sequence
  Synthetic
gaggttcataggatgcctttt

SEQ ID NO: 20519 - DNA, 21 bp, Artificial Sequence
  Synthetic
gggacttctcctggggcgtgg

SEQ ID NO: 20520 - DNA, 21 bp, Artificial Sequence
  Synthetic
attaattatagtcaggctctt

SEQ ID NO: 20521 - DNA, 21 bp, Artificial Sequence
  Synthetic
tgggatgttagtactgggtat

SEQ ID NO: 20522 - DNA, 21 bp, Artificial Sequence
  Synthetic
ggtgagtggaggggtagtgtg

SEQ ID NO: 20523 - DNA, 21 bp, Artificial Sequence
  Synthetic
atgtattcgctgggtgcgggt

SEQ ID NO: 20524 - DNA, 21 bp, Artificial Sequence
  Synthetic
gatccggggacggtgcggtgg

SEQ ID NO: 20525 - DNA, 21 bp, Artificial Sequence
  Synthetic
tggaagctttctgggtcgcag

SEQ ID NO: 20526 - DNA, 21 bp, Artificial Sequence
  Synthetic
ttgttgcatggttatactgtg

SEQ ID NO: 20527 - DNA, 21 bp, Artificial Sequence
  Synthetic
gataggatttatgggagtgcg

SEQ ID NO: 20528 - DNA, 21 bp, Artificial Sequence
  Synthetic
cttaggcctggttgggctcag

SEQ ID NO: 20529 - DNA, 21 bp, Artificial Sequence
  Synthetic
ttgtcttttcatggtagtacg

SEQ ID NO: 20530 - DNA, 21 bp, Artificial Sequence
  Synthetic
acgaagcttggttttagtcag

SEQ ID NO: 20531 - DNA, 21 bp, Artificial Sequence
  Synthetic
ccgatgagggggttttcttcg

SEQ ID NO: 20532 - DNA, 21 bp, Artificial Sequence
  Synthetic
agtgttacgaatcggtttaat

SEQ ID NO: 20533 - DNA, 21 bp, Artificial Sequence
  Synthetic
tggaagattgagactggttat

SEQ ID NO: 20534 - DNA, 21 bp, Artificial Sequence
  Synthetic
ccgtcggctaattgggcttct

SEQ ID NO: 20535 - DNA, 21 bp, Artificial Sequence
  Synthetic
tgggggtctccgcctcatagt

SEQ ID NO: 20536 - DNA, 21 bp, Artificial Sequence
  Synthetic
caggctgcgggttggagtagt

SEQ ID NO: 20537 - DNA, 21 bp, Artificial Sequence
  Synthetic
ttgattcgggggatgtctagt

SEQ ID NO: 20538 - DNA, 21 bp, Artificial Sequence
  Synthetic
gagatgaggtatgggtctact

SEQ ID NO: 20539 - DNA, 21 bp, Artificial Sequence
  Synthetic
gataagtatatgggtagtgtg

SEQ ID NO: 20540 - DNA, 21 bp, Artificial Sequence
  Synthetic
aggtttctgggtgagccgtct

SEQ ID NO: 20541 - DNA, 21 bp, Artificial Sequence
  Synthetic
aaggctgttgggtcttcgtgg

SEQ ID NO: 20542 - DNA, 21 bp, Artificial Sequence
  Synthetic
atgtttgctggtcagagtagt

SEQ ID NO: 20543 - DNA, 21 bp, Artificial Sequence
  Synthetic
tcgcgtgaggggtggagtact

SEQ ID NO: 20544 - DNA, 21 bp, Artificial Sequence
  Synthetic
tggcaggtgcatggttctgct

SEQ ID NO: 20545 - DNA, 21 bp, Artificial Sequence
  Synthetic
attctgttgggtcgtgtgggt

SEQ ID NO: 20546 - DNA, 21 bp, Artificial Sequence
  Synthetic
gattatagggggtattcgact

SEQ ID NO: 20547 - DNA, 21 bp, Artificial Sequence
  Synthetic
tggatgaatggtggggcgcag

SEQ ID NO: 20548 - DNA, 21 bp, Artificial Sequence
  Synthetic
ccgagggctgggtattctatg

SEQ ID NO: 20549 - DNA, 21 bp, Artificial Sequence
  Synthetic
gtttgggggtcgctggggccg

SEQ ID NO: 20550 - DNA, 21 bp, Artificial Sequence
  Synthetic
acgtttgctttggggtcggct

SEQ ID NO: 20551 - DNA, 21 bp, Artificial Sequence
  Synthetic
gttcgtacggggtcgatttat

SEQ ID NO: 20552 - DNA, 21 bp, Artificial Sequence
  Synthetic
aagttgtctacggagtattgg

SEQ ID NO: 20553 - DNA, 21 bp, Artificial Sequence
  Synthetic
gtgatttttcatgggagtgct

SEQ ID NO: 20554 - DNA, 21 bp, Artificial Sequence
  Synthetic
tggtttcagcatggggctgcg

SEQ ID NO: 20555 - DNA, 21 bp, Artificial Sequence
  Synthetic
agtcgtattgtgttgactaat

SEQ ID NO: 20556 - DNA, 21 bp, Artificial Sequence
  Synthetic
cttaagtttatgcttagggat

SEQ ID NO: 20557 - DNA, 21 bp, Artificial Sequence
  Synthetic
catgtggggtgggggtcggcg

SEQ ID NO: 20558 - DNA, 21 bp, Artificial Sequence
  Synthetic
ggttggccgggtgggtcttcg

SEQ ID NO: 20559 - DNA, 21 bp, Artificial Sequence
  Synthetic
atttatgcgggttttaatgag

SEQ ID NO: 20560 - DNA, 21 bp, Artificial Sequence
  Synthetic
gggacgaatgtgggtatttgg

SEQ ID NO: 20561 - DNA, 21 bp, Artificial Sequence
  Synthetic
atgatttatcagggttcttct

SEQ ID NO: 20562 - DNA, 21 bp, Artificial Sequence
  Synthetic
ttggttgttgctcagagtagt

SEQ ID NO: 20563 - DNA, 21 bp, Artificial Sequence
  Synthetic
cttgctcgggggagtgtttat

SEQ ID NO: 20564 - DNA, 21 bp, Artificial Sequence
  Synthetic
ctttggcagggtgggagttcg

SEQ ID NO: 20565 - DNA, 21 bp, Artificial Sequence
  Synthetic
gagtcggggggtgctcgttgg

SEQ ID NO: 20566 - DNA, 21 bp, Artificial Sequence
  Synthetic
ttgccgttgcgtttgaatatt

SEQ ID NO: 20567 - DNA, 21 bp, Artificial Sequence
  Synthetic
tcgcattggggtgggagttcg

SEQ ID NO: 20568 - DNA, 21 bp, Artificial Sequence
  Synthetic
gaggggccttttcagtcttct

SEQ ID NO: 20569 - DNA, 21 bp, Artificial Sequence
  Synthetic
cctgctcctgggtggtcgtcg

SEQ ID NO: 20570 - DNA, 21 bp, Artificial Sequence
  Synthetic
tggcggctggaggggagtacg

SEQ ID NO: 20571 - DNA, 21 bp, Artificial Sequence
  Synthetic
tttggtagtctttcgcagttt

SEQ ID NO: 20572 - DNA, 21 bp, Artificial Sequence
  Synthetic
ttgaagtatcatttgggggat

SEQ ID NO: 20573 - DNA, 21 bp, Artificial Sequence
  Synthetic
ggttctgaggctgggaggtgg

SEQ ID NO: 20574 - DNA, 21 bp, Artificial Sequence
  Synthetic
acttcggttggtacgatttat

SEQ ID NO: 20575 - DNA, 21 bp, Artificial Sequence
  Synthetic
cctaggattgtgcttaataat

SEQ ID NO: 20576 - DNA, 21 bp, Artificial Sequence
  Synthetic
tctgtgcgtttggggagttct

SEQ ID NO: 20577 - DNA, 21 bp, Artificial Sequence
  Synthetic
tggtcgcttaattctgggcat

SEQ ID NO: 20578 - DNA, 21 bp, Artificial Sequence
  Synthetic
acgtatctggggcaggcgtcg

SEQ ID NO: 20579 - DNA, 21 bp, Artificial Sequence
  Synthetic
ggtcgtgagaatacttggact

SEQ ID NO: 20580 - DNA, 21 bp, Artificial Sequence
  Synthetic
gttgagtttaagcttcctcat

SEQ ID NO: 20581 - DNA, 21 bp, Artificial Sequence
  Synthetic
tggatggttgggggttcggcg

SEQ ID NO: 20582 - DNA, 21 bp, Artificial Sequence
  Synthetic
gggcataatagtgggatgtgg

SEQ ID NO: 20583 - DNA, 21 bp, Artificial Sequence
  Synthetic
tttaggacgcttgggagtgcg

SEQ ID NO: 20584 - DNA, 21 bp, Artificial Sequence
  Synthetic
tggggttctcttgagagtctg

SEQ ID NO: 20585 - DNA, 21 bp, Artificial Sequence
  Synthetic
tgggcgtatcagggttctgct

SEQ ID NO: 20586 - DNA, 21 bp, Artificial Sequence
  Synthetic
ttgggtagtatgtttagtatg

SEQ ID NO: 20587 - DNA, 21 bp, Artificial Sequence
  Synthetic
attcttggtgggtatacgatt

SEQ ID NO: 20588 - DNA, 21 bp, Artificial Sequence
  Synthetic
gtgactacttcgcgttgggat

SEQ ID NO: 20589 - DNA, 21 bp, Artificial Sequence
  Synthetic
gagactcctgttgggcgttgg

SEQ ID NO: 20590 - DNA, 21 bp, Artificial Sequence
  Synthetic
gagttttatggtggttcggtt

SEQ ID NO: 20591 - DNA, 21 bp, Artificial Sequence
  Synthetic
tttgatcatccgggtgtttgg

SEQ ID NO: 20592 - DNA, 21 bp, Artificial Sequence
  Synthetic
ggggtggataggggtgtgtgg

SEQ ID NO: 20593 - DNA, 21 bp, Artificial Sequence
  Synthetic
tgttttcctcgtcatgagtgt

SEQ ID NO: 20594 - DNA, 21 bp, Artificial Sequence
  Synthetic
catgtgccgtatgggagtact

SEQ ID NO: 20595 - DNA, 21 bp, Artificial Sequence
  Synthetic
acgtggcagggtggtgctcag

SEQ ID NO: 20596 - DNA, 21 bp, Artificial Sequence
  Synthetic
gggtctgatgcggcgcgttgg

SEQ ID NO: 20597 - DNA, 21 bp, Artificial Sequence
  Synthetic
attgcgaagggttattctcag

SEQ ID NO: 20598 - DNA, 21 bp, Artificial Sequence
  Synthetic
atgatgtatcaggggtctgcg

SEQ ID NO: 20599 - DNA, 21 bp, Artificial Sequence
  Synthetic
tttggtagtttgtctattgtg

SEQ ID NO: 20600 - DNA, 21 bp, Artificial Sequence
  Synthetic
gcgtggtctcatggtgctagt

SEQ ID NO: 20601 - DNA, 21 bp, Artificial Sequence
  Synthetic
aaggtttcttatggtagtgcg

SEQ ID NO: 20602 - DNA, 21 bp, Artificial Sequence
  Synthetic
atgcgtgtgggggcggcgcag

SEQ ID NO: 20603 - DNA, 21 bp, Artificial Sequence
  Synthetic
ctgtctgtggggcgtgtttat

SEQ ID NO: 20604 - DNA, 21 bp, Artificial Sequence
  Synthetic
gattgggctagggggagtacg

SEQ ID NO: 20605 - DNA, 21 bp, Artificial Sequence
  Synthetic
cgtagtattggtagtgtgtat

SEQ ID NO: 20606 - DNA, 21 bp, Artificial Sequence
  Synthetic
atgcggactcttggttctact

SEQ ID NO: 20607 - DNA, 21 bp, Artificial Sequence
  Synthetic
actattacgaattatcatgtg

SEQ ID NO: 20608 - DNA, 21 bp, Artificial Sequence
  Synthetic
ttgggtattatgaatgtggtg

SEQ ID NO: 20609 - DNA, 21 bp, Artificial Sequence
  Synthetic
gctttttttagtggtagtgcg

SEQ ID NO: 20610 - DNA, 21 bp, Artificial Sequence
  Synthetic
cgtgataagggttcggtgtat

SEQ ID NO: 20611 - DNA, 21 bp, Artificial Sequence
  Synthetic
cagagggtggggtttagttct

SEQ ID NO: 20612 - DNA, 21 bp, Artificial Sequence
  Synthetic
tttgggagtctgcatcttgtt

SEQ ID NO: 20613 - DNA, 21 bp, Artificial Sequence
  Synthetic
gcgagttggcagggttcttcg

SEQ ID NO: 20614 - DNA, 21 bp, Artificial Sequence
  Synthetic
attagttttggtggggcgcag

SEQ ID NO: 20615 - DNA, 21 bp, Artificial Sequence
  Synthetic
tggagtgtggggcgtgagggg

SEQ ID NO: 20616 - DNA, 21 bp, Artificial Sequence
  Synthetic
ggggagacgcggcatgtgtgg

SEQ ID NO: 20617 - DNA, 21 bp, Artificial Sequence
  Synthetic
cttaagtcgggtttttcgatg

SEQ ID NO: 20618 - DNA, 21 bp, Artificial Sequence
  Synthetic
aggccgtatactgttgatgtg

SEQ ID NO: 20619 - DNA, 21 bp, Artificial Sequence
  Synthetic
tggagggatatggggtctacg

SEQ ID NO: 20620 - DNA, 21 bp, Artificial Sequence
  Synthetic
ggtgatcgtttgggggtttgg

SEQ ID NO: 20621 - DNA, 21 bp, Artificial Sequence
  Synthetic
gttgctttgggttatagttcg

SEQ ID NO: 20622 - DNA, 21 bp, Artificial Sequence
  Synthetic
ggggatcctgctgggcggtgg

SEQ ID NO: 20623 - DNA, 21 bp, Artificial Sequence
  Synthetic
aagttggggtctggtgtgtgg

SEQ ID NO: 20624 - DNA, 21 bp, Artificial Sequence
  Synthetic
ggtcattctgttggtccgtgg

SEQ ID NO: 20625 - DNA, 21 bp, Artificial Sequence
  Synthetic
ttgtggccgggtcagtctagt

SEQ ID NO: 20626 - DNA, 21 bp, Artificial Sequence
  Synthetic
attcggtatgcggttgatgtt

SEQ ID NO: 20627 - DNA, 21 bp, Artificial Sequence
  Synthetic
cagatggattctgggaggtgg

SEQ ID NO: 20628 - DNA, 21 bp, Artificial Sequence
  Synthetic
tgggcgcatatgggttctgct

SEQ ID NO: 20629 - DNA, 21 bp, Artificial Sequence
  Synthetic
tataggacgatgggtagttcg

SEQ ID NO: 20630 - DNA, 21 bp, Artificial Sequence
  Synthetic
tttcagcggctgggttcgtct

SEQ ID NO: 20631 - DNA, 21 bp, Artificial Sequence
  Synthetic
agtgcgcggcttgggtctacg

SEQ ID NO: 20632 - DNA, 21 bp, Artificial Sequence
  Synthetic
atggctactggttggtcgtcg

SEQ ID NO: 20633 - DNA, 21 bp, Artificial Sequence
  Synthetic
cggtatatgggtgattctgtt

SEQ ID NO: 20634 - DNA, 21 bp, Artificial Sequence
  Synthetic
ctgcgtgcgggtctggctcag

SEQ ID NO: 20635 - DNA, 21 bp, Artificial Sequence
  Synthetic
atggtggagtatgggagtgct

SEQ ID NO: 20636 - DNA, 21 bp, Artificial Sequence
  Synthetic
gagcgggcggggtattcgtcg

SEQ ID NO: 20637 - DNA, 21 bp, Artificial Sequence
  Synthetic
tctcattttggtatggcgcag

SEQ ID NO: 20638 - DNA, 21 bp, Artificial Sequence
  Synthetic
gtggcgagggggtatagttct

SEQ ID NO: 20639 - DNA, 21 bp, Artificial Sequence
  Synthetic
gggtctaatactggtgtgtgg

SEQ ID NO: 20640 - DNA, 21 bp, Artificial Sequence
  Synthetic
gtgtctaagtatcaggattgg

SEQ ID NO: 20641 - DNA, 21 bp, Artificial Sequence
  Synthetic
atgtatatgccggcgagttct

SEQ ID NO: 20642 - DNA, 21 bp, Artificial Sequence
  Synthetic
gttactccggggtcgtattgg

SEQ ID NO: 20643 - DNA, 21 bp, Artificial Sequence
  Synthetic
ttgagttatggtatgtcgagt

SEQ ID NO: 20644 - DNA, 21 bp, Artificial Sequence
  Synthetic
gagaagttgtatggttcgacg

SEQ ID NO: 20645 - DNA, 21 bp, Artificial Sequence
  Synthetic
cagggtgatgttgggcggtgg

SEQ ID NO: 20646 - DNA, 21 bp, Artificial Sequence
  Synthetic
tttgcgctgaatctgaggcct

SEQ ID NO: 20647 - DNA, 21 bp, Artificial Sequence
  Synthetic
atggttgttcatggtagtagt

SEQ ID NO: 20648 - DNA, 21 bp, Artificial Sequence
  Synthetic
catcatactatggggtctgct

SEQ ID NO: 20649 - DNA, 21 bp, Artificial Sequence
  Synthetic
ccgagggttggtttttcttct

SEQ ID NO: 20650 - DNA, 21 bp, Artificial Sequence
  Synthetic
gggtggcatggggggtctagt

SEQ ID NO: 20651 - DNA, 21 bp, Artificial Sequence
  Synthetic
ttgaggactgggtatgcgatg

SEQ ID NO: 20652 - DNA, 21 bp, Artificial Sequence
  Synthetic
gagcctgcttggtcttcttct

SEQ ID NO: 20653 - DNA, 21 bp, Artificial Sequence
  Synthetic
tggcgtgagctttattcgtcg

SEQ ID NO: 20654 - DNA, 21 bp, Artificial Sequence
  Synthetic
aagatgaatagtgggatttgg

SEQ ID NO: 20655 - DNA, 21 bp, Artificial Sequence
  Synthetic
cttagggctttggggtcgagt

SEQ ID NO: 20656 - DNA, 21 bp, Artificial Sequence
  Synthetic
gattataatggtggtcgttgg

SEQ ID NO: 20657 - DNA, 21 bp, Artificial Sequence
  Synthetic
ccgtctaatttggctaggttt

SEQ ID NO: 20658 - DNA, 21 bp, Artificial Sequence
  Synthetic
tgggcgcatcatgggtcgcag

SEQ ID NO: 20659 - DNA, 21 bp, Artificial Sequence
  Synthetic
atttatgttggtagttctact

SEQ ID NO: 20660 - DNA, 21 bp, Artificial Sequence
  Synthetic
cctcagtggggggctgcgacg

SEQ ID NO: 20661 - DNA, 21 bp, Artificial Sequence
  Synthetic
ttgaggccggggtatagttcg

SEQ ID NO: 20662 - DNA, 21 bp, Artificial Sequence
  Synthetic
tatgatttttctggtgatcgg

SEQ ID NO: 20663 - DNA, 21 bp, Artificial Sequence
  Synthetic
gatgagaggattaatcggtgg

SEQ ID NO: 20664 - DNA, 21 bp, Artificial Sequence
  Synthetic
ggggagtcgtcggggcgttgg

SEQ ID NO: 20665 - DNA, 21 bp, Artificial Sequence
  Synthetic
agttggagtggtcttcgtgag

SEQ ID NO: 20666 - DNA, 21 bp, Artificial Sequence
  Synthetic
ctttggaagggtgatgcttcg

SEQ ID NO: 20667 - DNA, 21 bp, Artificial Sequence
  Synthetic
gatccgtctagtgctcggtgg

SEQ ID NO: 20668 - DNA, 21 bp, Artificial Sequence
  Synthetic
tggcggccgcttggtgcggcg

SEQ ID NO: 20669 - DNA, 21 bp, Artificial Sequence
  Synthetic
gtgtatcaggggtcggtgtat

SEQ ID NO: 20670 - DNA, 21 bp, Artificial Sequence
  Synthetic
cctgagcattcttatcggtat

SEQ ID NO: 20671 - DNA, 21 bp, Artificial Sequence
  Synthetic
atggggagtatgttttcttcg

SEQ ID NO: 20672 - DNA, 21 bp, Artificial Sequence
  Synthetic
ggtattgagaaggggtattgg

SEQ ID NO: 20673 - DNA, 21 bp, Artificial Sequence
  Synthetic
acgtgggggagtcttggtgct

SEQ ID NO: 20674 - DNA, 21 bp, Artificial Sequence
  Synthetic
gggccgacggtgggtcattgg

SEQ ID NO: 20675 - DNA, 21 bp, Artificial Sequence
  Synthetic
aggtatactggggagagtacg

SEQ ID NO: 20676 - DNA, 21 bp, Artificial Sequence
  Synthetic
acgtggcatggtgcttcttct

SEQ ID NO: 20677 - DNA, 21 bp, Artificial Sequence
  Synthetic
catggtcttgggttttcgagt

SEQ ID NO: 20678 - DNA, 21 bp, Artificial Sequence
  Synthetic
cgttattatgaggggagtagt

SEQ ID NO: 20679 - DNA, 21 bp, Artificial Sequence
  Synthetic
gtgtatctggggggttctcag

SEQ ID NO: 20680 - DNA, 21 bp, Artificial Sequence
  Synthetic
tctccggttcctcatggttgg

SEQ ID NO: 20681 - DNA, 21 bp, Artificial Sequence
  Synthetic
agtgcttggcaggggagtgct

SEQ ID NO: 20682 - DNA, 21 bp, Artificial Sequence
  Synthetic
gtgcgtagtggttatagttct

SEQ ID NO: 20683 - DNA, 21 bp, Artificial Sequence
  Synthetic
tggaagcagatggggtcggct

SEQ ID NO: 20684 - DNA, 21 bp, Artificial Sequence
  Synthetic
aagctttataatgggagtatt

SEQ ID NO: 20685 - DNA, 21 bp, Artificial Sequence
  Synthetic
tatgggacgtttattactcgt

SEQ ID NO: 20686 - DNA, 21 bp, Artificial Sequence
  Synthetic
agtaggccgggtttttcgatg

SEQ ID NO: 20687 - DNA, 21 bp, Artificial Sequence
  Synthetic
gtgaagtttgggcaggcgcag

SEQ ID NO: 20688 - DNA, 21 bp, Artificial Sequence
  Synthetic
tctccgcatgatgcgaggtgg

SEQ ID NO: 20689 - DNA, 21 bp, Artificial Sequence
  Synthetic
gatcgttatattggtagttcg

SEQ ID NO: 20690 - DNA, 21 bp, Artificial Sequence
  Synthetic
agtattctggagggttatcgt

SEQ ID NO: 20691 - DNA, 21 bp, Artificial Sequence
  Synthetic
ccggagtataagttgccgacg

SEQ ID NO: 20692 - DNA, 21 bp, Artificial Sequence
  Synthetic
ctgtatcctggtagttcgatg

SEQ ID NO: 20693 - DNA, 21 bp, Artificial Sequence
  Synthetic
tgggcgaagattgggagtgct

SEQ ID NO: 20694 - DNA, 21 bp, Artificial Sequence
  Synthetic
tggtctttgccttctcatggt

SEQ ID NO: 20695 - DNA, 21 bp, Artificial Sequence
  Synthetic
actgtttatcttgggtctgtg

SEQ ID NO: 20696 - DNA, 21 bp, Artificial Sequence
  Synthetic
aagtctgtgtataatgattgg

SEQ ID NO: 20697 - DNA, 21 bp, Artificial Sequence
  Synthetic
ggttcggatctggggcggtgg

SEQ ID NO: 20698 - DNA, 21 bp, Artificial Sequence
  Synthetic
tatgctagtttggctccgtat

SEQ ID NO: 20699 - DNA, 21 bp, Artificial Sequence
  Synthetic
tttggtttgttggatcggatt

SEQ ID NO: 20700 - DNA, 21 bp, Artificial Sequence
  Synthetic
cggaagtgggagttgccggat

SEQ ID NO: 20701 - DNA, 21 bp, Artificial Sequence
  Synthetic
cctaagattagttatagtgct

SEQ ID NO: 20702 - DNA, 21 bp, Artificial Sequence
  Synthetic
cagagtgattatagtcagtgg

SEQ ID NO: 20703 - DNA, 21 bp, Artificial Sequence
  Synthetic
cgtgggagtcttgggccgatg

SEQ ID NO: 20704 - DNA, 21 bp, Artificial Sequence
  Synthetic
ttgaagacgggtttttcttct

SEQ ID NO: 20705 - DNA, 21 bp, Artificial Sequence
  Synthetic
gagctgactggggctcgttgg

SEQ ID NO: 20706 - DNA, 21 bp, Artificial Sequence
  Synthetic
cgtgtttatgaggggtatcat

SEQ ID NO: 20707 - DNA, 21 bp, Artificial Sequence
  Synthetic
tggcggtctgggggtagtcag

SEQ ID NO: 20708 - DNA, 21 bp, Artificial Sequence
  Synthetic
ttgaagcagggttggtctgcg

SEQ ID NO: 20709 - DNA, 21 bp, Artificial Sequence
  Synthetic
aggattcctggtctttctagt

SEQ ID NO: 20710 - DNA, 21 bp, Artificial Sequence
  Synthetic
attggttattcggttggtctt

SEQ ID NO: 20711 - DNA, 21 bp, Artificial Sequence
  Synthetic
tggaagttggagtcggggttt

SEQ ID NO: 20712 - DNA, 21 bp, Artificial Sequence
  Synthetic
gtgcgtctgatgggttctact

SEQ ID NO: 20713 - DNA, 21 bp, Artificial Sequence
  Synthetic
ggtttgagtactagtatgtgg

SEQ ID NO: 20714 - DNA, 21 bp, Artificial Sequence
  Synthetic
cctggtacgggtggtcattgg

SEQ ID NO: 20715 - DNA, 21 bp, Artificial Sequence
  Synthetic
tatttgaggggttggagtgag

SEQ ID NO: 20716 - DNA, 21 bp, Artificial Sequence
  Synthetic
gctactgttgctcatggttgg

SEQ ID NO: 20717 - DNA, 21 bp, Artificial Sequence
  Synthetic
gataggacgccggggctgtgg

SEQ ID NO: 20718 - DNA, 21 bp, Artificial Sequence
  Synthetic
tcggtgtcttggggtagtgct

SEQ ID NO: 20719 - DNA, 21 bp, Artificial Sequence
  Synthetic
actaagacggggtatagtagt

SEQ ID NO: 20720 - DNA, 21 bp, Artificial Sequence
  Synthetic
gatgttccgtctgggaggtgg

SEQ ID NO: 20721 - DNA, 21 bp, Artificial Sequence
  Synthetic
tatggtatgttgtcggcgatt

SEQ ID NO: 20722 - DNA, 21 bp, Artificial Sequence
  Synthetic
cgtgggtctttgggtcctctt

SEQ ID NO: 20723 - DNA, 21 bp, Artificial Sequence
  Synthetic
atgagttatcatgggtcgagt

SEQ ID NO: 20724 - DNA, 21 bp, Artificial Sequence
  Synthetic
atgccgggtgatgggcggtgg

SEQ ID NO: 20725 - DNA, 21 bp, Artificial Sequence
  Synthetic
tggtttacttctgggtcggcg

SEQ ID NO: 20726 - DNA, 21 bp, Artificial Sequence
  Synthetic
gctcctagtctgaggtatgtt

SEQ ID NO: 20727 - DNA, 21 bp, Artificial Sequence
  Synthetic
attgctttgggttatagtgct

SEQ ID NO: 20728 - DNA, 21 bp, Artificial Sequence
  Synthetic
cctaggcctgcttatgctgct

SEQ ID NO: 20729 - DNA, 21 bp, Artificial Sequence
  Synthetic
cataagactcttgggagtgct

SEQ ID NO: 20730 - DNA, 21 bp, Artificial Sequence
  Synthetic
gcgcagattgggtggtcgagt

SEQ ID NO: 20731 - DNA, 21 bp, Artificial Sequence
  Synthetic
ttgagggagaattggtcttcg

SEQ ID NO: 20732 - DNA, 21 bp, Artificial Sequence
  Synthetic
ggtttttcgaggtgggctgag

SEQ ID NO: 20733 - DNA, 21 bp, Artificial Sequence
  Synthetic
tggggggtgttgagtgcgatt

SEQ ID NO: 20734 - DNA, 21 bp, Artificial Sequence
  Synthetic
attactcggggtactgtttat

SEQ ID NO: 20735 - DNA, 21 bp, Artificial Sequence
  Synthetic
ctggtgtatggtgctgctcag

SEQ ID NO: 20736 - DNA, 21 bp, Artificial Sequence
  Synthetic
atgattacgtatgggagttct

SEQ ID NO: 20737 - DNA, 21 bp, Artificial Sequence
  Synthetic
cgggtggagatgggtagttgg

SEQ ID NO: 20738 - DNA, 21 bp, Artificial Sequence
  Synthetic
agtgtgccggggtggtcggcg

SEQ ID NO: 20739 - DNA, 21 bp, Artificial Sequence
  Synthetic
attggttcgctggagaggtgg

SEQ ID NO: 20740 - DNA, 21 bp, Artificial Sequence
  Synthetic
aagattcttttgactcctgtg

SEQ ID NO: 20741 - DNA, 21 bp, Artificial Sequence
  Synthetic
gagcgtgttaattggtctgtt

SEQ ID NO: 20742 - DNA, 21 bp, Artificial Sequence
  Synthetic
attgtgcagtttgggtctgcg

SEQ ID NO: 20743 - DNA, 21 bp, Artificial Sequence
  Synthetic
cgttttgctggtgatgcttcg

SEQ ID NO: 20744 - DNA, 21 bp, Artificial Sequence
  Synthetic
cttatgcagtatgggtcgtcg

SEQ ID NO: 20745 - DNA, 21 bp, Artificial Sequence
  Synthetic
cttgtgccgcatggttggagt

SEQ ID NO: 20746 - DNA, 21 bp, Artificial Sequence
  Synthetic
gataggattctggggagtacg

SEQ ID NO: 20747 - DNA, 21 bp, Artificial Sequence
  Synthetic
tgggaggtgacgactggttat

SEQ ID NO: 20748 - DNA, 21 bp, Artificial Sequence
  Synthetic
ggggctgatatttctaggtgg

SEQ ID NO: 20749 - DNA, 21 bp, Artificial Sequence
  Synthetic
ttttatcggccggctggtgct

SEQ ID NO: 20750 - DNA, 21 bp, Artificial Sequence
  Synthetic
gggggttcgccgggtcagtgg

SEQ ID NO: 20751 - DNA, 21 bp, Artificial Sequence
  Synthetic
tggcgtattggtgggtcggct

SEQ ID NO: 20752 - DNA, 21 bp, Artificial Sequence
  Synthetic
ttgcatgctggttttagtagt

SEQ ID NO: 20753 - DNA, 21 bp, Artificial Sequence
  Synthetic
ctgaaggctaattattctagt

SEQ ID NO: 20754 - DNA, 21 bp, Artificial Sequence
  Synthetic
cgtttttttgaggggagtagt

SEQ ID NO: 20755 - DNA, 21 bp, Artificial Sequence
  Synthetic
ttggtgcagtatgggtcggct

SEQ ID NO: 20756 - DNA, 21 bp, Artificial Sequence
  Synthetic
ccgggttctcctggtccgtgg

SEQ ID NO: 20757 - DNA, 21 bp, Artificial Sequence
  Synthetic
gagcgtatgctggggagttct

SEQ ID NO: 20758 - DNA, 21 bp, Artificial Sequence
  Synthetic
gttaggacgtgggagtcttct

SEQ ID NO: 20759 - DNA, 21 bp, Artificial Sequence
  Synthetic
ctgagtattgggtggtctagt

SEQ ID NO: 20760 - DNA, 21 bp, Artificial Sequence
  Synthetic
tggccttatgggaaggagaat

SEQ ID NO: 20761 - DNA, 21 bp, Artificial Sequence
  Synthetic
tggggtagtatgtttagttct

SEQ ID NO: 20762 - DNA, 21 bp, Artificial Sequence
  Synthetic
ccgcggcttgggatgagttcg

SEQ ID NO: 20763 - DNA, 21 bp, Artificial Sequence
  Synthetic
ccttggccttctgcggctagt

SEQ ID NO: 20764 - DNA, 21 bp, Artificial Sequence
  Synthetic
catgtggagtgggggtcgtcg

SEQ ID NO: 20765 - DNA, 21 bp, Artificial Sequence
  Synthetic
gataagctttttgggtcggcg

SEQ ID NO: 20766 - DNA, 21 bp, Artificial Sequence
  Synthetic
tggagtgctagtactggttat

SEQ ID NO: 20767 - DNA, 21 bp, Artificial Sequence
  Synthetic
gtgcgttctggtttggctcag

SEQ ID NO: 20768 - DNA, 21 bp, Artificial Sequence
  Synthetic
tatcgtgagtatcctgaggtt

SEQ ID NO: 20769 - DNA, 21 bp, Artificial Sequence
  Synthetic
atgcagcggcttgggagtgcg

SEQ ID NO: 20770 - DNA, 21 bp, Artificial Sequence
  Synthetic
cgttatttgggggataatatt

SEQ ID NO: 20771 - DNA, 21 bp, Artificial Sequence
  Synthetic
cctcgggtgccgaatgcgtgg

SEQ ID NO: 20772 - DNA, 21 bp, Artificial Sequence
  Synthetic
tggggttataggattactgat

SEQ ID NO: 20773 - DNA, 21 bp, Artificial Sequence
  Synthetic
gttcatcttggtttttcgtcg

SEQ ID NO: 20774 - DNA, 21 bp, Artificial Sequence
  Synthetic
gatggtactgttgggcggtgg

SEQ ID NO: 20775 - DNA, 21 bp, Artificial Sequence
  Synthetic
ctgtctgtggggcgggtttat

SEQ ID NO: 20776 - DNA, 21 bp, Artificial Sequence
  Synthetic
ttgcgggtgaattatgctagt

SEQ ID NO: 20777 - DNA, 21 bp, Artificial Sequence
  Synthetic
cttgagagtaggtttagtact

SEQ ID NO: 20778 - DNA, 21 bp, Artificial Sequence
  Synthetic
tggtctcatttggggagtgct

SEQ ID NO: 20779 - DNA, 21 bp, Artificial Sequence
  Synthetic
agtacttggggggcggcgcag

SEQ ID NO: 20780 - DNA, 21 bp, Artificial Sequence
  Synthetic
ccgccgaattctgctgcgtgg

SEQ ID NO: 20781 - DNA, 21 bp, Artificial Sequence
  Synthetic
ctgggtcatgggtggtctcag

SEQ ID NO: 20782 - DNA, 21 bp, Artificial Sequence
  Synthetic
atgtatcttccgcagtcgagt

SEQ ID NO: 20783 - DNA, 21 bp, Artificial Sequence
  Synthetic
agggagatgggttcgatttat

SEQ ID NO: 20784 - DNA, 21 bp, Artificial Sequence
  Synthetic
ccgtttcctgggtatggtgcg

SEQ ID NO: 20785 - DNA, 21 bp, Artificial Sequence
  Synthetic
aatattaggttggggtatagt

SEQ ID NO: 20786 - DNA, 21 bp, Artificial Sequence
  Synthetic
gcggtttatatggggtctgtt

SEQ ID NO: 20787 - DNA, 21 bp, Artificial Sequence
  Synthetic
ttgcattatagtgaggggttg

SEQ ID NO: 20788 - DNA, 21 bp, Artificial Sequence
  Synthetic
atgtatattcgggatgcgtcg

SEQ ID NO: 20789 - DNA, 21 bp, Artificial Sequence
  Synthetic
tggagggatcggggtagtgcg

SEQ ID NO: 20790 - DNA, 21 bp, Artificial Sequence
  Synthetic
ctgttgagttttggtagtagt

SEQ ID NO: 20791 - DNA, 21 bp, Artificial Sequence
  Synthetic
gagaggaattatgggagtgcg

SEQ ID NO: 20792 - DNA, 21 bp, Artificial Sequence
  Synthetic
acggcgcgtctggggagtacg

SEQ ID NO: 20793 - DNA, 21 bp, Artificial Sequence
  Synthetic
gtgtatgctggttggagggag

SEQ ID NO: 20794 - DNA, 21 bp, Artificial Sequence
  Synthetic
gcgcagtatatgggtagttct

SEQ ID NO: 20795 - DNA, 21 bp, Artificial Sequence
  Synthetic
tcgagggcgggttatagtatg

SEQ ID NO: 20796 - DNA, 21 bp, Artificial Sequence
  Synthetic
acgatgacgaggggtagttct

SEQ ID NO: 20797 - DNA, 21 bp, Artificial Sequence
  Synthetic
tggcatagtctgcagaatccg

SEQ ID NO: 20798 - DNA, 21 bp, Artificial Sequence
  Synthetic
tggcgttcgcttcctgagttg

SEQ ID NO: 20799 - DNA, 21 bp, Artificial Sequence
  Synthetic
tggtatgttgctggtagtgct

SEQ ID NO: 20800 - DNA, 21 bp, Artificial Sequence
  Synthetic
tggtctatgcatggtagtact

SEQ ID NO: 20801 - DNA, 21 bp, Artificial Sequence
  Synthetic
cgttatatgggtgatgcgtcg

SEQ ID NO: 20802 - DNA, 21 bp, Artificial Sequence
  Synthetic
tggcgtgttgcgggttcggct

SEQ ID NO: 20803 - DNA, 21 bp, Artificial Sequence
  Synthetic
cgtgttccggggttttcttcg

SEQ ID NO: 20804 - DNA, 21 bp, Artificial Sequence
  Synthetic
gttattccgggttggtcttct

SEQ ID NO: 20805 - DNA, 21 bp, Artificial Sequence
  Synthetic
gagtatggtggtgggaagttt

SEQ ID NO: 20806 - DNA, 21 bp, Artificial Sequence
  Synthetic
agtttgactggtcggctgtat

SEQ ID NO: 20807 - DNA, 21 bp, Artificial Sequence
  Synthetic
tatgcgcttgagggtgatcgt

SEQ ID NO: 20808 - DNA, 21 bp, Artificial Sequence
  Synthetic
cttatgcgtggttttagtacg

SEQ ID NO: 20809 - DNA, 21 bp, Artificial Sequence
  Synthetic
tggattcttccgtcggggggg

SEQ ID NO: 20810 - DNA, 21 bp, Artificial Sequence
  Synthetic
tcgatgtatcatgggagttcg

SEQ ID NO: 20811 - DNA, 21 bp, Artificial Sequence
  Synthetic
ctgattagttatgggagtacg

SEQ ID NO: 20812 - DNA, 21 bp, Artificial Sequence
  Synthetic
gaggcgggggtgactcgttgg

SEQ ID NO: 20813 - DNA, 21 bp, Artificial Sequence
  Synthetic
tgggtggggcatgggtcgtct

SEQ ID NO: 20814 - DNA, 21 bp, Artificial Sequence
  Synthetic
gttcatgttgggagtgtttat

SEQ ID NO: 20815 - DNA, 21 bp, Artificial Sequence
  Synthetic
ctggttgttcctatggcgagt

SEQ ID NO: 20816 - DNA, 21 bp, Artificial Sequence
  Synthetic
gctgcgattgggagtatttat

SEQ ID NO: 20817 - DNA, 21 bp, Artificial Sequence
  Synthetic
ttgcagcctggttggagtact

SEQ ID NO: 20818 - DNA, 21 bp, Artificial Sequence
  Synthetic
ttggagcgttatgggtcttcg

SEQ ID NO: 20819 - DNA, 21 bp, Artificial Sequence
  Synthetic
actattgtggggttttcttcg

SEQ ID NO: 20820 - DNA, 21 bp, Artificial Sequence
  Synthetic
gttcgtgcgggtttttcttct

SEQ ID NO: 20821 - DNA, 21 bp, Artificial Sequence
  Synthetic
tgggatgttaagtcggggttt

SEQ ID NO: 20822 - DNA, 21 bp, Artificial Sequence
  Synthetic
tatttgagtgggtatacgagt

SEQ ID NO: 20823 - DNA, 21 bp, Artificial Sequence
  Synthetic
aaggtggctagtcagtcttgg

SEQ ID NO: 20824 - DNA, 21 bp, Artificial Sequence
  Synthetic
tgggttattggtgggtcgaag

SEQ ID NO: 20825 - DNA, 21 bp, Artificial Sequence
  Synthetic
tggtctacgcatactgggtat

SEQ ID NO: 20826 - DNA, 21 bp, Artificial Sequence
  Synthetic
tggagtcagttttctagtggg

SEQ ID NO: 20827 - DNA, 21 bp, Artificial Sequence
  Synthetic
aattatgctgggtatagtact

SEQ ID NO: 20828 - DNA, 21 bp, Artificial Sequence
  Synthetic
gatgttgggagttctcggtgg

SEQ ID NO: 20829 - DNA, 21 bp, Artificial Sequence
  Synthetic
gtgactaggggttatgctacg

SEQ ID NO: 20830 - DNA, 21 bp, Artificial Sequence
  Synthetic
aagatgtgggggagtcttgag

SEQ ID NO: 20831 - DNA, 21 bp, Artificial Sequence
  Synthetic
aagtctccgggtttttctagt

SEQ ID NO: 20832 - DNA, 21 bp, Artificial Sequence
  Synthetic
atggctgcgggtttttctcag

SEQ ID NO: 20833 - DNA, 21 bp, Artificial Sequence
  Synthetic
ggttggtcgggtggtgctcag

SEQ ID NO: 20834 - DNA, 21 bp, Artificial Sequence
  Synthetic
tggaagcttgcgggtagtgcg

SEQ ID NO: 20835 - DNA, 21 bp, Artificial Sequence
  Synthetic
catgctctttatggtagtgtt

SEQ ID NO: 20836 - DNA, 21 bp, Artificial Sequence
  Synthetic
acttttcatggtggttctatg

SEQ ID NO: 20837 - DNA, 21 bp, Artificial Sequence
  Synthetic
gagcgtcctgggtgggcgtct

SEQ ID NO: 20838 - DNA, 21 bp, Artificial Sequence
  Synthetic
atgcggacgcttgggtcggct

SEQ ID NO: 20839 - DNA, 21 bp, Artificial Sequence
  Synthetic
cttagggcggggtattctgtt

SEQ ID NO: 20840 - DNA, 21 bp, Artificial Sequence
  Synthetic
cctcggtctgggtttagtagt

SEQ ID NO: 20841 - DNA, 21 bp, Artificial Sequence
  Synthetic
gagaggggtgatgggaggtgg

SEQ ID NO: 20842 - DNA, 21 bp, Artificial Sequence
  Synthetic
atggctgttggttttagtagt

SEQ ID NO: 20843 - DNA, 21 bp, Artificial Sequence
  Synthetic
tatatgcggatggggagtgcg

SEQ ID NO: 20844 - DNA, 21 bp, Artificial Sequence
  Synthetic
aatcgtccggggtttagtagt

SEQ ID NO: 20845 - DNA, 21 bp, Artificial Sequence
  Synthetic
gaggtttggggtggtgctatg

SEQ ID NO: 20846 - DNA, 21 bp, Artificial Sequence
  Synthetic
tgggcgaggcaggggtcggct

SEQ ID NO: 20847 - DNA, 21 bp, Artificial Sequence
  Synthetic
aggccggagtggaggagtgat

SEQ ID NO: 20848 - DNA, 21 bp, Artificial Sequence
  Synthetic
tggcttagtggttttaaggat

SEQ ID NO: 20849 - DNA, 21 bp, Artificial Sequence
  Synthetic
agttggcctgggagtagtagt

SEQ ID NO: 20850 - DNA, 21 bp, Artificial Sequence
  Synthetic
cctgctccgatgttggctagt

SEQ ID NO: 20851 - DNA, 21 bp, Artificial Sequence
  Synthetic
cgttatcaggctgatgctcag

SEQ ID NO: 20852 - DNA, 21 bp, Artificial Sequence
  Synthetic
ctgtatctgggggatcggagt

SEQ ID NO: 20853 - DNA, 21 bp, Artificial Sequence
  Synthetic
cgtgctccggggctgtcttct

SEQ ID NO: 20854 - DNA, 21 bp, Artificial Sequence
  Synthetic
ggtgcggatgtgagtcgttgg

SEQ ID NO: 20855 - DNA, 21 bp, Artificial Sequence
  Synthetic
gttagggctatgggtagtgcg

SEQ ID NO: 20856 - DNA, 21 bp, Artificial Sequence
  Synthetic
ccgtatgttgggatggcgagt

SEQ ID NO: 20857 - DNA, 21 bp, Artificial Sequence
  Synthetic
gtgcggagtgggtgggcggcg

SEQ ID NO: 20858 - DNA, 21 bp, Artificial Sequence
  Synthetic
gagtttcgggggtattcgagt

SEQ ID NO: 20859 - DNA, 21 bp, Artificial Sequence
  Synthetic
tatgcgtcgctgtcgtttcat

SEQ ID NO: 20860 - DNA, 21 bp, Artificial Sequence
  Synthetic
tggtcgacgtattcggggcat

SEQ ID NO: 20861 - DNA, 21 bp, Artificial Sequence
  Synthetic
gttgttcagcattcgcattgg

SEQ ID NO: 20862 - DNA, 21 bp, Artificial Sequence
  Synthetic
cgttatgttggtggttcgtcg

SEQ ID NO: 20863 - DNA, 21 bp, Artificial Sequence
  Synthetic
aggccttatcatgttgatagt

SEQ ID NO: 20864 - DNA, 21 bp, Artificial Sequence
  Synthetic
aatgctcagttgctgccgtat

SEQ ID NO: 20865 - DNA, 21 bp, Artificial Sequence
  Synthetic
gggggtctgggttggagttcg

SEQ ID NO: 20866 - DNA, 21 bp, Artificial Sequence
  Synthetic
gctcggccgtatgcgcatgag

SEQ ID NO: 20867 - DNA, 21 bp, Artificial Sequence
  Synthetic
tatgggtcgttggagagtttg

SEQ ID NO: 20868 - DNA, 21 bp, Artificial Sequence
  Synthetic
tggacttcggataaggggtgg

SEQ ID NO: 20869 - DNA, 21 bp, Artificial Sequence
  Synthetic
tggagtcatgggtattctacg

SEQ ID NO: 20870 - DNA, 21 bp, Artificial Sequence
  Synthetic
ctgcaggagtatgggagtagt

SEQ ID NO: 20871 - DNA, 21 bp, Artificial Sequence
  Synthetic
gaggctccgtggcagtcttcg

SEQ ID NO: 20872 - DNA, 21 bp, Artificial Sequence
  Synthetic
gttcgtagtgggtttagttcg

SEQ ID NO: 20873 - DNA, 21 bp, Artificial Sequence
  Synthetic
gtgcggtcggggtttagtatg

SEQ ID NO: 20874 - DNA, 21 bp, Artificial Sequence
  Synthetic
atgtcttatcttggttcgtct

SEQ ID NO: 20875 - DNA, 21 bp, Artificial Sequence
  Synthetic
gttctgtatcgtgagtctttg

SEQ ID NO: 20876 - DNA, 21 bp, Artificial Sequence
  Synthetic
aggtatagtggtgatgcggcg

SEQ ID NO: 20877 - DNA, 21 bp, Artificial Sequence
  Synthetic
tggagtattgctgagggtcat

SEQ ID NO: 20878 - DNA, 21 bp, Artificial Sequence
  Synthetic
cttgatagtcgttttagtcat

SEQ ID NO: 20879 - DNA, 21 bp, Artificial Sequence
  Synthetic
tggtctttgcctaatggtggg

SEQ ID NO: 20880 - DNA, 21 bp, Artificial Sequence
  Synthetic
gatttttttaagggggcggct

SEQ ID NO: 20881 - DNA, 21 bp, Artificial Sequence
  Synthetic
gcgtggcatactgggagtagt

SEQ ID NO: 20882 - DNA, 21 bp, Artificial Sequence
  Synthetic
gtgatgcatggttttagttcg

SEQ ID NO: 20883 - DNA, 21 bp, Artificial Sequence
  Synthetic
gatgagaggattggtcggtgg

SEQ ID NO: 20884 - DNA, 21 bp, Artificial Sequence
  Synthetic
gagtggattggtggtgcggct

SEQ ID NO: 20885 - DNA, 21 bp, Artificial Sequence
  Synthetic
ttgaattctctgtggccggat

SEQ ID NO: 20886 - DNA, 21 bp, Artificial Sequence
  Synthetic
agtaaggttggttattctagt

SEQ ID NO: 20887 - DNA, 21 bp, Artificial Sequence
  Synthetic
acgtatcctgggtattctgtg

SEQ ID NO: 20888 - DNA, 21 bp, Artificial Sequence
  Synthetic
tttcgtcttcagggggctcag

SEQ ID NO: 20889 - DNA, 21 bp, Artificial Sequence
  Synthetic
tctatgccttatggtagttct

SEQ ID NO: 20890 - DNA, 21 bp, Artificial Sequence
  Synthetic
ggtgctccgggtcagtattgg

SEQ ID NO: 20891 - DNA, 21 bp, Artificial Sequence
  Synthetic
agtgtgcgtttggggtcgagt

SEQ ID NO: 20892 - DNA, 21 bp, Artificial Sequence
  Synthetic
ccttatccttcttatgctagt

SEQ ID NO: 20893 - DNA, 21 bp, Artificial Sequence
  Synthetic
atgcctcaggattcgaggtgg

SEQ ID NO: 20894 - DNA, 21 bp, Artificial Sequence
  Synthetic
ttgctttatgggggtagtact

SEQ ID NO: 20895 - DNA, 21 bp, Artificial Sequence
  Synthetic
tcgaaggctcctggtccgtgg

SEQ ID NO: 20896 - DNA, 21 bp, Artificial Sequence
  Synthetic
gagtggtctggtggtagtagt

SEQ ID NO: 20897 - DNA, 21 bp, Artificial Sequence
  Synthetic
tggaagcagatgggtgctagt

SEQ ID NO: 20898 - DNA, 21 bp, Artificial Sequence
  Synthetic
catcggtatgaggggtcgagt

SEQ ID NO: 20899 - DNA, 21 bp, Artificial Sequence
  Synthetic
aatgatccgacgttgaggtat

SEQ ID NO: 20900 - DNA, 21 bp, Artificial Sequence
  Synthetic
ccgaggcctgggtgggcggcg

SEQ ID NO: 20901 - DNA, 21 bp, Artificial Sequence
  Synthetic
tttgtgaggctgccggatgtt

SEQ ID NO: 20902 - DNA, 21 bp, Artificial Sequence
  Synthetic
aattatgttcctgcggctagt

SEQ ID NO: 20903 - DNA, 21 bp, Artificial Sequence
  Synthetic
gttgctggttatgagtggaag

SEQ ID NO: 20904 - DNA, 21 bp, Artificial Sequence
  Synthetic
ttgagggaggggttttctcag

SEQ ID NO: 20905 - DNA, 21 bp, Artificial Sequence
  Synthetic
gatcgtattgttcttcggaat

SEQ ID NO: 20906 - DNA, 21 bp, Artificial Sequence
  Synthetic
gattggaggggtcaggcgact

SEQ ID NO: 20907 - DNA, 21 bp, Artificial Sequence
  Synthetic
tggcgtcatgagggtgcgatg

SEQ ID NO: 20908 - DNA, 21 bp, Artificial Sequence
  Synthetic
tgggatgtgaatcggggttat

SEQ ID NO: 20909 - DNA, 21 bp, Artificial Sequence
  Synthetic
ttgccgctgatgtatagggat

SEQ ID NO: 20910 - DNA, 21 bp, Artificial Sequence
  Synthetic
gtttggcatgctgggtcgacg

SEQ ID NO: 20911 - DNA, 21 bp, Artificial Sequence
  Synthetic
gtgatgcctggttggtctagt

SEQ ID NO: 20912 - DNA, 21 bp, Artificial Sequence
  Synthetic
gattatccgggttatgcttcg

SEQ ID NO: 20913 - DNA, 21 bp, Artificial Sequence
  Synthetic
cgttggacgagtgatgctgct

SEQ ID NO: 20914 - DNA, 21 bp, Artificial Sequence
  Synthetic
gctatgcgggggtattctagt

SEQ ID NO: 20915 - DNA, 21 bp, Artificial Sequence
  Synthetic
ggtcagaatcctggtacttgg

SEQ ID NO: 20916 - DNA, 21 bp, Artificial Sequence
  Synthetic
ggtgatagtgttggtcggtgg

SEQ ID NO: 20917 - DNA, 21 bp, Artificial Sequence
  Synthetic
aggacggcgggttctgtttat

SEQ ID NO: 20918 - DNA, 21 bp, Artificial Sequence
  Synthetic
catcttatggggtatactacg

SEQ ID NO: 20919 - DNA, 21 bp, Artificial Sequence
  Synthetic
ttgcagactggttatagtcag

SEQ ID NO: 20920 - DNA, 21 bp, Artificial Sequence
  Synthetic
gcgcctggtagtgcggtgtgg

SEQ ID NO: 20921 - DNA, 21 bp, Artificial Sequence
  Synthetic
gctgttggggagtttcggtgg

SEQ ID NO: 20922 - DNA, 21 bp, Artificial Sequence
  Synthetic
gtttggcatggtgggagtcag

SEQ ID NO: 20923 - DNA, 21 bp, Artificial Sequence
  Synthetic
attaggtttgaggggtctatg

SEQ ID NO: 20924 - DNA, 21 bp, Artificial Sequence
  Synthetic
gcgagtttggggtctatttat

SEQ ID NO: 20925 - DNA, 21 bp, Artificial Sequence
  Synthetic
gagcgggtttttcagagtagt

SEQ ID NO: 20926 - DNA, 21 bp, Artificial Sequence
  Synthetic
tggcattcgcttatggtggag

SEQ ID NO: 20927 - DNA, 21 bp, Artificial Sequence
  Synthetic
tatgctacttgggtttcgaat

SEQ ID NO: 20928 - DNA, 21 bp, Artificial Sequence
  Synthetic
gataggggggtttgggcggcg

SEQ ID NO: 20929 - DNA, 21 bp, Artificial Sequence
  Synthetic
attattgattctggtaggtgg

SEQ ID NO: 20930 - DNA, 21 bp, Artificial Sequence
  Synthetic
attattcctggttttagttcg

SEQ ID NO: 20931 - DNA, 21 bp, Artificial Sequence
  Synthetic
agtcgttgggagggttctgct

SEQ ID NO: 20932 - DNA, 21 bp, Artificial Sequence
  Synthetic
ggtcttgataaggctcgtttt

SEQ ID NO: 20933 - DNA, 21 bp, Artificial Sequence
  Synthetic
tgggtggagcgtgggagtacg

SEQ ID NO: 20934 - DNA, 21 bp, Artificial Sequence
  Synthetic
gtgagtcataattggagttcg

SEQ ID NO: 20935 - DNA, 21 bp, Artificial Sequence
  Synthetic
tggcgggagaagggttcttct

SEQ ID NO: 20936 - DNA, 21 bp, Artificial Sequence
  Synthetic
cctgagaatcctggtcggtgg

SEQ ID NO: 20937 - DNA, 21 bp, Artificial Sequence
  Synthetic
atgcgttcgcttggtagtagt

SEQ ID NO: 20938 - DNA, 21 bp, Artificial Sequence
  Synthetic
tcgtggccgggtgggtctatg

SEQ ID NO: 20939 - DNA, 21 bp, Artificial Sequence
  Synthetic
ctgtattcggggctggctcag

SEQ ID NO: 20940 - DNA, 21 bp, Artificial Sequence
  Synthetic
cgtgctatgggtctggctcag

SEQ ID NO: 20941 - DNA, 21 bp, Artificial Sequence
  Synthetic
tttgagaggtttggttctgcg

SEQ ID NO: 20942 - DNA, 21 bp, Artificial Sequence
  Synthetic
gcttttctgcatggtgcggct

SEQ ID NO: 20943 - DNA, 21 bp, Artificial Sequence
  Synthetic
aagcatacgggttttagtcag

SEQ ID NO: 20944 - DNA, 21 bp, Artificial Sequence
  Synthetic
ggttttccggggttttctacg

SEQ ID NO: 20945 - DNA, 21 bp, Artificial Sequence
  Synthetic
atgaagtatgggggttcgact

SEQ ID NO: 20946 - DNA, 21 bp, Artificial Sequence
  Synthetic
gcgcctctggaggtgcgttgg

SEQ ID NO: 20947 - DNA, 21 bp, Artificial Sequence
  Synthetic
atgcatcctgggtattcgatg

SEQ ID NO: 20948 - DNA, 21 bp, Artificial Sequence
  Synthetic
ggtctggattctcggtggaat

SEQ ID NO: 20949 - DNA, 21 bp, Artificial Sequence
  Synthetic
ggtaatgatccggggcggtgg

SEQ ID NO: 20950 - DNA, 21 bp, Artificial Sequence
  Synthetic
ggtgaggctgcgaggtggagt

SEQ ID NO: 20951 - DNA, 21 bp, Artificial Sequence
  Synthetic
tggagggaggggtggtcgact

SEQ ID NO: 20952 - DNA, 21 bp, Artificial Sequence
  Synthetic
aatgtgtttcatgggtcggct

SEQ ID NO: 20953 - DNA, 21 bp, Artificial Sequence
  Synthetic
catatttatgctggtagttct

SEQ ID NO: 20954 - DNA, 21 bp, Artificial Sequence
  Synthetic
atgaaggctggttatagttct

SEQ ID NO: 20955 - DNA, 21 bp, Artificial Sequence
  Synthetic
ggtacgcggtggaatcttgag

SEQ ID NO: 20956 - DNA, 21 bp, Artificial Sequence
  Synthetic
ccgtttaattatcaggcttct

SEQ ID NO: 20957 - DNA, 21 bp, Artificial Sequence
  Synthetic
tttcgggagcatggttcttct

SEQ ID NO: 20958 - DNA, 21 bp, Artificial Sequence
  Synthetic
agggtggagcatgggtatgcg

SEQ ID NO: 20959 - DNA, 21 bp, Artificial Sequence
  Synthetic
cggtatgggggtgatagttct

SEQ ID NO: 20960 - DNA, 21 bp, Artificial Sequence
  Synthetic
ctgtttgctggttattctacg

SEQ ID NO: 20961 - DNA, 21 bp, Artificial Sequence
  Synthetic
tatggttggcggctggcggag

SEQ ID NO: 20962 - DNA, 21 bp, Artificial Sequence
  Synthetic
gagaggactggttgggcggcg

SEQ ID NO: 20963 - DNA, 21 bp, Artificial Sequence
  Synthetic
tatgtggagtttccggagttt

SEQ ID NO: 20964 - DNA, 21 bp, Artificial Sequence
  Synthetic
ggtcggtttgatttgaggccg

SEQ ID NO: 20965 - DNA, 21 bp, Artificial Sequence
  Synthetic
ggttcgaatgctgggccttgg

SEQ ID NO: 20966 - DNA, 21 bp, Artificial Sequence
  Synthetic
gatactcctgtggggcgttgg

SEQ ID NO: 20967 - DNA, 21 bp, Artificial Sequence
  Synthetic
ggggatatgactggtcggtgg

SEQ ID NO: 20968 - DNA, 21 bp, Artificial Sequence
  Synthetic
aggattccgggtttttcggcg

SEQ ID NO: 20969 - DNA, 21 bp, Artificial Sequence
  Synthetic
cgtcatccgggggaggcttcg

SEQ ID NO: 20970 - DNA, 21 bp, Artificial Sequence
  Synthetic
atgtgggcgggtgcggcttct

SEQ ID NO: 20971 - DNA, 21 bp, Artificial Sequence
  Synthetic
tgggtgactcagggtgctgct

SEQ ID NO: 20972 - DNA, 21 bp, Artificial Sequence
  Synthetic
ttgttgaagggttggtcggct

SEQ ID NO: 20973 - DNA, 21 bp, Artificial Sequence
  Synthetic
gtgcggtatgagggtgcttcg

SEQ ID NO: 20974 - DNA, 21 bp, Artificial Sequence
  Synthetic
tctgtgccgggttggtcgtcg

SEQ ID NO: 20975 - DNA, 21 bp, Artificial Sequence
  Synthetic
ctggttcctggtttgtcgagt

SEQ ID NO: 20976 - DNA, 21 bp, Artificial Sequence
  Synthetic
acgaatcctctgtggagtgct

SEQ ID NO: 20977 - DNA, 21 bp, Artificial Sequence
  Synthetic
tgggtttttgggaatgttgcg

SEQ ID NO: 20978 - DNA, 21 bp, Artificial Sequence
  Synthetic
gatctggttggtggtaggtgg

SEQ ID NO: 20979 - DNA, 21 bp, Artificial Sequence
  Synthetic
ccgcatccgcagtggagtgct

SEQ ID NO: 20980 - DNA, 21 bp, Artificial Sequence
  Synthetic
tggcgggatatgggtagtcag

SEQ ID NO: 20981 - DNA, 21 bp, Artificial Sequence
  Synthetic
gttgttccggggttttcttat

SEQ ID NO: 20982 - DNA, 21 bp, Artificial Sequence
  Synthetic
ggggagtctgcgggtcggtgg

SEQ ID NO: 20983 - DNA, 21 bp, Artificial Sequence
  Synthetic
gcgggtaatccgggggcttgg

SEQ ID NO: 20984 - DNA, 21 bp, Artificial Sequence
  Synthetic
cctctggttcagcattcgtgg

SEQ ID NO: 20985 - DNA, 21 bp, Artificial Sequence
  Synthetic
cagaaggcgggtcctaattgg

SEQ ID NO: 20986 - DNA, 21 bp, Artificial Sequence
  Synthetic
ggtcaggcgaattgggcgagt

SEQ ID NO: 20987 - DNA, 21 bp, Artificial Sequence
  Synthetic
tttgggagtttggcgcgtttg

SEQ ID NO: 20988 - DNA, 21 bp, Artificial Sequence
  Synthetic
catgttgagtttggttcgagt

SEQ ID NO: 20989 - DNA, 21 bp, Artificial Sequence
  Synthetic
cggtttattgcggatcaggct

SEQ ID NO: 20990 - DNA, 21 bp, Artificial Sequence
  Synthetic
ggtcttgataatgggaggtgg

SEQ ID NO: 20991 - DNA, 21 bp, Artificial Sequence
  Synthetic
catgctaagctggggtcgagt

SEQ ID NO: 20992 - DNA, 21 bp, Artificial Sequence
  Synthetic
atgaatcatggttattctatg

SEQ ID NO: 20993 - DNA, 21 bp, Artificial Sequence
  Synthetic
ttgcagtcgacgtggagttct

SEQ ID NO: 20994 - DNA, 21 bp, Artificial Sequence
  Synthetic
ctgaagattggttatgctact

SEQ ID NO: 20995 - DNA, 21 bp, Artificial Sequence
  Synthetic
cagtatggttttggtagttcg

SEQ ID NO: 20996 - DNA, 21 bp, Artificial Sequence
  Synthetic
ggtattatggatgggtttagg

SEQ ID NO: 20997 - DNA, 21 bp, Artificial Sequence
  Synthetic
gtgttggtggggcggactggt

SEQ ID NO: 20998 - DNA, 21 bp, Artificial Sequence
  Synthetic
cgtgtttgggctgagagtcag

SEQ ID NO: 20999 - DNA, 21 bp, Artificial Sequence
  Synthetic
agtgcttggggtcaggcgcag

SEQ ID NO: 21000 - DNA, 21 bp, Artificial Sequence
  Synthetic
cctattttgaagtatggtgct

SEQ ID NO: 21001 - DNA, 21 bp, Artificial Sequence
  Synthetic
aaggttggttttggtagttct

SEQ ID NO: 21002 - DNA, 21 bp, Artificial Sequence
  Synthetic
gtgctttctgggttttcgcag

SEQ ID NO: 21003 - DNA, 21 bp, Artificial Sequence
  Synthetic
tggtcggttcagggggggttt

SEQ ID NO: 21004 - DNA, 21 bp, Artificial Sequence
  Synthetic
gttcagtgggagggttcttct

SEQ ID NO: 21005 - DNA, 21 bp, Artificial Sequence
  Synthetic
gagttttatggtggttcgcgg

SEQ ID NO: 21006 - DNA, 21 bp, Artificial Sequence
  Synthetic
ttgatttcttttgggtcggct

SEQ ID NO: 21007 - DNA, 21 bp, Artificial Sequence
  Synthetic
tatgggatgcttgcttcgtat

SEQ ID NO: 21008 - DNA, 21 bp, Artificial Sequence
  Synthetic
tttgcttatggttcggcgcag

SEQ ID NO: 21009 - DNA, 21 bp, Artificial Sequence
  Synthetic
acgaatgtgggtactatttat

SEQ ID NO: 21010 - DNA, 21 bp, Artificial Sequence
  Synthetic
ccggtgaatcctggtgtgtgg

SEQ ID NO: 21011 - DNA, 21 bp, Artificial Sequence
  Synthetic
agtaaggtgctgttttctgct

SEQ ID NO: 21012 - DNA, 21 bp, Artificial Sequence
  Synthetic
actattccggggttgtcttcg

SEQ ID NO: 21013 - DNA, 21 bp, Artificial Sequence
  Synthetic
ctttgggcgggtgctagtcag

SEQ ID NO: 21014 - DNA, 21 bp, Artificial Sequence
  Synthetic
attaataagactgattattgg

SEQ ID NO: 21015 - DNA, 21 bp, Artificial Sequence
  Synthetic
aaggttcaggggttttctagt

SEQ ID NO: 21016 - DNA, 21 bp, Artificial Sequence
  Synthetic
gctggttttgggcaggctcag

SEQ ID NO: 21017 - DNA, 21 bp, Artificial Sequence
  Synthetic
gagaaggtgaattggtcggtg

SEQ ID NO: 21018 - DNA, 21 bp, Artificial Sequence
  Synthetic
tatggttcgttgcaggggtgg

SEQ ID NO: 21019 - DNA, 21 bp, Artificial Sequence
  Synthetic
aggtttgcgggtgattcgagt

SEQ ID NO: 21020 - DNA, 21 bp, Artificial Sequence
  Synthetic
agtagggtggggtcggtgtat

SEQ ID NO: 21021 - DNA, 21 bp, Artificial Sequence
  Synthetic
agtcatccgggttttagttct

SEQ ID NO: 21022 - DNA, 21 bp, Artificial Sequence
  Synthetic
ggggctgatactgggcgttgg

SEQ ID NO: 21023 - DNA, 21 bp, Artificial Sequence
  Synthetic
tcgatgcggttgggttctacg

SEQ ID NO: 21024 - DNA, 21 bp, Artificial Sequence
  Synthetic
atggcttctaagtttagttcg

SEQ ID NO: 21025 - DNA, 21 bp, Artificial Sequence
  Synthetic
attcaggttggttcgatttat

SEQ ID NO: 21026 - DNA, 21 bp, Artificial Sequence
  Synthetic
tgggggagtccgagtcattcg

SEQ ID NO: 21027 - DNA, 21 bp, Artificial Sequence
  Synthetic
agtgaggcgtggaatagggcg

SEQ ID NO: 21028 - DNA, 21 bp, Artificial Sequence
  Synthetic
tctgctcggttggggtcgact

SEQ ID NO: 21029 - DNA, 21 bp, Artificial Sequence
  Synthetic
tttggttctcttgctctgatt

SEQ ID NO: 21030 - DNA, 21 bp, Artificial Sequence
  Synthetic
tggaggtcgcttcctgagagt

SEQ ID NO: 21031 - DNA, 21 bp, Artificial Sequence
  Synthetic
tggggtcgtctggaggcgatt

SEQ ID NO: 21032 - DNA, 21 bp, Artificial Sequence
  Synthetic
atggcttcgtatggttcgtcg

SEQ ID NO: 21033 - DNA, 21 bp, Artificial Sequence
  Synthetic
gatacgtttcgggggtctact

SEQ ID NO: 21034 - DNA, 21 bp, Artificial Sequence
  Synthetic
attgttacgtttgggagtgcg

SEQ ID NO: 21035 - DNA, 21 bp, Artificial Sequence
  Synthetic
gagcgggcgcatgggtcgagt

SEQ ID NO: 21036 - DNA, 21 bp, Artificial Sequence
  Synthetic
gtttttagtgggtattcgtct

SEQ ID NO: 21037 - DNA, 21 bp, Artificial Sequence
  Synthetic
aagctgttttatcctgatggg

SEQ ID NO: 21038 - DNA, 21 bp, Artificial Sequence
  Synthetic
ggtagttggcagggttcgtct

SEQ ID NO: 21039 - DNA, 21 bp, Artificial Sequence
  Synthetic
cttattccttttcagtcgcag

SEQ ID NO: 21040 - DNA, 21 bp, Artificial Sequence
  Synthetic
aaggtgtggggggagctgagt

SEQ ID NO: 21041 - DNA, 21 bp, Artificial Sequence
  Synthetic
cgtgcgcctgctgatcgtgcg

SEQ ID NO: 21042 - DNA, 21 bp, Artificial Sequence
  Synthetic
acttttcatgggggtagtatt

SEQ ID NO: 21043 - DNA, 21 bp, Artificial Sequence
  Synthetic
cggtttattgctgatcatgct

SEQ ID NO: 21044 - DNA, 21 bp, Artificial Sequence
  Synthetic
ttgttgcgtggttattcgaat

SEQ ID NO: 21045 - DNA, 21 bp, Artificial Sequence
  Synthetic
tatcatgttggtactatttat

SEQ ID NO: 21046 - DNA, 21 bp, Artificial Sequence
  Synthetic
tgggggatgacgactggtttt

SEQ ID NO: 21047 - DNA, 21 bp, Artificial Sequence
  Synthetic
acgttttatggtggtgcttcg

SEQ ID NO: 21048 - DNA, 21 bp, Artificial Sequence
  Synthetic
gattataggccggcgtctagt

SEQ ID NO: 21049 - DNA, 21 bp, Artificial Sequence
  Synthetic
tatgctactcttgggtcttcg

SEQ ID NO: 21050 - DNA, 21 bp, Artificial Sequence
  Synthetic
aggctggctggttataatgtg

SEQ ID NO: 21051 - DNA, 21 bp, Artificial Sequence
  Synthetic
catggggttaattggagtcat

SEQ ID NO: 21052 - DNA, 21 bp, Artificial Sequence
  Synthetic
atgctgaagtatgggtcgact

SEQ ID NO: 21053 - DNA, 21 bp, Artificial Sequence
  Synthetic
tggtcgccttattctcctaat

SEQ ID NO: 21054 - DNA, 21 bp, Artificial Sequence
  Synthetic
ccttctaatcagggggtttgg

SEQ ID NO: 21055 - DNA, 21 bp, Artificial Sequence
  Synthetic
tggaagattggttttagttct

SEQ ID NO: 21056 - DNA, 21 bp, Artificial Sequence
  Synthetic
tggatgaaggggggtagtcag

SEQ ID NO: 21057 - DNA, 21 bp, Artificial Sequence
  Synthetic
gatgatcgggtgactcggtgg

SEQ ID NO: 21058 - DNA, 21 bp, Artificial Sequence
  Synthetic
aggtatgatagtggggtgtgg

SEQ ID NO: 21059 - DNA, 21 bp, Artificial Sequence
  Synthetic
tatccttatgatcttggtagg

SEQ ID NO: 21060 - DNA, 21 bp, Artificial Sequence
  Synthetic
gatggtgcttcggggcggtgg

SEQ ID NO: 21061 - DNA, 21 bp, Artificial Sequence
  Synthetic
tctaggattctgggttcgacg

SEQ ID NO: 21062 - DNA, 21 bp, Artificial Sequence
  Synthetic
gataggccgggttttagttat

SEQ ID NO: 21063 - DNA, 21 bp, Artificial Sequence
  Synthetic
gtgagggctatggggtctacg

SEQ ID NO: 21064 - DNA, 21 bp, Artificial Sequence
  Synthetic
tggcgtcatgagggttctgtt

SEQ ID NO: 21065 - DNA, 21 bp, Artificial Sequence
  Synthetic
gaggtttttaggggtgcggcg

SEQ ID NO: 21066 - DNA, 21 bp, Artificial Sequence
  Synthetic
tggtcgacgcatactgggttt

SEQ ID NO: 21067 - DNA, 21 bp, Artificial Sequence
  Synthetic
catgtggcttatgggtcgact

SEQ ID NO: 21068 - DNA, 21 bp, Artificial Sequence
  Synthetic
cataggactttgatgagttcg

SEQ ID NO: 21069 - DNA, 21 bp, Artificial Sequence
  Synthetic
tgggggtcgctgtctgctgtg

SEQ ID NO: 21070 - DNA, 21 bp, Artificial Sequence
  Synthetic
cgttatattggggatagtgct

SEQ ID NO: 21071 - DNA, 21 bp, Artificial Sequence
  Synthetic
gtgcatcagggttatagtagt

SEQ ID NO: 21072 - DNA, 21 bp, Artificial Sequence
  Synthetic
cctacgtggggtcatgcggct

SEQ ID NO: 21073 - DNA, 21 bp, Artificial Sequence
  Synthetic
acgtatcctcttggtagtgct

SEQ ID NO: 21074 - DNA, 21 bp, Artificial Sequence
  Synthetic
aaggtgccggggtatagtgcg

SEQ ID NO: 21075 - DNA, 21 bp, Artificial Sequence
  Synthetic
gcgaaggctgggtggagtagt

SEQ ID NO: 21076 - DNA, 21 bp, Artificial Sequence
  Synthetic
attttgattgggcgggggggt

SEQ ID NO: 21077 - DNA, 21 bp, Artificial Sequence
  Synthetic
gctcgtcttcttgggagttcg

SEQ ID NO: 21078 - DNA, 21 bp, Artificial Sequence
  Synthetic
tggagtttgcagggtgcgtat

SEQ ID NO: 21079 - DNA, 21 bp, Artificial Sequence
  Synthetic
gggtctcggccggggccttgg

SEQ ID NO: 21080 - DNA, 21 bp, Artificial Sequence
  Synthetic
gaggcgtatatgggttctgtg

SEQ ID NO: 21081 - DNA, 21 bp, Artificial Sequence
  Synthetic
tggggtcttggtgatgggtat

SEQ ID NO: 21082 - DNA, 21 bp, Artificial Sequence
  Synthetic
actcgggctgggtattctagt

SEQ ID NO: 21083 - DNA, 21 bp, Artificial Sequence
  Synthetic
ggttatcctggtgatcgtacg

SEQ ID NO: 21084 - DNA, 21 bp, Artificial Sequence
  Synthetic
cctaaggctacgtggtcggcg

SEQ ID NO: 21085 - DNA, 21 bp, Artificial Sequence
  Synthetic
actcgtgcgctggggagtact

SEQ ID NO: 21086 - DNA, 21 bp, Artificial Sequence
  Synthetic
gcttttcctggggcggcgcag

SEQ ID NO: 21087 - DNA, 21 bp, Artificial Sequence
  Synthetic
gtgaatgagtttgctaggtat

SEQ ID NO: 21088 - DNA, 21 bp, Artificial Sequence
  Synthetic
tttatggctgggtattctaat

SEQ ID NO: 21089 - DNA, 21 bp, Artificial Sequence
  Synthetic
gataaggctgtgtggagttcg

SEQ ID NO: 21090 - DNA, 21 bp, Artificial Sequence
  Synthetic
ccgcgtgtgggttatgctagt

SEQ ID NO: 21091 - DNA, 21 bp, Artificial Sequence
  Synthetic
tggtctcttgggggttcgagt

SEQ ID NO: 21092 - DNA, 21 bp, Artificial Sequence
  Synthetic
gatcctcggtggagtagtgct

SEQ ID NO: 21093 - DNA, 21 bp, Artificial Sequence
  Synthetic
gataggcatcttggttcgact

SEQ ID NO: 21094 - DNA, 21 bp, Artificial Sequence
  Synthetic
cagaattataatgggagtatt

SEQ ID NO: 21095 - DNA, 21 bp, Artificial Sequence
  Synthetic
atgtatccggcgggttctatt

SEQ ID NO: 21096 - DNA, 21 bp, Artificial Sequence
  Synthetic
tggtctactgctactggttat

SEQ ID NO: 21097 - DNA, 21 bp, Artificial Sequence
  Synthetic
agtatttatttggggtctagt

SEQ ID NO: 21098 - DNA, 21 bp, Artificial Sequence
  Synthetic
cgttttacgggggatccggcg

SEQ ID NO: 21099 - DNA, 21 bp, Artificial Sequence
  Synthetic
cggtttgttagtgatgcgacg

SEQ ID NO: 21100 - DNA, 21 bp, Artificial Sequence
  Synthetic
gatggtcgtgaggggcgttgg

SEQ ID NO: 21101 - DNA, 21 bp, Artificial Sequence
  Synthetic
aagttgtatcagcttgatcat

SEQ ID NO: 21102 - DNA, 21 bp, Artificial Sequence
  Synthetic
gagcatccttcgcgttggagt

SEQ ID NO: 21103 - DNA, 21 bp, Artificial Sequence
  Synthetic
gatcctatttggaagagtagt

SEQ ID NO: 21104 - DNA, 21 bp, Artificial Sequence
  Synthetic
agtgcgccgggttggagtacg

SEQ ID NO: 21105 - DNA, 21 bp, Artificial Sequence
  Synthetic
gagtggccgggttatgcgatg

SEQ ID NO: 21106 - DNA, 21 bp, Artificial Sequence
  Synthetic
ctgattgcggggtatagttcg

SEQ ID NO: 21107 - DNA, 21 bp, Artificial Sequence
  Synthetic
tcgtatcagggttatagtagt

SEQ ID NO: 21108 - DNA, 21 bp, Artificial Sequence
  Synthetic
aagcgttttgctgttgatgtg

SEQ ID NO: 21109 - DNA, 21 bp, Artificial Sequence
  Synthetic
gtggctcatgggtttagtatg

SEQ ID NO: 21110 - DNA, 21 bp, Artificial Sequence
  Synthetic
ctgtatcggggtgagagtagt

SEQ ID NO: 21111 - DNA, 21 bp, Artificial Sequence
  Synthetic
atgcgtgctgggctggctcag

SEQ ID NO: 21112 - DNA, 21 bp, Artificial Sequence
  Synthetic
aattctcatccgggtgtttgg

SEQ ID NO: 21113 - DNA, 21 bp, Artificial Sequence
  Synthetic
agtattggttatgggtcgagt

SEQ ID NO: 21114 - DNA, 21 bp, Artificial Sequence
  Synthetic
tcggtgtgggcggggtcgagt

SEQ ID NO: 21115 - DNA, 21 bp, Artificial Sequence
  Synthetic
cagtatattgggcagagtagt

SEQ ID NO: 21116 - DNA, 21 bp, Artificial Sequence
  Synthetic
tctctgcttcatgggtatggt

SEQ ID NO: 21117 - DNA, 21 bp, Artificial Sequence
  Synthetic
tgggggagtccgccgcatagt

SEQ ID NO: 21118 - DNA, 21 bp, Artificial Sequence
  Synthetic
cttgattatagggggtctact

SEQ ID NO: 21119 - DNA, 21 bp, Artificial Sequence
  Synthetic
ggtgctgatgtttcgcgttgg

SEQ ID NO: 21120 - DNA, 21 bp, Artificial Sequence
  Synthetic
ttggggccttcgcattggaat

SEQ ID NO: 21121 - DNA, 21 bp, Artificial Sequence
  Synthetic
aagcagtgggggagtgttgag

SEQ ID NO: 21122 - DNA, 21 bp, Artificial Sequence
  Synthetic
gggtggcatgggggttcgatg

SEQ ID NO: 21123 - DNA, 21 bp, Artificial Sequence
  Synthetic
catcagaggcttggttcttcg

SEQ ID NO: 21124 - DNA, 21 bp, Artificial Sequence
  Synthetic
gtggttactacgacttggaat

SEQ ID NO: 21125 - DNA, 21 bp, Artificial Sequence
  Synthetic
ggggagcttacggggcgttgg

SEQ ID NO: 21126 - DNA, 21 bp, Artificial Sequence
  Synthetic
ggtgcgtcgtgggatagggcg

SEQ ID NO: 21127 - DNA, 21 bp, Artificial Sequence
  Synthetic
cagtttacgcatgggtctgcg

SEQ ID NO: 21128 - DNA, 21 bp, Artificial Sequence
  Synthetic
ctggttaagcatgggtttagt

SEQ ID NO: 21129 - DNA, 21 bp, Artificial Sequence
  Synthetic
attcggacggggtatgctcag

SEQ ID NO: 21130 - DNA, 21 bp, Artificial Sequence
  Synthetic
ttgtatcatgggcatgcgtcg

SEQ ID NO: 21131 - DNA, 21 bp, Artificial Sequence
  Synthetic
ttgcctcgtgatgcgcggtgg

SEQ ID NO: 21132 - DNA, 21 bp, Artificial Sequence
  Synthetic
tgggcgactttgggttcggcg

SEQ ID NO: 21133 - DNA, 21 bp, Artificial Sequence
  Synthetic
tggcttaatgggtataatgat

SEQ ID NO: 21134 - DNA, 21 bp, Artificial Sequence
  Synthetic
tggaagcagttgggtagtagt

SEQ ID NO: 21135 - DNA, 21 bp, Artificial Sequence
  Synthetic
ctttatgctgggtttagtagt

SEQ ID NO: 21136 - DNA, 21 bp, Artificial Sequence
  Synthetic
ggttgggctgggggttcgagt

SEQ ID NO: 21137 - DNA, 21 bp, Artificial Sequence
  Synthetic
ggggcttggcatgggagtacg

SEQ ID NO: 21138 - DNA, 21 bp, Artificial Sequence
  Synthetic
ccggctgttggttcggtgtat

SEQ ID NO: 21139 - DNA, 21 bp, Artificial Sequence
  Synthetic
ttggcgtggcaggggtctcag

SEQ ID NO: 21140 - DNA, 21 bp, Artificial Sequence
  Synthetic
ccgattcctcggctggctagt

SEQ ID NO: 21141 - DNA, 21 bp, Artificial Sequence
  Synthetic
ttgcagtcgaggtatagtgcg

SEQ ID NO: 21142 - DNA, 21 bp, Artificial Sequence
  Synthetic
gggatggcgggttggtcttcg

SEQ ID NO: 21143 - DNA, 21 bp, Artificial Sequence
  Synthetic
cttaatttggggtatagtcag

SEQ ID NO: 21144 - DNA, 21 bp, Artificial Sequence
  Synthetic
gagttgacgtggacggctgcg

SEQ ID NO: 21145 - DNA, 21 bp, Artificial Sequence
  Synthetic
aatgataagtatgctgggtgg

SEQ ID NO: 21146 - DNA, 21 bp, Artificial Sequence
  Synthetic
gtttggattggtggtagttct

SEQ ID NO: 21147 - DNA, 21 bp, Artificial Sequence
  Synthetic
gttctttatcgtgagagtttg

SEQ ID NO: 21148 - DNA, 21 bp, Artificial Sequence
  Synthetic
ggttatgttgatatgcgtttt

SEQ ID NO: 21149 - DNA, 21 bp, Artificial Sequence
  Synthetic
actaggcctgcggcttgggag

SEQ ID NO: 21150 - DNA, 21 bp, Artificial Sequence
  Synthetic
tttaatagtcagtttagttat

SEQ ID NO: 21151 - DNA, 21 bp, Artificial Sequence
  Synthetic
gagtttcctggttggagtagt

SEQ ID NO: 21152 - DNA, 21 bp, Artificial Sequence
  Synthetic
aagattaatagtggtgcgtgg

SEQ ID NO: 21153 - DNA, 21 bp, Artificial Sequence
  Synthetic
aaggaggcgtgggatagggcg

SEQ ID NO: 21154 - DNA, 21 bp, Artificial Sequence
  Synthetic
gagtggccggcggatcggtcg

SEQ ID NO: 21155 - DNA, 21 bp, Artificial Sequence
  Synthetic
gcgtggccggggggggcggcg

SEQ ID NO: 21156 - DNA, 21 bp, Artificial Sequence
  Synthetic
atgagggattatggttctact

SEQ ID NO: 21157 - DNA, 21 bp, Artificial Sequence
  Synthetic
cggactgttggttctgcttat

SEQ ID NO: 21158 - DNA, 21 bp, Artificial Sequence
  Synthetic
acgagtattaataggttgtat

SEQ ID NO: 21159 - DNA, 21 bp, Artificial Sequence
  Synthetic
gatctgaatacgtcgaggtgg

SEQ ID NO: 21160 - DNA, 21 bp, Artificial Sequence
  Synthetic
ggtgggcatgtgggtgcttgg

SEQ ID NO: 21161 - DNA, 21 bp, Artificial Sequence
  Synthetic
ttgtcgattgggtttagtgtg

SEQ ID NO: 21162 - DNA, 21 bp, Artificial Sequence
  Synthetic
gctccggtgcgtcttacgaat

SEQ ID NO: 21163 - DNA, 21 bp, Artificial Sequence
  Synthetic
gttagtgtggctagtcattgg

SEQ ID NO: 21164 - DNA, 21 bp, Artificial Sequence
  Synthetic
actatgaggctgatgtcgagt

SEQ ID NO: 21165 - DNA, 21 bp, Artificial Sequence
  Synthetic
cgtgtttatggggggtctcag

SEQ ID NO: 21166 - DNA, 21 bp, Artificial Sequence
  Synthetic
cttgcgtcttggattggggct

SEQ ID NO: 21167 - DNA, 21 bp, Artificial Sequence
  Synthetic
ctgcattatggtagttctagt

SEQ ID NO: 21168 - DNA, 21 bp, Artificial Sequence
  Synthetic
atggtgactcttgttcagccg

SEQ ID NO: 21169 - DNA, 21 bp, Artificial Sequence
  Synthetic
tttatgccgcttggtagttct

SEQ ID NO: 21170 - DNA, 21 bp, Artificial Sequence
  Synthetic
ttgtttatggctggttctagt

SEQ ID NO: 21171 - DNA, 21 bp, Artificial Sequence
  Synthetic
catcctacgtggtctagtgcg

SEQ ID NO: 21172 - DNA, 21 bp, Artificial Sequence
  Synthetic
cggtatcattcggatgctagt

SEQ ID NO: 21173 - DNA, 21 bp, Artificial Sequence
  Synthetic
tggcatatggagtctggtttt

SEQ ID NO: 21174 - DNA, 21 bp, Artificial Sequence
  Synthetic
gagggtgctctgtttcgtaat

SEQ ID NO: 21175 - DNA, 21 bp, Artificial Sequence
  Synthetic
gatccgaattgggatcttggg

SEQ ID NO: 21176 - DNA, 21 bp, Artificial Sequence
  Synthetic
ccggaggtgaggaatagttgg

SEQ ID NO: 21177 - DNA, 21 bp, Artificial Sequence
  Synthetic
ttgtgggttggttctagttct

SEQ ID NO: 21178 - DNA, 21 bp, Artificial Sequence
  Synthetic
ccgcggtttggtatggcttct

SEQ ID NO: 21179 - DNA, 21 bp, Artificial Sequence
  Synthetic
gtgcaggtgggttatgctcag

SEQ ID NO: 21180 - DNA, 21 bp, Artificial Sequence
  Synthetic
atggatacttttcctaggggt

SEQ ID NO: 21181 - DNA, 21 bp, Artificial Sequence
  Synthetic
ggtaggctgctgcttgttaat

SEQ ID NO: 21182 - DNA, 21 bp, Artificial Sequence
  Synthetic
atgttgtctcatggtagttct

SEQ ID NO: 21183 - DNA, 21 bp, Artificial Sequence
  Synthetic
tggaatctttcgagtggttat

SEQ ID NO: 21184 - DNA, 21 bp, Artificial Sequence
  Synthetic
gagaagtattattcgagtgcg

SEQ ID NO: 21185 - DNA, 21 bp, Artificial Sequence
  Synthetic
gatcgtggtggttttgcgtat

SEQ ID NO: 21186 - DNA, 21 bp, Artificial Sequence
  Synthetic
gatttgaatactaataggtgg

SEQ ID NO: 21187 - DNA, 21 bp, Artificial Sequence
  Synthetic
ggttatgagtctggtcggtgg

SEQ ID NO: 21188 - DNA, 21 bp, Artificial Sequence
  Synthetic
gagaagtggggttcgtcgact

SEQ ID NO: 21189 - DNA, 21 bp, Artificial Sequence
  Synthetic
gttgtgtataatggtagtacg

SEQ ID NO: 21190 - DNA, 21 bp, Artificial Sequence
  Synthetic
gggtcgaagtggcatcttgag

SEQ ID NO: 21191 - DNA, 21 bp, Artificial Sequence
  Synthetic
gatgagaatccgggtcgttgg

SEQ ID NO: 21192 - DNA, 21 bp, Artificial Sequence
  Synthetic
ggtcatcctctgagttttagt

SEQ ID NO: 21193 - DNA, 21 bp, Artificial Sequence
  Synthetic
attgatcattcgcattgggtt

SEQ ID NO: 21194 - DNA, 21 bp, Artificial Sequence
  Synthetic
gataggtatctgggggcgact

SEQ ID NO: 21195 - DNA, 21 bp, Artificial Sequence
  Synthetic
cgggagtttgatctgcggaat

SEQ ID NO: 21196 - DNA, 21 bp, Artificial Sequence
  Synthetic
ggtaataatccgggtctttgg

SEQ ID NO: 21197 - DNA, 21 bp, Artificial Sequence
  Synthetic
tatgatagggggtattcgacg

SEQ ID NO: 21198 - DNA, 21 bp, Artificial Sequence
  Synthetic
atgatgcctttgggttctagt

SEQ ID NO: 21199 - DNA, 21 bp, Artificial Sequence
  Synthetic
cctcagtgggggaatctttcg

SEQ ID NO: 21200 - DNA, 21 bp, Artificial Sequence
  Synthetic
tctgtgagttatggttctgcg

SEQ ID NO: 21201 - DNA, 21 bp, Artificial Sequence
  Synthetic
ggtgtttatatggggagttct

SEQ ID NO: 21202 - DNA, 21 bp, Artificial Sequence
  Synthetic
cagcggtttgataatcggcct

SEQ ID NO: 21203 - DNA, 21 bp, Artificial Sequence
  Synthetic
gagcggattggtatgtcttcg

SEQ ID NO: 21204 - DNA, 21 bp, Artificial Sequence
  Synthetic
ttggtgagtcattttagttct

SEQ ID NO: 21205 - DNA, 21 bp, Artificial Sequence
  Synthetic
acggctcatgggtatagttcg

SEQ ID NO: 21206 - DNA, 21 bp, Artificial Sequence
  Synthetic
tttgctcatggttatgcgatg

SEQ ID NO: 21207 - DNA, 21 bp, Artificial Sequence
  Synthetic
tcttggccggggagttctgtg

SEQ ID NO: 21208 - DNA, 21 bp, Artificial Sequence
  Synthetic
tcgtatggggatgggaggtgg

SEQ ID NO: 21209 - DNA, 21 bp, Artificial Sequence
  Synthetic
gtgcttgcgggttatcggccg

SEQ ID NO: 21210 - DNA, 21 bp, Artificial Sequence
  Synthetic
ggtggtaatccgggtgtttgg

SEQ ID NO: 21211 - DNA, 21 bp, Artificial Sequence
  Synthetic
ttggttcatagtggtgcgtgg

SEQ ID NO: 21212 - DNA, 21 bp, Artificial Sequence
  Synthetic
atggcgacgagggggtctacg

SEQ ID NO: 21213 - DNA, 21 bp, Artificial Sequence
  Synthetic
attaaggctcctgggccttgg

SEQ ID NO: 21214 - DNA, 21 bp, Artificial Sequence
  Synthetic
tggctgcatgggtattcttcg

SEQ ID NO: 21215 - DNA, 21 bp, Artificial Sequence
  Synthetic
ctggagagtaagtttagttcg

SEQ ID NO: 21216 - DNA, 21 bp, Artificial Sequence
  Synthetic
atgcagaaggggttttctacg

SEQ ID NO: 21217 - DNA, 21 bp, Artificial Sequence
  Synthetic
acgatgccgggttatagtgcg

SEQ ID NO: 21218 - DNA, 21 bp, Artificial Sequence
  Synthetic
gctgtgcgtgtgaatggttgg

SEQ ID NO: 21219 - DNA, 21 bp, Artificial Sequence
  Synthetic
tcttttagtggtattcctgtg

SEQ ID NO: 21220 - DNA, 21 bp, Artificial Sequence
  Synthetic
tatagggagcttccgagggtg

SEQ ID NO: 21221 - DNA, 21 bp, Artificial Sequence
  Synthetic
agttcgccggggtggagttct

SEQ ID NO: 21222 - DNA, 21 bp, Artificial Sequence
  Synthetic
gagcctcgttggagtctggat

SEQ ID NO: 21223 - DNA, 21 bp, Artificial Sequence
  Synthetic
aggtctgagcattctaattgg

SEQ ID NO: 21224 - DNA, 21 bp, Artificial Sequence
  Synthetic
gtggcggcggggtttgcgcag

SEQ ID NO: 21225 - DNA, 21 bp, Artificial Sequence
  Synthetic
acttatcatgggtatgctagt

SEQ ID NO: 21226 - DNA, 21 bp, Artificial Sequence
  Synthetic
tggcgttctaatggttctagt

SEQ ID NO: 21227 - DNA, 21 bp, Artificial Sequence
  Synthetic
gtgatgcgtgggtatgctgcg

SEQ ID NO: 21228 - DNA, 21 bp, Artificial Sequence
  Synthetic
tgggttagtttgggttctgcg

SEQ ID NO: 21229 - DNA, 21 bp, Artificial Sequence
  Synthetic
gtttatattggtatgagttct

SEQ ID NO: 21230 - DNA, 21 bp, Artificial Sequence
  Synthetic
aggtcggggtatgctgattgg

SEQ ID NO: 21231 - DNA, 21 bp, Artificial Sequence
  Synthetic
ttgcaggcttcttggtcgcat

SEQ ID NO: 21232 - DNA, 21 bp, Artificial Sequence
  Synthetic
aggtatgaggctgatgcggct

SEQ ID NO: 21233 - DNA, 21 bp, Artificial Sequence
  Synthetic
tggacgctggggacggggcat

SEQ ID NO: 21234 - DNA, 21 bp, Artificial Sequence
  Synthetic
ctgaattatggtgggtctatg

SEQ ID NO: 21235 - DNA, 21 bp, Artificial Sequence
  Synthetic
aagcagatggggtttagttct

SEQ ID NO: 21236 - DNA, 21 bp, Artificial Sequence
  Synthetic
gatacgcatgctgggcgttgg

SEQ ID NO: 21237 - DNA, 21 bp, Artificial Sequence
  Synthetic
tggcctgggtttacgagtacg

SEQ ID NO: 21238 - DNA, 21 bp, Artificial Sequence
  Synthetic
cgtcatcctgggggggcgcag

SEQ ID NO: 21239 - DNA, 21 bp, Artificial Sequence
  Synthetic
tattatcttccgaatggggat

SEQ ID NO: 21240 - DNA, 21 bp, Artificial Sequence
  Synthetic
ctggcgcggatgggttcgacg

SEQ ID NO: 21241 - DNA, 21 bp, Artificial Sequence
  Synthetic
ttggtgcagtatgggtctgcg

SEQ ID NO: 21242 - DNA, 21 bp, Artificial Sequence
  Synthetic
tctattaggcctaatgggtgg

SEQ ID NO: 21243 - DNA, 21 bp, Artificial Sequence
  Synthetic
ctgtatcatgggtctagtagt

SEQ ID NO: 21244 - DNA, 21 bp, Artificial Sequence
  Synthetic
aaggcgcctgggttttcgcag

SEQ ID NO: 21245 - DNA, 21 bp, Artificial Sequence
  Synthetic
ctggctacttatttggcttcg

SEQ ID NO: 21246 - DNA, 21 bp, Artificial Sequence
  Synthetic
gggattttgcaggggtatggg

SEQ ID NO: 21247 - DNA, 21 bp, Artificial Sequence
  Synthetic
aagcatccggggctgagtagt

SEQ ID NO: 21248 - DNA, 21 bp, Artificial Sequence
  Synthetic
ttgtatactggtttggcgcag

SEQ ID NO: 21249 - DNA, 21 bp, Artificial Sequence
  Synthetic
gatgttaagtggtcttatagt

SEQ ID NO: 21250 - DNA, 21 bp, Artificial Sequence
  Synthetic
cgttatagtttgggtgagccg

SEQ ID NO: 21251 - DNA, 21 bp, Artificial Sequence
  Synthetic
cctttgcctaattggtcgcat

SEQ ID NO: 21252 - DNA, 21 bp, Artificial Sequence
  Synthetic
actcttcggctgggttcgacg

SEQ ID NO: 21253 - DNA, 21 bp, Artificial Sequence
  Synthetic
acttatcatggtggggcgtct

SEQ ID NO: 21254 - DNA, 21 bp, Artificial Sequence
  Synthetic
catacgcagtatgaggggtgg

SEQ ID NO: 21255 - DNA, 21 bp, Artificial Sequence
  Synthetic
tttggtccttttctttcgagt

SEQ ID NO: 21256 - DNA, 21 bp, Artificial Sequence
  Synthetic
attgtgtggaatggtagttcg

SEQ ID NO: 21257 - DNA, 21 bp, Artificial Sequence
  Synthetic
cctgtggattcggcgcggtgg

SEQ ID NO: 21258 - DNA, 21 bp, Artificial Sequence
  Synthetic
tggagtgttcatggttcgagt

SEQ ID NO: 21259 - DNA, 21 bp, Artificial Sequence
  Synthetic
cagagggctgggtgggcggcg

SEQ ID NO: 21260 - DNA, 21 bp, Artificial Sequence
  Synthetic
cggtttttgggggatatttct

SEQ ID NO: 21261 - DNA, 21 bp, Artificial Sequence
  Synthetic
cgttatccgggtggtgctcag

SEQ ID NO: 21262 - DNA, 21 bp, Artificial Sequence
  Synthetic
gttcgtgctgggttttcgagt

SEQ ID NO: 21263 - DNA, 21 bp, Artificial Sequence
  Synthetic
tgggtgttgccggatcatggt

SEQ ID NO: 21264 - DNA, 21 bp, Artificial Sequence
  Synthetic
cagggtaatcctgggctttgg

SEQ ID NO: 21265 - DNA, 21 bp, Artificial Sequence
  Synthetic
tcggtgactggtcggctgtat

SEQ ID NO: 21266 - DNA, 21 bp, Artificial Sequence
  Synthetic
cctgagactagtaggcattgg

SEQ ID NO: 21267 - DNA, 21 bp, Artificial Sequence
  Synthetic
ccgtggcctggtatgagttct

SEQ ID NO: 21268 - DNA, 21 bp, Artificial Sequence
  Synthetic
ggtgattggtctaggattgct

SEQ ID NO: 21269 - DNA, 21 bp, Artificial Sequence
  Synthetic
gattctcggtttggttctagt

SEQ ID NO: 21270 - DNA, 21 bp, Artificial Sequence
  Synthetic
atgaggtctggtctgtctcag

SEQ ID NO: 21271 - DNA, 21 bp, Artificial Sequence
  Synthetic
ctgaattggagtgggagttcg

SEQ ID NO: 21272 - DNA, 21 bp, Artificial Sequence
  Synthetic
tcttatcgtcctgctcctgcg

SEQ ID NO: 21273 - DNA, 21 bp, Artificial Sequence
  Synthetic
atgtttcatagtgggagtact

SEQ ID NO: 21274 - DNA, 21 bp, Artificial Sequence
  Synthetic
cctaggaatactaatggttgg

SEQ ID NO: 21275 - DNA, 21 bp, Artificial Sequence
  Synthetic
gaggggccttctcggtgggat

SEQ ID NO: 21276 - DNA, 21 bp, Artificial Sequence
  Synthetic
ctggctcctccttggtcgagt

SEQ ID NO: 21277 - DNA, 21 bp, Artificial Sequence
  Synthetic
tatgcgtcgtgggttccgaag

SEQ ID NO: 21278 - DNA, 21 bp, Artificial Sequence
  Synthetic
cattggagtggggggtcgagt

SEQ ID NO: 21279 - DNA, 21 bp, Artificial Sequence
  Synthetic
gtgtatgttggtcattcttcg

SEQ ID NO: 21280 - DNA, 21 bp, Artificial Sequence
  Synthetic
cctacgtggggttctgggtct

SEQ ID NO: 21281 - DNA, 21 bp, Artificial Sequence
  Synthetic
gagtcggtggctggttattgg

SEQ ID NO: 21282 - DNA, 21 bp, Artificial Sequence
  Synthetic
acggagcggtatgggtctacg

SEQ ID NO: 21283 - DNA, 21 bp, Artificial Sequence
  Synthetic
gaggcgaagtggggtagtact

SEQ ID NO: 21284 - DNA, 21 bp, Artificial Sequence
  Synthetic
ttggagattggttggtcttcg

SEQ ID NO: 21285 - DNA, 21 bp, Artificial Sequence
  Synthetic
atggcgtttcttcttcagcct

SEQ ID NO: 21286 - DNA, 21 bp, Artificial Sequence
  Synthetic
gtgaggtctggttattcggct

SEQ ID NO: 21287 - DNA, 21 bp, Artificial Sequence
  Synthetic
atgtatcctggtagttcgtcg

SEQ ID NO: 21288 - DNA, 21 bp, Artificial Sequence
  Synthetic
actgtgaggggttatgctagt

SEQ ID NO: 21289 - DNA, 21 bp, Artificial Sequence
  Synthetic
ttgattccgcggggttctacg

SEQ ID NO: 21290 - DNA, 21 bp, Artificial Sequence
  Synthetic
actcatgctgggtttagtacg

SEQ ID NO: 21291 - DNA, 21 bp, Artificial Sequence
  Synthetic
gtgagttatggttctgcgtat

SEQ ID NO: 21292 - DNA, 21 bp, Artificial Sequence
  Synthetic
ctgcagtttcgtttgcctgat

SEQ ID NO: 21293 - DNA, 21 bp, Artificial Sequence
  Synthetic
atgcatagtgggtattcgagt

SEQ ID NO: 21294 - DNA, 21 bp, Artificial Sequence
  Synthetic
catcctgcgtggggttcggcg

SEQ ID NO: 21295 - DNA, 21 bp, Artificial Sequence
  Synthetic
ggtcgggatcctgggcggtgg

SEQ ID NO: 21296 - DNA, 21 bp, Artificial Sequence
  Synthetic
cgttatattggggataatgtg

SEQ ID NO: 21297 - DNA, 21 bp, Artificial Sequence
  Synthetic
gatttgactactcggtgggcg

SEQ ID NO: 21298 - DNA, 21 bp, Artificial Sequence
  Synthetic
ttgagggatgggtggtctcag

SEQ ID NO: 21299 - DNA, 21 bp, Artificial Sequence
  Synthetic
gatcctcattggtcgagtgct

SEQ ID NO: 21300 - DNA, 21 bp, Artificial Sequence
  Synthetic
gagcgtactgggtattcgatg

SEQ ID NO: 21301 - DNA, 21 bp, Artificial Sequence
  Synthetic
acgattaggatgggttctagt

SEQ ID NO: 21302 - DNA, 21 bp, Artificial Sequence
  Synthetic
cagcgtattatgggttctacg

SEQ ID NO: 21303 - DNA, 21 bp, Artificial Sequence
  Synthetic
gagacgccttctaggtggtct

SEQ ID NO: 21304 - DNA, 21 bp, Artificial Sequence
  Synthetic
gtgtcgtatcatggtagtagt

SEQ ID NO: 21305 - DNA, 21 bp, Artificial Sequence
  Synthetic
atggttcctttggggtcttcg

SEQ ID NO: 21306 - DNA, 21 bp, Artificial Sequence
  Synthetic
tggacgcataatgctgggtat

SEQ ID NO: 21307 - DNA, 21 bp, Artificial Sequence
  Synthetic
tggggttcgcctcagcatagt

SEQ ID NO: 21308 - DNA, 21 bp, Artificial Sequence
  Synthetic
tttacgcttcaggggaggccg

SEQ ID NO: 21309 - DNA, 21 bp, Artificial Sequence
  Synthetic
gtgaggatgatggggtcgagt

SEQ ID NO: 21310 - DNA, 21 bp, Artificial Sequence
  Synthetic
tatttgagtgggtatacgtgt

SEQ ID NO: 21311 - DNA, 21 bp, Artificial Sequence
  Synthetic
ccgtttccgcatacgagtgct

SEQ ID NO: 21312 - DNA, 21 bp, Artificial Sequence
  Synthetic
gagcggtatgttattcagacg

SEQ ID NO: 21313 - DNA, 21 bp, Artificial Sequence
  Synthetic
ggtgtgaatcaggcgcggttt

SEQ ID NO: 21314 - DNA, 21 bp, Artificial Sequence
  Synthetic
aggtatcagggggattcggcg

SEQ ID NO: 21315 - DNA, 21 bp, Artificial Sequence
  Synthetic
gtggtgcctggtttttctagt

SEQ ID NO: 21316 - DNA, 21 bp, Artificial Sequence
  Synthetic
ggtgcgcctggttggtcgact

SEQ ID NO: 21317 - DNA, 21 bp, Artificial Sequence
  Synthetic
gagaagtatggtggttcgacg

SEQ ID NO: 21318 - DNA, 21 bp, Artificial Sequence
  Synthetic
tggagtttgggggggagtacg

SEQ ID NO: 21319 - DNA, 21 bp, Artificial Sequence
  Synthetic
cgtaaggagtttggtagttcg

SEQ ID NO: 21320 - DNA, 21 bp, Artificial Sequence
  Synthetic
gagcagacttgggggagttct

SEQ ID NO: 21321 - DNA, 21 bp, Artificial Sequence
  Synthetic
agttcttatatggggtcgact

SEQ ID NO: 21322 - DNA, 21 bp, Artificial Sequence
  Synthetic
cttcgtccgggttggtcgcag

SEQ ID NO: 21323 - DNA, 21 bp, Artificial Sequence
  Synthetic
atggcgccgtggacgtctacg

SEQ ID NO: 21324 - DNA, 21 bp, Artificial Sequence
  Synthetic
tgtccggcgttgattcattgt

SEQ ID NO: 21325 - DNA, 21 bp, Artificial Sequence
  Synthetic
gagaggacgctgtgggcggct

SEQ ID NO: 21326 - DNA, 21 bp, Artificial Sequence
  Synthetic
cctgatatgcatcgtcagtgg

SEQ ID NO: 21327 - DNA, 21 bp, Artificial Sequence
  Synthetic
cttagttatatgggttcgcat

SEQ ID NO: 21328 - DNA, 21 bp, Artificial Sequence
  Synthetic
gctattacgcatggttcggcg

SEQ ID NO: 21329 - DNA, 21 bp, Artificial Sequence
  Synthetic
cagagtgatctgcagtattgg

SEQ ID NO: 21330 - DNA, 21 bp, Artificial Sequence
  Synthetic
tggcgggattatgggagtatg

SEQ ID NO: 21331 - DNA, 21 bp, Artificial Sequence
  Synthetic
gtgaatctggggtattcttct

SEQ ID NO: 21332 - DNA, 21 bp, Artificial Sequence
  Synthetic
gagcatggtgggggtcgttgg

SEQ ID NO: 21333 - DNA, 21 bp, Artificial Sequence
  Synthetic
gggatttttgctggtcagtat

SEQ ID NO: 21334 - DNA, 21 bp, Artificial Sequence
  Synthetic
gggacggggtatgatttgcgg

SEQ ID NO: 21335 - DNA, 21 bp, Artificial Sequence
  Synthetic
aagggtactaatgatttttgg

SEQ ID NO: 21336 - DNA, 21 bp, Artificial Sequence
  Synthetic
gatcttagttcggctcggtgg

SEQ ID NO: 21337 - DNA, 21 bp, Artificial Sequence
  Synthetic
tttgtgtatggtcagattgcg

SEQ ID NO: 21338 - DNA, 21 bp, Artificial Sequence
  Synthetic
cctgttccggtgtatggggct

SEQ ID NO: 21339 - DNA, 21 bp, Artificial Sequence
  Synthetic
cctcatgctgggtatagtgcg

SEQ ID NO: 21340 - DNA, 21 bp, Artificial Sequence
  Synthetic
gttcttcaggcgatggggatg

SEQ ID NO: 21341 - DNA, 21 bp, Artificial Sequence
  Synthetic
cgttatgcgggtgatagtact

SEQ ID NO: 21342 - DNA, 21 bp, Artificial Sequence
  Synthetic
ctgagggtggtgttgacgaat

SEQ ID NO: 21343 - DNA, 21 bp, Artificial Sequence
  Synthetic
gagaagtttagggttgatgtg

SEQ ID NO: 21344 - DNA, 21 bp, Artificial Sequence
  Synthetic
tatgcggattggcagcggagt

SEQ ID NO: 21345 - DNA, 21 bp, Artificial Sequence
  Synthetic
ccgccttttcgggtggatgtt

SEQ ID NO: 21346 - DNA, 21 bp, Artificial Sequence
  Synthetic
gataggccttatgggtcggct

SEQ ID NO: 21347 - DNA, 21 bp, Artificial Sequence
  Synthetic
gctgcgttttcgaatggttgg

SEQ ID NO: 21348 - DNA, 21 bp, Artificial Sequence
  Synthetic
cctcataatccgggtgcgtgg

SEQ ID NO: 21349 - DNA, 21 bp, Artificial Sequence
  Synthetic
gctgctccgtttttttcgagt

SEQ ID NO: 21350 - DNA, 21 bp, Artificial Sequence
  Synthetic
gagtttctgggtggtagtact

SEQ ID NO: 21351 - DNA, 21 bp, Artificial Sequence
  Synthetic
gagtatggggaggggcgttgg

SEQ ID NO: 21352 - DNA, 21 bp, Artificial Sequence
  Synthetic
ttgttgcgggggctgagtagt

SEQ ID NO: 21353 - DNA, 21 bp, Artificial Sequence
  Synthetic
gggcagtggcaggggagtacg

SEQ ID NO: 21354 - DNA, 21 bp, Artificial Sequence
  Synthetic
ggtgaggtgaattggagttat

SEQ ID NO: 21355 - DNA, 21 bp, Artificial Sequence
  Synthetic
gatccggggatggtgcggtgg

SEQ ID NO: 21356 - DNA, 21 bp, Artificial Sequence
  Synthetic
cttaggttgggtctttctact

SEQ ID NO: 21357 - DNA, 21 bp, Artificial Sequence
  Synthetic
tggtcggcttcgatgggttat

SEQ ID NO: 21358 - DNA, 21 bp, Artificial Sequence
  Synthetic
catgttgttctggggtatagt

SEQ ID NO: 21359 - DNA, 21 bp, Artificial Sequence
  Synthetic
aaggcttttgatctgcggact

SEQ ID NO: 21360 - DNA, 21 bp, Artificial Sequence
  Synthetic
tggcaggtggatcggggtttt

SEQ ID NO: 21361 - DNA, 21 bp, Artificial Sequence
  Synthetic
tatagggagtatcctgatcat

SEQ ID NO: 21362 - DNA, 21 bp, Artificial Sequence
  Synthetic
cattatgttgggagtgcgagt

SEQ ID NO: 21363 - DNA, 21 bp, Artificial Sequence
  Synthetic
ctgtattctgggagtatttat

SEQ ID NO: 21364 - DNA, 21 bp, Artificial Sequence
  Synthetic
gagcattatttgggtgctgct

SEQ ID NO: 21365 - DNA, 21 bp, Artificial Sequence
  Synthetic
gatcataagtgggagtcttct

SEQ ID NO: 21366 - DNA, 21 bp, Artificial Sequence
  Synthetic
ggtacgtctcctggtcgttgg

SEQ ID NO: 21367 - DNA, 21 bp, Artificial Sequence
  Synthetic
ctgaatcgggggactgtgtat

SEQ ID NO: 21368 - DNA, 21 bp, Artificial Sequence
  Synthetic
gataatcttagtgcgaggtgg

SEQ ID NO: 21369 - DNA, 21 bp, Artificial Sequence
  Synthetic
aagtattatggtgagagtagt

SEQ ID NO: 21370 - DNA, 21 bp, Artificial Sequence
  Synthetic
gggcatcagcatgatctgcgt

SEQ ID NO: 21371 - DNA, 21 bp, Artificial Sequence
  Synthetic
gagtggcatggtggggcgtct

SEQ ID NO: 21372 - DNA, 21 bp, Artificial Sequence
  Synthetic
tggtctctggatgttgggttt

SEQ ID NO: 21373 - DNA, 21 bp, Artificial Sequence
  Synthetic
tcttggtcgcatggggctgct

SEQ ID NO: 21374 - DNA, 21 bp, Artificial Sequence
  Synthetic
ttggtgtttcatgggtcggcg

SEQ ID NO: 21375 - DNA, 21 bp, Artificial Sequence
  Synthetic
gctaataagtattctattagt

SEQ ID NO: 21376 - DNA, 21 bp, Artificial Sequence
  Synthetic
atttgggtgggtcattcgagt

SEQ ID NO: 21377 - DNA, 21 bp, Artificial Sequence
  Synthetic
gaggctcgttatgggagtagt

SEQ ID NO: 21378 - DNA, 21 bp, Artificial Sequence
  Synthetic
tggcgggatcttggttctgtg

SEQ ID NO: 21379 - DNA, 21 bp, Artificial Sequence
  Synthetic
tttatttcgcatgggagtgcg

SEQ ID NO: 21380 - DNA, 21 bp, Artificial Sequence
  Synthetic
gagtggcctggtggtgcgcgt

SEQ ID NO: 21381 - DNA, 21 bp, Artificial Sequence
  Synthetic
gcttggggtagtcttggggcg

SEQ ID NO: 21382 - DNA, 21 bp, Artificial Sequence
  Synthetic
ctttcgcatgggtattctagt

SEQ ID NO: 21383 - DNA, 21 bp, Artificial Sequence
  Synthetic
catgagaatctggggcgttgg

SEQ ID NO: 21384 - DNA, 21 bp, Artificial Sequence
  Synthetic
agggggagtctggagtattat

SEQ ID NO: 21385 - DNA, 21 bp, Artificial Sequence
  Synthetic
ggggaggatagggctcgttgg

SEQ ID NO: 21386 - DNA, 21 bp, Artificial Sequence
  Synthetic
tggggtcttcctaatcatagt

SEQ ID NO: 21387 - DNA, 21 bp, Artificial Sequence
  Synthetic
caggctgcgggttggtcttcg

SEQ ID NO: 21388 - DNA, 21 bp, Artificial Sequence
  Synthetic
gggcagaatacggggctgtgg

SEQ ID NO: 21389 - DNA, 21 bp, Artificial Sequence
  Synthetic
aagtatgtggggtggtcggag

SEQ ID NO: 21390 - DNA, 21 bp, Artificial Sequence
  Synthetic
tctgtgtggcaggggtcgact

SEQ ID NO: 21391 - DNA, 21 bp, Artificial Sequence
  Synthetic
aagtatcctggttctagtgcg

SEQ ID NO: 21392 - DNA, 21 bp, Artificial Sequence
  Synthetic
gattggaggggggggtctgtg

SEQ ID NO: 21393 - DNA, 21 bp, Artificial Sequence
  Synthetic
gatttgactcgtaatcattgg

SEQ ID NO: 21394 - DNA, 21 bp, Artificial Sequence
  Synthetic
tatctggcgggttatgagagg

SEQ ID NO: 21395 - DNA, 21 bp, Artificial Sequence
  Synthetic
tgggtgcatggggggtcgact

SEQ ID NO: 21396 - DNA, 21 bp, Artificial Sequence
  Synthetic
tgttggggttgtccgggtgag

SEQ ID NO: 21397 - DNA, 21 bp, Artificial Sequence
  Synthetic
tgttttcctgtgggtcattgt

SEQ ID NO: 21398 - DNA, 21 bp, Artificial Sequence
  Synthetic
cctgaggatcctgggccttgg

SEQ ID NO: 21399 - DNA, 21 bp, Artificial Sequence
  Synthetic
tcttttctgcttggtagtgct

SEQ ID NO: 21400 - DNA, 21 bp, Artificial Sequence
  Synthetic
ctgaagtctacgtggagttcg

SEQ ID NO: 21401 - DNA, 21 bp, Artificial Sequence
  Synthetic
gtggagaggtgggggtctgcg

SEQ ID NO: 21402 - DNA, 21 bp, Artificial Sequence
  Synthetic
gtgaataagtatgcgattaat

SEQ ID NO: 21403 - DNA, 21 bp, Artificial Sequence
  Synthetic
ttgaatcatggttgggcttct

SEQ ID NO: 21404 - DNA, 21 bp, Artificial Sequence
  Synthetic
tttacggctgatagtcgtccg

SEQ ID NO: 21405 - DNA, 21 bp, Artificial Sequence
  Synthetic
gatcagcgggcgtggggggct

SEQ ID NO: 21406 - DNA, 21 bp, Artificial Sequence
  Synthetic
gaggtgcctagtcggtggaat

SEQ ID NO: 21407 - DNA, 21 bp, Artificial Sequence
  Synthetic
atgttgcttcgggagactctg

SEQ ID NO: 21408 - DNA, 21 bp, Artificial Sequence
  Synthetic
cgggagtttgatttgcgtatg

SEQ ID NO: 21409 - DNA, 21 bp, Artificial Sequence
  Synthetic
tggtcggtgcagtcggggcat

SEQ ID NO: 21410 - DNA, 21 bp, Artificial Sequence
  Synthetic
gatgttcaggtgcgttggtcg

SEQ ID NO: 21411 - DNA, 21 bp, Artificial Sequence
  Synthetic
ggggtttgggggtcggtggcg

SEQ ID NO: 21412 - DNA, 21 bp, Artificial Sequence
  Synthetic
gatgcgccgggggctaggtat

SEQ ID NO: 21413 - DNA, 21 bp, Artificial Sequence
  Synthetic
gcgattaggccggcggggtgg

SEQ ID NO: 21414 - DNA, 21 bp, Artificial Sequence
  Synthetic
acggttacgtggcatgctgat

SEQ ID NO: 21415 - DNA, 21 bp, Artificial Sequence
  Synthetic
atggagtttttgcgtgtgccg

SEQ ID NO: 21416 - DNA, 21 bp, Artificial Sequence
  Synthetic
gatatgtggttggggagtgct

SEQ ID NO: 21417 - DNA, 21 bp, Artificial Sequence
  Synthetic
gtgcagcatcctgggcagtgg

SEQ ID NO: 21418 - DNA, 21 bp, Artificial Sequence
  Synthetic
ttgcttacgtttggtagtagt

SEQ ID NO: 21419 - DNA, 21 bp, Artificial Sequence
  Synthetic
ctgctgacttatgggtctacg

SEQ ID NO: 21420 - DNA, 21 bp, Artificial Sequence
  Synthetic
tctatgatttatggttcggcg

SEQ ID NO: 21421 - DNA, 21 bp, Artificial Sequence
  Synthetic
tatttggtgggttttaagccg

SEQ ID NO: 21422 - DNA, 21 bp, Artificial Sequence
  Synthetic
gtgtgggcggggtcgagtagt

SEQ ID NO: 21423 - DNA, 21 bp, Artificial Sequence
  Synthetic
ttttataggggggattcttct

SEQ ID NO: 21424 - DNA, 21 bp, Artificial Sequence
  Synthetic
aggagtgagcatagtacttgg

SEQ ID NO: 21425 - DNA, 21 bp, Artificial Sequence
  Synthetic
gttgggtattcgttggggttg

SEQ ID NO: 21426 - DNA, 21 bp, Artificial Sequence
  Synthetic
gctactgattctgcgcggtgg

SEQ ID NO: 21427 - DNA, 21 bp, Artificial Sequence
  Synthetic
ctggttttgcggatgagttct

SEQ ID NO: 21428 - DNA, 21 bp, Artificial Sequence
  Synthetic
ccttattttggtcaggcttct

SEQ ID NO: 21429 - DNA, 21 bp, Artificial Sequence
  Synthetic
attactgtgggtcgtgtttat

SEQ ID NO: 21430 - DNA, 21 bp, Artificial Sequence
  Synthetic
ggtggtcatcctgggagttgg

SEQ ID NO: 21431 - DNA, 21 bp, Artificial Sequence
  Synthetic
tggcattctcttactgtgagt

SEQ ID NO: 21432 - DNA, 21 bp, Artificial Sequence
  Synthetic
attgatgcttcttattgggct

SEQ ID NO: 21433 - DNA, 21 bp, Artificial Sequence
  Synthetic
actgagaggtatgggtcgtct

SEQ ID NO: 21434 - DNA, 21 bp, Artificial Sequence
  Synthetic
ggtgctccgggttggagtact

SEQ ID NO: 21435 - DNA, 21 bp, Artificial Sequence
  Synthetic
cggtttgttggtgattttggg

SEQ ID NO: 21436 - DNA, 21 bp, Artificial Sequence
  Synthetic
ttgagtaagggtttttcgact

SEQ ID NO: 21437 - DNA, 21 bp, Artificial Sequence
  Synthetic
aggatgtcttatggtagtgcg

SEQ ID NO: 21438 - DNA, 21 bp, Artificial Sequence
  Synthetic
cgtgctcttgggcttagtagt

SEQ ID NO: 21439 - DNA, 21 bp, Artificial Sequence
  Synthetic
gtgagtaatactggtcggtgg

SEQ ID NO: 21440 - DNA, 21 bp, Artificial Sequence
  Synthetic
actgtgcgttatggttttgat

SEQ ID NO: 21441 - DNA, 21 bp, Artificial Sequence
  Synthetic
cttcgtgaggggtatagtact

SEQ ID NO: 21442 - DNA, 21 bp, Artificial Sequence
  Synthetic
ttttttaagctggggtcggcg

SEQ ID NO: 21443 - DNA, 21 bp, Artificial Sequence
  Synthetic
tgggtgttggatgcggatcgg

SEQ ID NO: 21444 - DNA, 21 bp, Artificial Sequence
  Synthetic
cggcatgtggcggaggcttct

SEQ ID NO: 21445 - DNA, 21 bp, Artificial Sequence
  Synthetic
agtgcttggcagggtagtagt

SEQ ID NO: 21446 - DNA, 21 bp, Artificial Sequence
  Synthetic
gagaagctttttggggcggcg

SEQ ID NO: 21447 - DNA, 21 bp, Artificial Sequence
  Synthetic
gggggttggggtgggtcgacg

SEQ ID NO: 21448 - DNA, 21 bp, Artificial Sequence
  Synthetic
actggggtgacgaggtgggat

SEQ ID NO: 21449 - DNA, 21 bp, Artificial Sequence
  Synthetic
aatgagtggagggggtcttct

SEQ ID NO: 21450 - DNA, 21 bp, Artificial Sequence
  Synthetic
tggatgtatgggggtactggg

SEQ ID NO: 21451 - DNA, 21 bp, Artificial Sequence
  Synthetic
tttactcgtgatgctgtgccg

SEQ ID NO: 21452 - DNA, 21 bp, Artificial Sequence
  Synthetic
ccgattgcgcatgcgtatagt

SEQ ID NO: 21453 - DNA, 21 bp, Artificial Sequence
  Synthetic
ttggttggtcgtttgatgggg

SEQ ID NO: 21454 - DNA, 21 bp, Artificial Sequence
  Synthetic
catcttcatggttattcggat

SEQ ID NO: 21455 - DNA, 21 bp, Artificial Sequence
  Synthetic
actgattatgcgaatcggtgg

SEQ ID NO: 21456 - DNA, 21 bp, Artificial Sequence
  Synthetic
gctttttataatggttcggct

SEQ ID NO: 21457 - DNA, 21 bp, Artificial Sequence
  Synthetic
gctgtttcttatgggtcggct

SEQ ID NO: 21458 - DNA, 21 bp, Artificial Sequence
  Synthetic
gatgctcatgtgacgcgttgg

SEQ ID NO: 21459 - DNA, 21 bp, Artificial Sequence
  Synthetic
tcttggcatggtggtgctgtt

SEQ ID NO: 21460 - DNA, 21 bp, Artificial Sequence
  Synthetic
tgggctgttggtgggagtcag

SEQ ID NO: 21461 - DNA, 21 bp, Artificial Sequence
  Synthetic
ctttggtcggggtcttcttcg

SEQ ID NO: 21462 - DNA, 21 bp, Artificial Sequence
  Synthetic
aatcttcagtggcgggctgat

SEQ ID NO: 21463 - DNA, 21 bp, Artificial Sequence
  Synthetic
aatgatcattcggggcgttgg

SEQ ID NO: 21464 - DNA, 21 bp, Artificial Sequence
  Synthetic
agtgggccggggcagtgggtt

SEQ ID NO: 21465 - DNA, 21 bp, Artificial Sequence
  Synthetic
gtgaggtatagtctggatatg

SEQ ID NO: 21466 - DNA, 21 bp, Artificial Sequence
  Synthetic
tttagtattggtttttcgagt

SEQ ID NO: 21467 - DNA, 21 bp, Artificial Sequence
  Synthetic
tctccgtggaagttgcctgat

SEQ ID NO: 21468 - DNA, 21 bp, Artificial Sequence
  Synthetic
tggttgctgccgtctgatagg

SEQ ID NO: 21469 - DNA, 21 bp, Artificial Sequence
  Synthetic
gcgagggctgggtatggtttt

SEQ ID NO: 21470 - DNA, 21 bp, Artificial Sequence
  Synthetic
tgggtgctgccgaatgggtct

SEQ ID NO: 21471 - DNA, 21 bp, Artificial Sequence
  Synthetic
gagtggacgcatggtgcgagt

SEQ ID NO: 21472 - DNA, 21 bp, Artificial Sequence
  Synthetic
ttgtttcaggggcattcgtcg

SEQ ID NO: 21473 - DNA, 21 bp, Artificial Sequence
  Synthetic
tcgtttatgcatgggtcgtct

SEQ ID NO: 21474 - DNA, 21 bp, Artificial Sequence
  Synthetic
gaggatggttcgggtcggtgg

SEQ ID NO: 21475 - DNA, 21 bp, Artificial Sequence
  Synthetic
gattcgtggagggggtcggtg

SEQ ID NO: 21476 - DNA, 21 bp, Artificial Sequence
  Synthetic
ggtgtggagaggcggtgggat

SEQ ID NO: 21477 - DNA, 21 bp, Artificial Sequence
  Synthetic
ttgttgaagggttggagtacg

SEQ ID NO: 21478 - DNA, 21 bp, Artificial Sequence
  Synthetic
ggtgagatggtgggtcgttgg

SEQ ID NO: 21479 - DNA, 21 bp, Artificial Sequence
  Synthetic
actacgaagaatacttggact

SEQ ID NO: 21480 - DNA, 21 bp, Artificial Sequence
  Synthetic
attattaagggttattcgtcg

SEQ ID NO: 21481 - DNA, 21 bp, Artificial Sequence
  Synthetic
tgtaagcttatgggtagtgct

SEQ ID NO: 21482 - DNA, 21 bp, Artificial Sequence
  Synthetic
ctttatccggggacttctacg

SEQ ID NO: 21483 - DNA, 21 bp, Artificial Sequence
  Synthetic
gctcctatggattcgaggtgg

SEQ ID NO: 21484 - DNA, 21 bp, Artificial Sequence
  Synthetic
tttagttcgtggaatctggcg

SEQ ID NO: 21485 - DNA, 21 bp, Artificial Sequence
  Synthetic
agggggagtcctggggtgtgg

SEQ ID NO: 21486 - DNA, 21 bp, Artificial Sequence
  Synthetic
ttgtgggagtttggtagtcag

SEQ ID NO: 21487 - DNA, 21 bp, Artificial Sequence
  Synthetic
tcgcgggagtgggggtcggct

SEQ ID NO: 21488 - DNA, 21 bp, Artificial Sequence
  Synthetic
gagagtggttctgttcgttgg

SEQ ID NO: 21489 - DNA, 21 bp, Artificial Sequence
  Synthetic
tgggggttgtttgttagtgag

SEQ ID NO: 21490 - DNA, 21 bp, Artificial Sequence
  Synthetic
gggagtgatacgagtcgttgg

SEQ ID NO: 21491 - DNA, 21 bp, Artificial Sequence
  Synthetic
ggggatgcgaggtttgggctg

SEQ ID NO: 21492 - DNA, 21 bp, Artificial Sequence
  Synthetic
gttgtgagtggttggtcttct

SEQ ID NO: 21493 - DNA, 21 bp, Artificial Sequence
  Synthetic
gatgcgtcgagtgcgcggtgg

SEQ ID NO: 21494 - DNA, 21 bp, Artificial Sequence
  Synthetic
tgggatcatgttcgtaatttt

SEQ ID NO: 21495 - DNA, 21 bp, Artificial Sequence
  Synthetic
attcgtagtatgggttcgagt

SEQ ID NO: 21496 - DNA, 21 bp, Artificial Sequence
  Synthetic
agtccgacttggcgggttgat

SEQ ID NO: 21497 - DNA, 21 bp, Artificial Sequence
  Synthetic
atgtattttccggaggcgagt

SEQ ID NO: 21498 - DNA, 21 bp, Artificial Sequence
  Synthetic
acggcgtgggggggttcgcag

SEQ ID NO: 21499 - DNA, 21 bp, Artificial Sequence
  Synthetic
gatagtactcctggtaggtgg

SEQ ID NO: 21500 - DNA, 21 bp, Artificial Sequence
  Synthetic
ttgtggcagggtagttcgact

SEQ ID NO: 21501 - DNA, 21 bp, Artificial Sequence
  Synthetic
gaggctgggaattctcgttgg

SEQ ID NO: 21502 - DNA, 21 bp, Artificial Sequence
  Synthetic
gatacttcgacgaatcggtgg

SEQ ID NO: 21503 - DNA, 21 bp, Artificial Sequence
  Synthetic
atgtgggataatgtgcgtggt

SEQ ID NO: 21504 - DNA, 21 bp, Artificial Sequence
  Synthetic
tttggttcggatgggcgttgg

SEQ ID NO: 21505 - DNA, 21 bp, Artificial Sequence
  Synthetic
tttcattttgaggggagttct

SEQ ID NO: 21506 - DNA, 21 bp, Artificial Sequence
  Synthetic
gttggtccttttcatcagacg

SEQ ID NO: 21507 - DNA, 21 bp, Artificial Sequence
  Synthetic
cagcggtttgataatcgggtt

SEQ ID NO: 21508 - DNA, 21 bp, Artificial Sequence
  Synthetic
attcgtgagggttattctagt

SEQ ID NO: 21509 - DNA, 21 bp, Artificial Sequence
  Synthetic
atgatttatagtgggtcgcat

SEQ ID NO: 21510 - DNA, 21 bp, Artificial Sequence
  Synthetic
gggcatcctatgtcgtttggt

SEQ ID NO: 21511 - DNA, 21 bp, Artificial Sequence
  Synthetic
agtcgtgagggttggtctacg

SEQ ID NO: 21512 - DNA, 21 bp, Artificial Sequence
  Synthetic
tatggttcgttggctccgatt

SEQ ID NO: 21513 - DNA, 21 bp, Artificial Sequence
  Synthetic
gagcgtgcgggttggtctgcg

SEQ ID NO: 21514 - DNA, 21 bp, Artificial Sequence
  Synthetic
gataagccttattattctact

SEQ ID NO: 21515 - DNA, 21 bp, Artificial Sequence
  Synthetic
gcgcggcatatggggagtacg

SEQ ID NO: 21516 - DNA, 21 bp, Artificial Sequence
  Synthetic
gcgaggcatatggggtctacg

SEQ ID NO: 21517 - DNA, 21 bp, Artificial Sequence
  Synthetic
aatacttggggggttgttgct

SEQ ID NO: 21518 - DNA, 21 bp, Artificial Sequence
  Synthetic
atggatttgggttggagttcg

SEQ ID NO: 21519 - DNA, 21 bp, Artificial Sequence
  Synthetic
aagtttcttggtcaggctcag

SEQ ID NO: 21520 - DNA, 21 bp, Artificial Sequence
  Synthetic
tggcattcgttggcgacgagg

SEQ ID NO: 21521 - DNA, 21 bp, Artificial Sequence
  Synthetic
aatcataggtatgaggcgagt

SEQ ID NO: 21522 - DNA, 21 bp, Artificial Sequence
  Synthetic
ccgtggcctgggcatgctgct

SEQ ID NO: 21523 - DNA, 21 bp, Artificial Sequence
  Synthetic
ggttttgctattaggcaggtg

SEQ ID NO: 21524 - DNA, 21 bp, Artificial Sequence
  Synthetic
tatttggcggggtttggtact

SEQ ID NO: 21525 - DNA, 21 bp, Artificial Sequence
  Synthetic
catgtgtctctgggtagttct

SEQ ID NO: 21526 - DNA, 21 bp, Artificial Sequence
  Synthetic
tttgtgacttatggttcggcg

SEQ ID NO: 21527 - DNA, 21 bp, Artificial Sequence
  Synthetic
ctgaagtatgctgggagtacg

SEQ ID NO: 21528 - DNA, 21 bp, Artificial Sequence
  Synthetic
gttacgcagcagaatatgtgg

SEQ ID NO: 21529 - DNA, 21 bp, Artificial Sequence
  Synthetic
gctaggaatccgggtgtttgg

SEQ ID NO: 21530 - DNA, 21 bp, Artificial Sequence
  Synthetic
acgcgtgcggggtatgctgtt

SEQ ID NO: 21531 - DNA, 21 bp, Artificial Sequence
  Synthetic
gagagtcatgcgggtaggtgg

SEQ ID NO: 21532 - DNA, 21 bp, Artificial Sequence
  Synthetic
atgtatcaggggggttcgcag

SEQ ID NO: 21533 - DNA, 21 bp, Artificial Sequence
  Synthetic
ggtgattttaggatgattgtg

SEQ ID NO: 21534 - DNA, 21 bp, Artificial Sequence
  Synthetic
ggggttgatcgtgggccttgg

SEQ ID NO: 21535 - DNA, 21 bp, Artificial Sequence
  Synthetic
gtgatgaagggttatagtagt

SEQ ID NO: 21536 - DNA, 21 bp, Artificial Sequence
  Synthetic
ttgtatgtgggtggtgcgcag

SEQ ID NO: 21537 - DNA, 21 bp, Artificial Sequence
  Synthetic
gtggtttatgcgggtagttcg

SEQ ID NO: 21538 - DNA, 21 bp, Artificial Sequence
  Synthetic
catgtggcttcgcagtattat

SEQ ID NO: 21539 - DNA, 21 bp, Artificial Sequence
  Synthetic
gcgtggcttgggggggctact

SEQ ID NO: 21540 - DNA, 21 bp, Artificial Sequence
  Synthetic
tcgtggcagggttcgagttcg

SEQ ID NO: 21541 - DNA, 21 bp, Artificial Sequence
  Synthetic
cttttgtatggttctgcgcag

SEQ ID NO: 21542 - DNA, 21 bp, Artificial Sequence
  Synthetic
actcgtacggggtatagtgtt

SEQ ID NO: 21543 - DNA, 21 bp, Artificial Sequence
  Synthetic
ttgtttttgggttctagtatg

SEQ ID NO: 21544 - DNA, 21 bp, Artificial Sequence
  Synthetic
gtttggggtgggcttggggtg

SEQ ID NO: 21545 - DNA, 21 bp, Artificial Sequence
  Synthetic
gaggttagtcatggtagtgcg

SEQ ID NO: 21546 - DNA, 21 bp, Artificial Sequence
  Synthetic
atttctagggggtttgctcag

SEQ ID NO: 21547 - DNA, 21 bp, Artificial Sequence
  Synthetic
ctggttaggttgggtagtgcg

SEQ ID NO: 21548 - DNA, 21 bp, Artificial Sequence
  Synthetic
gttgcggcgggttggagtacg

SEQ ID NO: 21549 - DNA, 21 bp, Artificial Sequence
  Synthetic
ccttatgagaggagttatggg

SEQ ID NO: 21550 - DNA, 21 bp, Artificial Sequence
  Synthetic
actcttgggtatggttcgtct

SEQ ID NO: 21551 - DNA, 21 bp, Artificial Sequence
  Synthetic
tatggtagtcttgcgagtatt

SEQ ID NO: 21552 - DNA, 21 bp, Artificial Sequence
  Synthetic
gttgttgagaattggcatttg

SEQ ID NO: 21553 - DNA, 21 bp, Artificial Sequence
  Synthetic
gcgtatttgggttatagtgcg

SEQ ID NO: 21554 - DNA, 21 bp, Artificial Sequence
  Synthetic
gttcgtagtgggatgtctcag

SEQ ID NO: 21555 - DNA, 21 bp, Artificial Sequence
  Synthetic
acggggcatgggtatagttct

SEQ ID NO: 21556 - DNA, 21 bp, Artificial Sequence
  Synthetic
gttcgtgtgcagcttgttaat

SEQ ID NO: 21557 - DNA, 21 bp, Artificial Sequence
  Synthetic
gttgctgcgtttgggtcgtct

SEQ ID NO: 21558 - DNA, 21 bp, Artificial Sequence
  Synthetic
ggttatgatttgaggactccg

SEQ ID NO: 21559 - DNA, 21 bp, Artificial Sequence
  Synthetic
agtcggacggggtttagtact

SEQ ID NO: 21560 - DNA, 21 bp, Artificial Sequence
  Synthetic
cctattgattcggcgcgttgg

SEQ ID NO: 21561 - DNA, 21 bp, Artificial Sequence
  Synthetic
attctgtcgggttattcgatg

SEQ ID NO: 21562 - DNA, 21 bp, Artificial Sequence
  Synthetic
ctttggccgggtcagtcttct

SEQ ID NO: 21563 - DNA, 21 bp, Artificial Sequence
  Synthetic
tatggtagtctggaggtgctt

SEQ ID NO: 21564 - DNA, 21 bp, Artificial Sequence
  Synthetic
catatttctcatggtagtgcg

SEQ ID NO: 21565 - DNA, 21 bp, Artificial Sequence
  Synthetic
attttgagtgggtataattct

SEQ ID NO: 21566 - DNA, 21 bp, Artificial Sequence
  Synthetic
gctgggtttgatcttcgtggg

SEQ ID NO: 21567 - DNA, 21 bp, Artificial Sequence
  Synthetic
gggcatgttaattggtcgagt

SEQ ID NO: 21568 - DNA, 21 bp, Artificial Sequence
  Synthetic
acggagggtgtgtatcgttgg

SEQ ID NO: 21569 - DNA, 21 bp, Artificial Sequence
  Synthetic
cggaggcctgcggaggcgcag

SEQ ID NO: 21570 - DNA, 21 bp, Artificial Sequence
  Synthetic
cgtcatgcgactgagtattat

SEQ ID NO: 21571 - DNA, 21 bp, Artificial Sequence
  Synthetic
ctggatgttgggtggagttcg

SEQ ID NO: 21572 - DNA, 21 bp, Artificial Sequence
  Synthetic
ggtgtgccgggttggtcttct

SEQ ID NO: 21573 - DNA, 21 bp, Artificial Sequence
  Synthetic
agggttggtgatactcgttgg

SEQ ID NO: 21574 - DNA, 21 bp, Artificial Sequence
  Synthetic
ctggcgtatcttgggtctcag

SEQ ID NO: 21575 - DNA, 21 bp, Artificial Sequence
  Synthetic
gatactactactaatcggtgg

SEQ ID NO: 21576 - DNA, 21 bp, Artificial Sequence
  Synthetic
agtcagatttgggggtctgcg

SEQ ID NO: 21577 - DNA, 21 bp, Artificial Sequence
  Synthetic
tggggttcgttgaatagtctg

SEQ ID NO: 21578 - DNA, 21 bp, Artificial Sequence
  Synthetic
agggttttgttggatagggct

SEQ ID NO: 21579 - DNA, 21 bp, Artificial Sequence
  Synthetic
tcggcgcatcctgggatgtgg

SEQ ID NO: 21580 - DNA, 21 bp, Artificial Sequence
  Synthetic
ttgattccgctgatgtctagt

SEQ ID NO: 21581 - DNA, 21 bp, Artificial Sequence
  Synthetic
agtgcgccgggttggtcgcat

SEQ ID NO: 21582 - DNA, 21 bp, Artificial Sequence
  Synthetic
cctcagtatgagtcgaggtgg

SEQ ID NO: 21583 - DNA, 21 bp, Artificial Sequence
  Synthetic
ctgcgtccttttgattcgacg

SEQ ID NO: 21584 - DNA, 21 bp, Artificial Sequence
  Synthetic
gttttttttgagggtagttcg

SEQ ID NO: 21585 - DNA, 21 bp, Artificial Sequence
  Synthetic
ttgaatccggggtggtcgacg

SEQ ID NO: 21586 - DNA, 21 bp, Artificial Sequence
  Synthetic
atgtttgggggtggttctcag

SEQ ID NO: 21587 - DNA, 21 bp, Artificial Sequence
  Synthetic
cttcggtttgagggtagtcag

SEQ ID NO: 21588 - DNA, 21 bp, Artificial Sequence
  Synthetic
gagcgtaattgggggagtacg

SEQ ID NO: 21589 - DNA, 21 bp, Artificial Sequence
  Synthetic
gcttatcctggtgctgctgcg

SEQ ID NO: 21590 - DNA, 21 bp, Artificial Sequence
  Synthetic
tgggttattggttctcaggtt

SEQ ID NO: 21591 - DNA, 21 bp, Artificial Sequence
  Synthetic
tggcattctttggcgcggccg

SEQ ID NO: 21592 - DNA, 21 bp, Artificial Sequence
  Synthetic
tgggctaagatggggagtgtt

SEQ ID NO: 21593 - DNA, 21 bp, Artificial Sequence
  Synthetic
tgggctcttcatgggagtcag

SEQ ID NO: 21594 - DNA, 21 bp, Artificial Sequence
  Synthetic
cgggctgatcataatcattgg

SEQ ID NO: 21595 - DNA, 21 bp, Artificial Sequence
  Synthetic
tctgcgcggttgatgtctagt

SEQ ID NO: 21596 - DNA, 21 bp, Artificial Sequence
  Synthetic
gtgtggggtgggcttggtgtt

SEQ ID NO: 21597 - DNA, 21 bp, Artificial Sequence
  Synthetic
tggagtcctaatacgggttat

SEQ ID NO: 21598 - DNA, 21 bp, Artificial Sequence
  Synthetic
tggctgcggggttatgctgag

SEQ ID NO: 21599 - DNA, 21 bp, Artificial Sequence
  Synthetic
cttcttcgtgggctgagttct

SEQ ID NO: 21600 - DNA, 21 bp, Artificial Sequence
  Synthetic
ggggtggttgtgttgaggaat

SEQ ID NO: 21601 - DNA, 21 bp, Artificial Sequence
  Synthetic
aggtttactaatgatagttct

SEQ ID NO: 21602 - DNA, 21 bp, Artificial Sequence
  Synthetic
gatttttttaaggggtcggcg

SEQ ID NO: 21603 - DNA, 21 bp, Artificial Sequence
  Synthetic
actcctgcttggacggcgtcg

SEQ ID NO: 21604 - DNA, 21 bp, Artificial Sequence
  Synthetic
atggtgtatagtgggtcgtcg

SEQ ID NO: 21605 - DNA, 21 bp, Artificial Sequence
  Synthetic
attgcttcttggatgcctcag

SEQ ID NO: 21606 - DNA, 21 bp, Artificial Sequence
  Synthetic
tatactttgcaggcggggtat

SEQ ID NO: 21607 - DNA, 21 bp, Artificial Sequence
  Synthetic
acggtgccgaattggcatcag

SEQ ID NO: 21608 - DNA, 21 bp, Artificial Sequence
  Synthetic
ccgtatcagccggctcctggg

SEQ ID NO: 21609 - DNA, 21 bp, Artificial Sequence
  Synthetic
tataatagtttgtggccggct

SEQ ID NO: 21610 - DNA, 21 bp, Artificial Sequence
  Synthetic
gagaagccttttttttctgcg

SEQ ID NO: 21611 - DNA, 21 bp, Artificial Sequence
  Synthetic
gataggcatctgaatcagtgg

SEQ ID NO: 21612 - DNA, 21 bp, Artificial Sequence
  Synthetic
aggtatgtgcatgaggctagt

SEQ ID NO: 21613 - DNA, 21 bp, Artificial Sequence
  Synthetic
actgttactttgtcgaagtat

SEQ ID NO: 21614 - DNA, 21 bp, Artificial Sequence
  Synthetic
actgtgcattcgggtgtttgg

SEQ ID NO: 21615 - DNA, 21 bp, Artificial Sequence
  Synthetic
tgggtgtctcttccgactagt

SEQ ID NO: 21616 - DNA, 21 bp, Artificial Sequence
  Synthetic
ttgcagttgggttttgctcag

SEQ ID NO: 21617 - DNA, 21 bp, Artificial Sequence
  Synthetic
tggcggacgttgccggatgtt

SEQ ID NO: 21618 - DNA, 21 bp, Artificial Sequence
  Synthetic
gttactcatgggttttcttct

SEQ ID NO: 21619 - DNA, 21 bp, Artificial Sequence
  Synthetic
gctatgaggggtttttctact

SEQ ID NO: 21620 - DNA, 21 bp, Artificial Sequence
  Synthetic
acgtatgctcattatagtagt

SEQ ID NO: 21621 - DNA, 21 bp, Artificial Sequence
  Synthetic
ggggagacgaatggtcgttgg

SEQ ID NO: 21622 - DNA, 21 bp, Artificial Sequence
  Synthetic
gatattccgtttgggtctagt

SEQ ID NO: 21623 - DNA, 21 bp, Artificial Sequence
  Synthetic
ttgcggccggggtgggctacg

SEQ ID NO: 21624 - DNA, 21 bp, Artificial Sequence
  Synthetic
gagttttatcgtggtgctgtt

SEQ ID NO: 21625 - DNA, 21 bp, Artificial Sequence
  Synthetic
tctcggaatcttgggagtacg

SEQ ID NO: 21626 - DNA, 21 bp, Artificial Sequence
  Synthetic
gctgtgcatgaggttaggtgg

SEQ ID NO: 21627 - DNA, 21 bp, Artificial Sequence
  Synthetic
gttgcttggggtggttctact

SEQ ID NO: 21628 - DNA, 21 bp, Artificial Sequence
  Synthetic
gagtttcgggggggtagttcg

SEQ ID NO: 21629 - DNA, 21 bp, Artificial Sequence
  Synthetic
tggatggctcgtggggctgcg

SEQ ID NO: 21630 - DNA, 21 bp, Artificial Sequence
  Synthetic
tggggggcttatcctggggct

SEQ ID NO: 21631 - DNA, 21 bp, Artificial Sequence
  Synthetic
tatgagcggcttgggagtacg

SEQ ID NO: 21632 - DNA, 21 bp, Artificial Sequence
  Synthetic
agttgggctcatggggctgcg

SEQ ID NO: 21633 - DNA, 21 bp, Artificial Sequence
  Synthetic
aagtttattggtggggctgcg

SEQ ID NO: 21634 - DNA, 21 bp, Artificial Sequence
  Synthetic
gagcgtacgtatgggtcgagt

SEQ ID NO: 21635 - DNA, 21 bp, Artificial Sequence
  Synthetic
gttcttattggtcggtctggt

SEQ ID NO: 21636 - DNA, 21 bp, Artificial Sequence
  Synthetic
gttgcgattgggcagacttgg

SEQ ID NO: 21637 - DNA, 21 bp, Artificial Sequence
  Synthetic
gagtatattcgggggtcggcg

SEQ ID NO: 21638 - DNA, 21 bp, Artificial Sequence
  Synthetic
ggtgagtcggttgggaagtgg

SEQ ID NO: 21639 - DNA, 21 bp, Artificial Sequence
  Synthetic
attaggcctttttctgatttt

SEQ ID NO: 21640 - DNA, 21 bp, Artificial Sequence
  Synthetic
tggtcgcagactcatgggtat

SEQ ID NO: 21641 - DNA, 21 bp, Artificial Sequence
  Synthetic
ctgtttccggggtatgcttct

SEQ ID NO: 21642 - DNA, 21 bp, Artificial Sequence
  Synthetic
tcgtatgcgattaagtctatt

SEQ ID NO: 21643 - DNA, 21 bp, Artificial Sequence
  Synthetic
actcagtataatggttctatt

SEQ ID NO: 21644 - DNA, 21 bp, Artificial Sequence
  Synthetic
tcgcttattggttattcttcg

SEQ ID NO: 21645 - DNA, 21 bp, Artificial Sequence
  Synthetic
catctgtctggttataatacg

SEQ ID NO: 21646 - DNA, 21 bp, Artificial Sequence
  Synthetic
cttaatgtgaattgggctagt

SEQ ID NO: 21647 - DNA, 21 bp, Artificial Sequence
  Synthetic
tatagggcgctggggtcggct

SEQ ID NO: 21648 - DNA, 21 bp, Artificial Sequence
  Synthetic
aatgctcctgtgcagcattgg

SEQ ID NO: 21649 - DNA, 21 bp, Artificial Sequence
  Synthetic
tttggttctcttgatgcgatt

SEQ ID NO: 21650 - DNA, 21 bp, Artificial Sequence
  Synthetic
cgtgaggttcataatatttgg

SEQ ID NO: 21651 - DNA, 21 bp, Artificial Sequence
  Synthetic
atttttctgcatggttcgacg

SEQ ID NO: 21652 - DNA, 21 bp, Artificial Sequence
  Synthetic
attattaatgataataggtgg

SEQ ID NO: 21653 - DNA, 21 bp, Artificial Sequence
  Synthetic
ccgaagaatgatggtaggtgg

SEQ ID NO: 21654 - DNA, 21 bp, Artificial Sequence
  Synthetic
ttgagggtgtcttatgctcag

SEQ ID NO: 21655 - DNA, 21 bp, Artificial Sequence
  Synthetic
gatcctccgaattgggcttat

SEQ ID NO: 21656 - DNA, 21 bp, Artificial Sequence
  Synthetic
aatgggccgtttatgagtacg

SEQ ID NO: 21657 - DNA, 21 bp, Artificial Sequence
  Synthetic
cctaagaatacttatgggtat

SEQ ID NO: 21658 - DNA, 21 bp, Artificial Sequence
  Synthetic
ggtgcttcgtggacggcttcg

SEQ ID NO: 21659 - DNA, 21 bp, Artificial Sequence
  Synthetic
tcggcggctaattggagtcat

SEQ ID NO: 21660 - DNA, 21 bp, Artificial Sequence
  Synthetic
cctgatgcgtggaatagggtt

SEQ ID NO: 21661 - DNA, 21 bp, Artificial Sequence
  Synthetic
tttactctgagtgataggccg

SEQ ID NO: 21662 - DNA, 21 bp, Artificial Sequence
  Synthetic
gcggtgattaggttgactaat

SEQ ID NO: 21663 - DNA, 21 bp, Artificial Sequence
  Synthetic
gagaggacgacgtggtctgct

SEQ ID NO: 21664 - DNA, 21 bp, Artificial Sequence
  Synthetic
ccggctcctccttttagtctt

SEQ ID NO: 21665 - DNA, 21 bp, Artificial Sequence
  Synthetic
cggagtgttgggactatttat

SEQ ID NO: 21666 - DNA, 21 bp, Artificial Sequence
  Synthetic
gggaaggttgctaatgcgtgg

SEQ ID NO: 21667 - DNA, 21 bp, Artificial Sequence
  Synthetic
tttgcgcatttgtatagttcg

SEQ ID NO: 21668 - DNA, 21 bp, Artificial Sequence
  Synthetic
aggtggccgtcggaggcgagt

SEQ ID NO: 21669 - DNA, 21 bp, Artificial Sequence
  Synthetic
tggggggctcttcagggtttg

SEQ ID NO: 21670 - DNA, 21 bp, Artificial Sequence
  Synthetic
actgcgagttgggatagggtt

SEQ ID NO: 21671 - DNA, 21 bp, Artificial Sequence
  Synthetic
gagcggcttcatggtgctagt

SEQ ID NO: 21672 - DNA, 21 bp, Artificial Sequence
  Synthetic
ctttgtgtgccgtgtagttct

SEQ ID NO: 21673 - DNA, 21 bp, Artificial Sequence
  Synthetic
atggttcggcctatggcgtcg

SEQ ID NO: 21674 - DNA, 21 bp, Artificial Sequence
  Synthetic
agtacgtatctgggtagtacg

SEQ ID NO: 21675 - DNA, 21 bp, Artificial Sequence
  Synthetic
gagagggttattatgaagccg

SEQ ID NO: 21676 - DNA, 21 bp, Artificial Sequence
  Synthetic
ctgcgtcttgcgggtagtact

SEQ ID NO: 21677 - DNA, 21 bp, Artificial Sequence
  Synthetic
gatcggtttttgggttcttct

SEQ ID NO: 21678 - DNA, 21 bp, Artificial Sequence
  Synthetic
cctggtcctaattggtcggcg

SEQ ID NO: 21679 - DNA, 21 bp, Artificial Sequence
  Synthetic
ttggtgcatgagagtcggtgg

SEQ ID NO: 21680 - DNA, 21 bp, Artificial Sequence
  Synthetic
agtaaggtgcttaatggttgg

SEQ ID NO: 21681 - DNA, 21 bp, Artificial Sequence
  Synthetic
gctgggcctgggagggctcag

SEQ ID NO: 21682 - DNA, 21 bp, Artificial Sequence
  Synthetic
atgcagattcgtggttctact

SEQ ID NO: 21683 - DNA, 21 bp, Artificial Sequence
  Synthetic
cgtacgtctgggagtgtgtat

SEQ ID NO: 21684 - DNA, 21 bp, Artificial Sequence
  Synthetic
gcgtttcagtttcaggctagt

SEQ ID NO: 21685 - DNA, 21 bp, Artificial Sequence
  Synthetic
agtgatcctggttggtcgtcg

SEQ ID NO: 21686 - DNA, 21 bp, Artificial Sequence
  Synthetic
ggggtgcatactgggagttgg

SEQ ID NO: 21687 - DNA, 21 bp, Artificial Sequence
  Synthetic
cttgatgttgggagggtttat

SEQ ID NO: 21688 - DNA, 21 bp, Artificial Sequence
  Synthetic
atgcgtcctatggaggctcag

SEQ ID NO: 21689 - DNA, 21 bp, Artificial Sequence
  Synthetic
agggattttgggtatgcgcag

SEQ ID NO: 21690 - DNA, 21 bp, Artificial Sequence
  Synthetic
gagcgttatggtggttttcat

SEQ ID NO: 21691 - DNA, 21 bp, Artificial Sequence
  Synthetic
aattcgccgggttggtcgtct

SEQ ID NO: 21692 - DNA, 21 bp, Artificial Sequence
  Synthetic
tggcggcttgggggttctgtt

SEQ ID NO: 21693 - DNA, 21 bp, Artificial Sequence
  Synthetic
atgatgcggttgggggcttcg

SEQ ID NO: 21694 - DNA, 21 bp, Artificial Sequence
  Synthetic
ttgtgggagcggggggcttcg

SEQ ID NO: 21695 - DNA, 21 bp, Artificial Sequence
  Synthetic
gatcggactgggtggtctact

SEQ ID NO: 21696 - DNA, 21 bp, Artificial Sequence
  Synthetic
tggcaggcgcatgggagtcag

SEQ ID NO: 21697 - DNA, 21 bp, Artificial Sequence
  Synthetic
agtttgcttcaggggtatggg

SEQ ID NO: 21698 - DNA, 21 bp, Artificial Sequence
  Synthetic
ccgaatgcgccgggtccgtgg

SEQ ID NO: 21699 - DNA, 21 bp, Artificial Sequence
  Synthetic
tcggtgcgtttggggtcttct

SEQ ID NO: 21700 - DNA, 21 bp, Artificial Sequence
  Synthetic
cgtgagggtgaggctaggtgg

SEQ ID NO: 21701 - DNA, 21 bp, Artificial Sequence
  Synthetic
cagcgggcgggtttttctcag

SEQ ID NO: 21702 - DNA, 21 bp, Artificial Sequence
  Synthetic
gagtatgcgctgctggggagg

SEQ ID NO: 21703 - DNA, 21 bp, Artificial Sequence
  Synthetic
actcagcgtgggtatagttct

SEQ ID NO: 21704 - DNA, 21 bp, Artificial Sequence
  Synthetic
gatgttcgttcgacttggact

SEQ ID NO: 21705 - DNA, 21 bp, Artificial Sequence
  Synthetic
cttagtcggggtatggctcag

SEQ ID NO: 21706 - DNA, 21 bp, Artificial Sequence
  Synthetic
tatggtatgttgggtcctatg

SEQ ID NO: 21707 - DNA, 21 bp, Artificial Sequence
  Synthetic
attcggattggtacggtttat

SEQ ID NO: 21708 - DNA, 21 bp, Artificial Sequence
  Synthetic
catcttgtggggtttagttcg

SEQ ID NO: 21709 - DNA, 21 bp, Artificial Sequence
  Synthetic
cttggtaagggttattctacg

SEQ ID NO: 21710 - DNA, 21 bp, Artificial Sequence
  Synthetic
atgaggattggtgctagtcag

SEQ ID NO: 21711 - DNA, 21 bp, Artificial Sequence
  Synthetic
atgcataagtgggagtcgtcg

SEQ ID NO: 21712 - DNA, 21 bp, Artificial Sequence
  Synthetic
cttgcgaggggtatgagtagt

SEQ ID NO: 21713 - DNA, 21 bp, Artificial Sequence
  Synthetic
gtgagggtggttttgacgaat

SEQ ID NO: 21714 - DNA, 21 bp, Artificial Sequence
  Synthetic
attgttacgcatgggtgggcg

SEQ ID NO: 21715 - DNA, 21 bp, Artificial Sequence
  Synthetic
tttatgcctgggtattctgct

SEQ ID NO: 21716 - DNA, 21 bp, Artificial Sequence
  Synthetic
cgttttcctggtgatggtgcg

SEQ ID NO: 21717 - DNA, 21 bp, Artificial Sequence
  Synthetic
aaggagtatgggagtgcttgg

SEQ ID NO: 21718 - DNA, 21 bp, Artificial Sequence
  Synthetic
agtgctatttatgggtcgagg

SEQ ID NO: 21719 - DNA, 21 bp, Artificial Sequence
  Synthetic
aggtatgtgggttctagtgcg

SEQ ID NO: 21720 - DNA, 21 bp, Artificial Sequence
  Synthetic
gggggggagacgggtaggtgg

SEQ ID NO: 21721 - DNA, 21 bp, Artificial Sequence
  Synthetic
ggtgagagtttgggtccgtgg

SEQ ID NO: 21722 - DNA, 21 bp, Artificial Sequence
  Synthetic
ttgttgtatagggaggggttg

SEQ ID NO: 21723 - DNA, 21 bp, Artificial Sequence
  Synthetic
gttccgagtaattatcatacg

SEQ ID NO: 21724 - DNA, 21 bp, Artificial Sequence
  Synthetic
agtgtgattgggtattctcag

SEQ ID NO: 21725 - DNA, 21 bp, Artificial Sequence
  Synthetic
agttttccgtatagtagttct

SEQ ID NO: 21726 - DNA, 21 bp, Artificial Sequence
  Synthetic
atgattaggcatgggtctgcg

SEQ ID NO: 21727 - DNA, 21 bp, Artificial Sequence
  Synthetic
gagaggcatgcgtatagttct

SEQ ID NO: 21728 - DNA, 21 bp, Artificial Sequence
  Synthetic
cttctggcgggttataatgat

SEQ ID NO: 21729 - DNA, 21 bp, Artificial Sequence
  Synthetic
tatttgagtggttatgtgaat

SEQ ID NO: 21730 - DNA, 21 bp, Artificial Sequence
  Synthetic
ttgtttgagtttcattcttcg

SEQ ID NO: 21731 - DNA, 21 bp, Artificial Sequence
  Synthetic
cctagtgatctggggcgttgg

SEQ ID NO: 21732 - DNA, 21 bp, Artificial Sequence
  Synthetic
ctggctacgtctcgttgggat

SEQ ID NO: 21733 - DNA, 21 bp, Artificial Sequence
  Synthetic
tatggttcgctgaatttgctg

SEQ ID NO: 21734 - DNA, 21 bp, Artificial Sequence
  Synthetic
ggtttggggtggcgtgtggat

SEQ ID NO: 21735 - DNA, 21 bp, Artificial Sequence
  Synthetic
aagattggtcttacgcctatt

SEQ ID NO: 21736 - DNA, 21 bp, Artificial Sequence
  Synthetic
atgtggcatactggttcgtcg

SEQ ID NO: 21737 - DNA, 21 bp, Artificial Sequence
  Synthetic
ggtaatgatcctgggccgtgg

SEQ ID NO: 21738 - DNA, 21 bp, Artificial Sequence
  Synthetic
tggtctccttatgtttctggg

SEQ ID NO: 21739 - DNA, 21 bp, Artificial Sequence
  Synthetic
tggggtgcttatgggtctcag

SEQ ID NO: 21740 - DNA, 21 bp, Artificial Sequence
  Synthetic
actgctatgggtttttcgtcg

SEQ ID NO: 21741 - DNA, 21 bp, Artificial Sequence
  Synthetic
atgttttctttgggtaagccg

SEQ ID NO: 21742 - DNA, 21 bp, Artificial Sequence
  Synthetic
cctcatccgggggcgagttcg

SEQ ID NO: 21743 - DNA, 21 bp, Artificial Sequence
  Synthetic
caggggcttgggtttagttcg

SEQ ID NO: 21744 - DNA, 21 bp, Artificial Sequence
  Synthetic
cctcgttggggtgagtctact

SEQ ID NO: 21745 - DNA, 21 bp, Artificial Sequence
  Synthetic
ccgcagcattctgctatttgg

SEQ ID NO: 21746 - DNA, 21 bp, Artificial Sequence
  Synthetic
aggcatcatgcggatagtgct

SEQ ID NO: 21747 - DNA, 21 bp, Artificial Sequence
  Synthetic
ctgatgtatgggatggcgagt

SEQ ID NO: 21748 - DNA, 21 bp, Artificial Sequence
  Synthetic
ggggcggagttggggcggtgg

SEQ ID NO: 21749 - DNA, 21 bp, Artificial Sequence
  Synthetic
gagcagtatcggggttcgacg

SEQ ID NO: 21750 - DNA, 21 bp, Artificial Sequence
  Synthetic
tggtcggagagggggtctagt

SEQ ID NO: 21751 - DNA, 21 bp, Artificial Sequence
  Synthetic
cattttcatgggggtgcttct

SEQ ID NO: 21752 - DNA, 21 bp, Artificial Sequence
  Synthetic
ggtctgtatgagatttttaat

SEQ ID NO: 21753 - DNA, 21 bp, Artificial Sequence
  Synthetic
gcgaatcatgggtattctatg

SEQ ID NO: 21754 - DNA, 21 bp, Artificial Sequence
  Synthetic
ggttggagtagtggtcagttt

SEQ ID NO: 21755 - DNA, 21 bp, Artificial Sequence
  Synthetic
tggtttgggggtggttctcag

SEQ ID NO: 21756 - DNA, 21 bp, Artificial Sequence
  Synthetic
ctgcatattggggctgcgcag

SEQ ID NO: 21757 - DNA, 21 bp, Artificial Sequence
  Synthetic
gaggtgcctcatcagtatcat

SEQ ID NO: 21758 - DNA, 21 bp, Artificial Sequence
  Synthetic
ttgttttatggtggttcgagt

SEQ ID NO: 21759 - DNA, 21 bp, Artificial Sequence
  Synthetic
ggtgggattggttggtcgtcg

SEQ ID NO: 21760 - DNA, 21 bp, Artificial Sequence
  Synthetic
ctgtggattggtggttcgcag

SEQ ID NO: 21761 - DNA, 21 bp, Artificial Sequence
  Synthetic
caggtgggttggaggagtgat

SEQ ID NO: 21762 - DNA, 21 bp, Artificial Sequence
  Synthetic
tggagggagcttggttcgact

SEQ ID NO: 21763 - DNA, 21 bp, Artificial Sequence
  Synthetic
ttgatgcatatggggtcttcg

SEQ ID NO: 21764 - DNA, 21 bp, Artificial Sequence
  Synthetic
gatgtggctacgaatcggtgg

SEQ ID NO: 21765 - DNA, 21 bp, Artificial Sequence
  Synthetic
tggagtgtggaggggagtcgg

SEQ ID NO: 21766 - DNA, 21 bp, Artificial Sequence
  Synthetic
attgctcgtctggggagttcg

SEQ ID NO: 21767 - DNA, 21 bp, Artificial Sequence
  Synthetic
gatgcgccggggtgggctact

SEQ ID NO: 21768 - DNA, 21 bp, Artificial Sequence
  Synthetic
ggtaatatgccgtttgcttat

SEQ ID NO: 21769 - DNA, 21 bp, Artificial Sequence
  Synthetic
gggaaggcgggttatgggttt

SEQ ID NO: 21770 - DNA, 21 bp, Artificial Sequence
  Synthetic
tatggttcgcttagtatggtg

SEQ ID NO: 21771 - DNA, 21 bp, Artificial Sequence
  Synthetic
acttggcaggggggtgctacg

SEQ ID NO: 21772 - DNA, 21 bp, Artificial Sequence
  Synthetic
acgattgcttatggttcgact

SEQ ID NO: 21773 - DNA, 21 bp, Artificial Sequence
  Synthetic
ggtaatcctaattggtctacg

SEQ ID NO: 21774 - DNA, 21 bp, Artificial Sequence
  Synthetic
acggatcggacttggagtcat

SEQ ID NO: 21775 - DNA, 21 bp, Artificial Sequence
  Synthetic
ttgtggactactgggtctacg

SEQ ID NO: 21776 - DNA, 21 bp, Artificial Sequence
  Synthetic
gatgttgtgagtagtaggtgg

SEQ ID NO: 21777 - DNA, 21 bp, Artificial Sequence
  Synthetic
ctggatggtagtgggcggtgg

SEQ ID NO: 21778 - DNA, 21 bp, Artificial Sequence
  Synthetic
ctggcgattaggttggcttct

SEQ ID NO: 21779 - DNA, 21 bp, Artificial Sequence
  Synthetic
acttggttgggtagttcttcg

SEQ ID NO: 21780 - DNA, 21 bp, Artificial Sequence
  Synthetic
gcggagccgcgtagttgggtt

SEQ ID NO: 21781 - DNA, 21 bp, Artificial Sequence
  Synthetic
ggttggcatggtgcggcttct

SEQ ID NO: 21782 - DNA, 21 bp, Artificial Sequence
  Synthetic
gggccgaatccgggtaagtgg

SEQ ID NO: 21783 - DNA, 21 bp, Artificial Sequence
  Synthetic
cagcatccgggtttttctgtg

SEQ ID NO: 21784 - DNA, 21 bp, Artificial Sequence
  Synthetic
gggtggcagggtggttctgtt

SEQ ID NO: 21785 - DNA, 21 bp, Artificial Sequence
  Synthetic
tggcagatgggtgggtcgacg

SEQ ID NO: 21786 - DNA, 21 bp, Artificial Sequence
  Synthetic
tggaagacgggtggttcgacg

SEQ ID NO: 21787 - DNA, 21 bp, Artificial Sequence
  Synthetic
cttcgtgagtggagtattagt

SEQ ID NO: 21788 - DNA, 21 bp, Artificial Sequence
  Synthetic
gtgtttcgggggatgagttcg

SEQ ID NO: 21789 - DNA, 21 bp, Artificial Sequence
  Synthetic
tggcggccgggggggtcgtcg

SEQ ID NO: 21790 - DNA, 21 bp, Artificial Sequence
  Synthetic
gattggaggggtggggctacg

SEQ ID NO: 21791 - DNA, 21 bp, Artificial Sequence
  Synthetic
attgggcctccgggtaagtgg

SEQ ID NO: 21792 - DNA, 21 bp, Artificial Sequence
  Synthetic
gctgggcaggtgcgttgggat

SEQ ID NO: 21793 - DNA, 21 bp, Artificial Sequence
  Synthetic
catgtttcttatgggtcgcag

SEQ ID NO: 21794 - DNA, 21 bp, Artificial Sequence
  Synthetic
gagcgtccgtatggttcggcg

SEQ ID NO: 21795 - DNA, 21 bp, Artificial Sequence
  Synthetic
gcgcgttctacggattattgg

SEQ ID NO: 21796 - DNA, 21 bp, Artificial Sequence
  Synthetic
cggtttacggcggattctact

SEQ ID NO: 21797 - DNA, 21 bp, Artificial Sequence
  Synthetic
ggtagtgagcttggtcgttgg

SEQ ID NO: 21798 - DNA, 21 bp, Artificial Sequence
  Synthetic
aggcctgatgaggttcgttgg

SEQ ID NO: 21799 - DNA, 21 bp, Artificial Sequence
  Synthetic
cggtggcatggtgaggcggcg

SEQ ID NO: 21800 - DNA, 21 bp, Artificial Sequence
  Synthetic
aagtctgttgggagtgtgtat

SEQ ID NO: 21801 - DNA, 21 bp, Artificial Sequence
  Synthetic
ggttggatgggtggggcttct

SEQ ID NO: 21802 - DNA, 21 bp, Artificial Sequence
  Synthetic
gatagggtttttgggtcggcg

SEQ ID NO: 21803 - DNA, 21 bp, Artificial Sequence
  Synthetic
gatcttgcgagtgcgcgttgg

SEQ ID NO: 21804 - DNA, 21 bp, Artificial Sequence
  Synthetic
ttgggttctcttggtaggttt

SEQ ID NO: 21805 - DNA, 21 bp, Artificial Sequence
  Synthetic
tggtctcttccgaatggtggg

SEQ ID NO: 21806 - DNA, 21 bp, Artificial Sequence
  Synthetic
ccgtttgagccgaataggtgg

SEQ ID NO: 21807 - DNA, 21 bp, Artificial Sequence
  Synthetic
cctcggattgcgtatgcgtcg

SEQ ID NO: 21808 - DNA, 21 bp, Artificial Sequence
  Synthetic
gagcggtgggctggtgcggcg

SEQ ID NO: 21809 - DNA, 21 bp, Artificial Sequence
  Synthetic
atgtggtcggggtcttcgact

SEQ ID NO: 21810 - DNA, 21 bp, Artificial Sequence
  Synthetic
aggttttcgattgggcctcct

SEQ ID NO: 21811 - DNA, 21 bp, Artificial Sequence
  Synthetic
cctagggcggctttttcggct

SEQ ID NO: 21812 - DNA, 21 bp, Artificial Sequence
  Synthetic
aggagtgttgggacgctgtat

SEQ ID NO: 21813 - DNA, 21 bp, Artificial Sequence
  Synthetic
tggtcggagtggtcgaagggt

SEQ ID NO: 21814 - DNA, 21 bp, Artificial Sequence
  Synthetic
gagaggatggggtattctgtg

SEQ ID NO: 21815 - DNA, 21 bp, Artificial Sequence
  Synthetic
aggtggcatggtgatgggagt

SEQ ID NO: 21816 - DNA, 21 bp, Artificial Sequence
  Synthetic
gaggcgccggggtattcttcg

SEQ ID NO: 21817 - DNA, 21 bp, Artificial Sequence
  Synthetic
gttcatgtggggtttagttct

SEQ ID NO: 21818 - DNA, 21 bp, Artificial Sequence
  Synthetic
gaggcgttgggttgggcgagt

SEQ ID NO: 21819 - DNA, 21 bp, Artificial Sequence
  Synthetic
ttgtggccggggagtgcgacg

SEQ ID NO: 21820 - DNA, 21 bp, Artificial Sequence
  Synthetic
agttatattcctgcgggtcat

SEQ ID NO: 21821 - DNA, 21 bp, Artificial Sequence
  Synthetic
tctgagggggatgcgacgatt

SEQ ID NO: 21822 - DNA, 21 bp, Artificial Sequence
  Synthetic
gggacgctgcggttgacgaat

SEQ ID NO: 21823 - DNA, 21 bp, Artificial Sequence
  Synthetic
attgttagtaattatcatatt

SEQ ID NO: 21824 - DNA, 21 bp, Artificial Sequence
  Synthetic
gagaagagttggtcggctgcg

SEQ ID NO: 21825 - DNA, 21 bp, Artificial Sequence
  Synthetic
ttgtggccgagtgggtctgtt

SEQ ID NO: 21826 - DNA, 21 bp, Artificial Sequence
  Synthetic
ccttattcgaattatgctgcg

SEQ ID NO: 21827 - DNA, 21 bp, Artificial Sequence
  Synthetic
gagctttttcgtggttttgct

SEQ ID NO: 21828 - DNA, 21 bp, Artificial Sequence
  Synthetic
cataaggtgcttgggagtagt

SEQ ID NO: 21829 - DNA, 21 bp, Artificial Sequence
  Synthetic
ctgtatgttcctgcgtctagt

SEQ ID NO: 21830 - DNA, 21 bp, Artificial Sequence
  Synthetic
tggcgtttgggtcctgagccg

SEQ ID NO: 21831 - DNA, 21 bp, Artificial Sequence
  Synthetic
gattgggctaggggggcgtcg

SEQ ID NO: 21832 - DNA, 21 bp, Artificial Sequence
  Synthetic
catcttttgcttgggtctagt

SEQ ID NO: 21833 - DNA, 21 bp, Artificial Sequence
  Synthetic
ctggattgggggggtagtact

SEQ ID NO: 21834 - DNA, 21 bp, Artificial Sequence
  Synthetic
atggattatcgtttgcctacg

SEQ ID NO: 21835 - DNA, 21 bp, Artificial Sequence
  Synthetic
tcggggccgtttctgtctagt

SEQ ID NO: 21836 - DNA, 21 bp, Artificial Sequence
  Synthetic
ctgcattttggtcatgctcag

SEQ ID NO: 21837 - DNA, 21 bp, Artificial Sequence
  Synthetic
gagtggagtagggggagtagt

SEQ ID NO: 21838 - DNA, 21 bp, Artificial Sequence
  Synthetic
atgtggcataatggggcggcg

SEQ ID NO: 21839 - DNA, 21 bp, Artificial Sequence
  Synthetic
gagaagtggggtggttcgtct

SEQ ID NO: 21840 - DNA, 21 bp, Artificial Sequence
  Synthetic
tctgctctttatgggtcgact

SEQ ID NO: 21841 - DNA, 21 bp, Artificial Sequence
  Synthetic
atgtatcctggtagtagttcg

SEQ ID NO: 21842 - DNA, 21 bp, Artificial Sequence
  Synthetic
aagggtttggcggatcattgg

SEQ ID NO: 21843 - DNA, 21 bp, Artificial Sequence
  Synthetic
gctagtgctgctcggtgggat

SEQ ID NO: 21844 - DNA, 21 bp, Artificial Sequence
  Synthetic
aagcattgggagggttctact

SEQ ID NO: 21845 - DNA, 21 bp, Artificial Sequence
  Synthetic
cgtggtgttcttctgcagctg

SEQ ID NO: 21846 - DNA, 21 bp, Artificial Sequence
  Synthetic
ctttggcctggtatggcttct

SEQ ID NO: 21847 - DNA, 21 bp, Artificial Sequence
  Synthetic
acgcatgctaattgggctagt

SEQ ID NO: 21848 - DNA, 21 bp, Artificial Sequence
  Synthetic
aatcctggtttgttgccttat

SEQ ID NO: 21849 - DNA, 21 bp, Artificial Sequence
  Synthetic
tatcgggcgcttcctggtgtt

SEQ ID NO: 21850 - DNA, 21 bp, Artificial Sequence
  Synthetic
gatgttaggtctacttggacg

SEQ ID NO: 21851 - DNA, 21 bp, Artificial Sequence
  Synthetic
cctgcggctggtatgaattgg

SEQ ID NO: 21852 - DNA, 21 bp, Artificial Sequence
  Synthetic
ggggcttcgcctgggccttgg

SEQ ID NO: 21853 - DNA, 21 bp, Artificial Sequence
  Synthetic
tttaaggttttgggttctagt

SEQ ID NO: 21854 - DNA, 21 bp, Artificial Sequence
  Synthetic
tggattattggtgggtctgcg

SEQ ID NO: 21855 - DNA, 21 bp, Artificial Sequence
  Synthetic
ctgtgggttgcgggtgctagt

SEQ ID NO: 21856 - DNA, 21 bp, Artificial Sequence
  Synthetic
gtgatgtatgggggttcttcg

SEQ ID NO: 21857 - DNA, 21 bp, Artificial Sequence
  Synthetic
ttggcttggagtgggagtacg

SEQ ID NO: 21858 - DNA, 21 bp, Artificial Sequence
  Synthetic
atgaagccttgggagtcttct

SEQ ID NO: 21859 - DNA, 21 bp, Artificial Sequence
  Synthetic
cagactaatcatggttattgg

SEQ ID NO: 21860 - DNA, 21 bp, Artificial Sequence
  Synthetic
agtgcgaagtgggaggcgtcg

SEQ ID NO: 21861 - DNA, 21 bp, Artificial Sequence
  Synthetic
gcgtatgttggttatgctgtg

SEQ ID NO: 21862 - DNA, 21 bp, Artificial Sequence
  Synthetic
gagcattttcggggtgctacg

SEQ ID NO: 21863 - DNA, 21 bp, Artificial Sequence
  Synthetic
gtgcgggcggggtattcggcg

SEQ ID NO: 21864 - DNA, 21 bp, Artificial Sequence
  Synthetic
ttgcgttctttgatgtctagt

SEQ ID NO: 21865 - DNA, 21 bp, Artificial Sequence
  Synthetic
tgggggagtctgagtgattat

SEQ ID NO: 21866 - DNA, 21 bp, Artificial Sequence
  Synthetic
gctcagagtccggggcgttgg

SEQ ID NO: 21867 - DNA, 21 bp, Artificial Sequence
  Synthetic
ctggattatgcgagtaggttt

SEQ ID NO: 21868 - DNA, 21 bp, Artificial Sequence
  Synthetic
aagtttctgggtgggtcttcg

SEQ ID NO: 21869 - DNA, 21 bp, Artificial Sequence
  Synthetic
tggattgatcgtggtagtatg

SEQ ID NO: 21870 - DNA, 21 bp, Artificial Sequence
  Synthetic
gctaagtatgctcttccgatt

SEQ ID NO: 21871 - DNA, 21 bp, Artificial Sequence
  Synthetic
aatgaggtgtcggggcggtgg

SEQ ID NO: 21872 - DNA, 21 bp, Artificial Sequence
  Synthetic
ccggggcagccgggggtttgg

SEQ ID NO: 21873 - DNA, 21 bp, Artificial Sequence
  Synthetic
tcttggcaggggtcggcgtcg

SEQ ID NO: 21874 - DNA, 21 bp, Artificial Sequence
  Synthetic
ggttatattggtggttctacg

SEQ ID NO: 21875 - DNA, 21 bp, Artificial Sequence
  Synthetic
ccgattgctcattatagtgcg

SEQ ID NO: 21876 - DNA, 21 bp, Artificial Sequence
  Synthetic
attatgtatcatttggagaag

SEQ ID NO: 21877 - DNA, 21 bp, Artificial Sequence
  Synthetic
gcgaaggagtatactggttgg

SEQ ID NO: 21878 - DNA, 21 bp, Artificial Sequence
  Synthetic
gagcgtcatagtggtgcgtgg

SEQ ID NO: 21879 - DNA, 21 bp, Artificial Sequence
  Synthetic
agtgtttggcagggttctgtt

SEQ ID NO: 21880 - DNA, 21 bp, Artificial Sequence
  Synthetic
cagcctgaggagtttcgttgg

SEQ ID NO: 21881 - DNA, 21 bp, Artificial Sequence
  Synthetic
tttgctgttgagggtagtcgg

SEQ ID NO: 21882 - DNA, 21 bp, Artificial Sequence
  Synthetic
agtcatttgcatggttcttct

SEQ ID NO: 21883 - DNA, 21 bp, Artificial Sequence
  Synthetic
ttggagagggggtatagtcag

SEQ ID NO: 21884 - DNA, 21 bp, Artificial Sequence
  Synthetic
ctgaatccggggtattctcag

SEQ ID NO: 21885 - DNA, 21 bp, Artificial Sequence
  Synthetic
actggtcatggttatagtacg

SEQ ID NO: 21886 - DNA, 21 bp, Artificial Sequence
  Synthetic
gagcggtgggttgggagtgtt

SEQ ID NO: 21887 - DNA, 21 bp, Artificial Sequence
  Synthetic
atgtcgactcatgggagtagt

SEQ ID NO: 21888 - DNA, 21 bp, Artificial Sequence
  Synthetic
ccggtttggaaggattatgct

SEQ ID NO: 21889 - DNA, 21 bp, Artificial Sequence
  Synthetic
caggcgtggaatgggtctact

SEQ ID NO: 21890 - DNA, 21 bp, Artificial Sequence
  Synthetic
ctgactaagggttattctacg

SEQ ID NO: 21891 - DNA, 21 bp, Artificial Sequence
  Synthetic
ggtgaggggtctcggtggaat

SEQ ID NO: 21892 - DNA, 21 bp, Artificial Sequence
  Synthetic
tatgcgaattttgcgtatggt

SEQ ID NO: 21893 - DNA, 21 bp, Artificial Sequence
  Synthetic
ccttttattggttctgctgct

SEQ ID NO: 21894 - DNA, 21 bp, Artificial Sequence
  Synthetic
gatatttcgcatcggtatatg

SEQ ID NO: 21895 - DNA, 21 bp, Artificial Sequence
  Synthetic
gttctgcaggggtatagggat

SEQ ID NO: 21896 - DNA, 21 bp, Artificial Sequence
  Synthetic
gattttagtcggggggctagt

SEQ ID NO: 21897 - DNA, 21 bp, Artificial Sequence
  Synthetic
tggactgttgcgggtgggcat

SEQ ID NO: 21898 - DNA, 21 bp, Artificial Sequence
  Synthetic
aggggtgttgggctgtcgcag

SEQ ID NO: 21899 - DNA, 21 bp, Artificial Sequence
  Synthetic
ctgcttaagtatggtagttct

SEQ ID NO: 21900 - DNA, 21 bp, Artificial Sequence
  Synthetic
aagtatgttgggggtgctgct

SEQ ID NO: 21901 - DNA, 21 bp, Artificial Sequence
  Synthetic
cttggtgatattggtaggtgg

SEQ ID NO: 21902 - DNA, 21 bp, Artificial Sequence
  Synthetic
atggtggtgggttcgatttat

SEQ ID NO: 21903 - DNA, 21 bp, Artificial Sequence
  Synthetic
tggaggttggcgggttctgct

SEQ ID NO: 21904 - DNA, 21 bp, Artificial Sequence
  Synthetic
aaggtgacggatggttttcgt

SEQ ID NO: 21905 - DNA, 21 bp, Artificial Sequence
  Synthetic
acggctagttggacggctagt

SEQ ID NO: 21906 - DNA, 21 bp, Artificial Sequence
  Synthetic
aggttggatgaggtgcggtgg

SEQ ID NO: 21907 - DNA, 21 bp, Artificial Sequence
  Synthetic
cagtatattgggggggcgagt

SEQ ID NO: 21908 - DNA, 21 bp, Artificial Sequence
  Synthetic
agttggccgggtggtgctgct

SEQ ID NO: 21909 - DNA, 21 bp, Artificial Sequence
  Synthetic
ttgtttgcggctgggagtacg

SEQ ID NO: 21910 - DNA, 21 bp, Artificial Sequence
  Synthetic
gaggtgtttaagctgccgcat

SEQ ID NO: 21911 - DNA, 21 bp, Artificial Sequence
  Synthetic
gggattttgcgtttggttaat

SEQ ID NO: 21912 - DNA, 21 bp, Artificial Sequence
  Synthetic
cttgagtttcttgggagtact

SEQ ID NO: 21913 - DNA, 21 bp, Artificial Sequence
  Synthetic
gtgtggggtgggccggatagg

SEQ ID NO: 21914 - DNA, 21 bp, Artificial Sequence
  Synthetic
gtggcgctgtatgggtcgact

SEQ ID NO: 21915 - DNA, 21 bp, Artificial Sequence
  Synthetic
atgtattataatggtagtcat

SEQ ID NO: 21916 - DNA, 21 bp, Artificial Sequence
  Synthetic
cttctgtcttatgggagtagt

SEQ ID NO: 21917 - DNA, 21 bp, Artificial Sequence
  Synthetic
acttatgtgccggctggtagt

SEQ ID NO: 21918 - DNA, 21 bp, Artificial Sequence
  Synthetic
ggtgttcctaattggagttcg

SEQ ID NO: 21919 - DNA, 21 bp, Artificial Sequence
  Synthetic
ggggagaattcgaatcgttgg

SEQ ID NO: 21920 - DNA, 21 bp, Artificial Sequence
  Synthetic
gatcggtgggggttgtcgcag

SEQ ID NO: 21921 - DNA, 21 bp, Artificial Sequence
  Synthetic
gagctggttggtgtggggtgg

SEQ ID NO: 21922 - DNA, 21 bp, Artificial Sequence
  Synthetic
aaggtgggtgattatgcgtgg

SEQ ID NO: 21923 - DNA, 21 bp, Artificial Sequence
  Synthetic
cgggcgatgggttcgatttat

SEQ ID NO: 21924 - DNA, 21 bp, Artificial Sequence
  Synthetic
tttggggttcttcatgctcat

SEQ ID NO: 21925 - DNA, 21 bp, Artificial Sequence
  Synthetic
tgggtgtatggttcgagtgag

SEQ ID NO: 21926 - DNA, 21 bp, Artificial Sequence
  Synthetic
tcttttaagggggggtctact

SEQ ID NO: 21927 - DNA, 21 bp, Artificial Sequence
  Synthetic
cgttgggataatgatatggtg

SEQ ID NO: 21928 - DNA, 21 bp, Artificial Sequence
  Synthetic
gggcatagtccgggtatttgg

SEQ ID NO: 21929 - DNA, 21 bp, Artificial Sequence
  Synthetic
gggactcgttatgatctgagt

SEQ ID NO: 21930 - DNA, 21 bp, Artificial Sequence
  Synthetic
gtgccgtttaggccggatgtg

SEQ ID NO: 21931 - DNA, 21 bp, Artificial Sequence
  Synthetic
tggcgtgctaatgggtctgtt

SEQ ID NO: 21932 - DNA, 21 bp, Artificial Sequence
  Synthetic
tcgaggctgggtagtcttatg

SEQ ID NO: 21933 - DNA, 21 bp, Artificial Sequence
  Synthetic
cgtgctccggggctttcttct

SEQ ID NO: 21934 - DNA, 21 bp, Artificial Sequence
  Synthetic
gctccgtatgtggttcagacg

SEQ ID NO: 21935 - DNA, 21 bp, Artificial Sequence
  Synthetic
tggcatactcagacggggtat

SEQ ID NO: 21936 - DNA, 21 bp, Artificial Sequence
  Synthetic
acttttcatggtagttcgact

SEQ ID NO: 21937 - DNA, 21 bp, Artificial Sequence
  Synthetic
gtgcgggcggggagtgtgtat

SEQ ID NO: 21938 - DNA, 21 bp, Artificial Sequence
  Synthetic
tggaagctggagtcggggttt

SEQ ID NO: 21939 - DNA, 21 bp, Artificial Sequence
  Synthetic
gttgctaagtatgggagtacg

SEQ ID NO: 21940 - DNA, 21 bp, Artificial Sequence
  Synthetic
gcgagggagcattggagttct

SEQ ID NO: 21941 - DNA, 21 bp, Artificial Sequence
  Synthetic
atggctagtcagtggtctcat

SEQ ID NO: 21942 - DNA, 21 bp, Artificial Sequence
  Synthetic
ctgaaggagtatgggtcgagt

SEQ ID NO: 21943 - DNA, 21 bp, Artificial Sequence
  Synthetic
tttgtttttgggtctgagtat

SEQ ID NO: 21944 - DNA, 21 bp, Artificial Sequence
  Synthetic
tcggcttcgtgggggagttcg

SEQ ID NO: 21945 - DNA, 21 bp, Artificial Sequence
  Synthetic
tatgctacttgggttcataat

SEQ ID NO: 21946 - DNA, 21 bp, Artificial Sequence
  Synthetic
ctgaatctggggtattcgcag

SEQ ID NO: 21947 - DNA, 21 bp, Artificial Sequence
  Synthetic
agtgaggtggggtcggtttat

SEQ ID NO: 21948 - DNA, 21 bp, Artificial Sequence
  Synthetic
gggtttcctgagaatcgttgg

SEQ ID NO: 21949 - DNA, 21 bp, Artificial Sequence
  Synthetic
tggggttcgcttaataatttt

SEQ ID NO: 21950 - DNA, 21 bp, Artificial Sequence
  Synthetic
ttgtattatccgagttctgcg

SEQ ID NO: 21951 - DNA, 21 bp, Artificial Sequence
  Synthetic
gaggtttgggcggggtctagg

SEQ ID NO: 21952 - DNA, 21 bp, Artificial Sequence
  Synthetic
cctatggtgcgttcttttggg

SEQ ID NO: 21953 - DNA, 21 bp, Artificial Sequence
  Synthetic
gagcgttggtctggtagtatg

SEQ ID NO: 21954 - DNA, 21 bp, Artificial Sequence
  Synthetic
actgaggttacgggtcggtgg

SEQ ID NO: 21955 - DNA, 21 bp, Artificial Sequence
  Synthetic
gagtgggagcattatagtgct

SEQ ID NO: 21956 - DNA, 21 bp, Artificial Sequence
  Synthetic
ttgtttgttggtagtagtacg

SEQ ID NO: 21957 - DNA, 21 bp, Artificial Sequence
  Synthetic
cgttatcattcggattctgct

SEQ ID NO: 21958 - DNA, 21 bp, Artificial Sequence
  Synthetic
ccgttttatagtggttctgcg

SEQ ID NO: 21959 - DNA, 21 bp, Artificial Sequence
  Synthetic
tttgtttttcctcatggggag

SEQ ID NO: 21960 - DNA, 21 bp, Artificial Sequence
  Synthetic
tttttggcggggtatagtact

SEQ ID NO: 21961 - DNA, 21 bp, Artificial Sequence
  Synthetic
cagcagtttcggcttgatctg

SEQ ID NO: 21962 - DNA, 21 bp, Artificial Sequence
  Synthetic
tggggttcgttgaatcagttt

SEQ ID NO: 21963 - DNA, 21 bp, Artificial Sequence
  Synthetic
ttgtgggggcagggggcgcag

SEQ ID NO: 21964 - DNA, 21 bp, Artificial Sequence
  Synthetic
gtgaagagtagtacgtggaat

SEQ ID NO: 21965 - DNA, 21 bp, Artificial Sequence
  Synthetic
gctaattttggtcaggctcag

SEQ ID NO: 21966 - DNA, 21 bp, Artificial Sequence
  Synthetic
gtgtcttatgaggcgcgttat

SEQ ID NO: 21967 - DNA, 21 bp, Artificial Sequence
  Synthetic
gttaggattgggggggcgcag

SEQ ID NO: 21968 - DNA, 21 bp, Artificial Sequence
  Synthetic
ctgtgggagcgtgggagtatg

SEQ ID NO: 21969 - DNA, 21 bp, Artificial Sequence
  Synthetic
gataggcattctgcgatttgg

SEQ ID NO: 21970 - DNA, 21 bp, Artificial Sequence
  Synthetic
cctgcttatcatcttggggct

SEQ ID NO: 21971 - DNA, 21 bp, Artificial Sequence
  Synthetic
atgaaggggtatgggtcgagt

SEQ ID NO: 21972 - DNA, 21 bp, Artificial Sequence
  Synthetic
attggttctttgtatggtttg

SEQ ID NO: 21973 - DNA, 21 bp, Artificial Sequence
  Synthetic
atggattatcgtctgccggtt

SEQ ID NO: 21974 - DNA, 21 bp, Artificial Sequence
  Synthetic
ttgcatcctccgtggagtagt

SEQ ID NO: 21975 - DNA, 21 bp, Artificial Sequence
  Synthetic
catacgttgcttggtgctgct

SEQ ID NO: 21976 - DNA, 21 bp, Artificial Sequence
  Synthetic
cctcatgatcctggtatttgg

SEQ ID NO: 21977 - DNA, 21 bp, Artificial Sequence
  Synthetic
gagtctcctggtttgtggtcg

SEQ ID NO: 21978 - DNA, 21 bp, Artificial Sequence
  Synthetic
gttatgtttcatgggtcgagt

SEQ ID NO: 21979 - DNA, 21 bp, Artificial Sequence
  Synthetic
gtttggcatgggggtgcggcg

SEQ ID NO: 21980 - DNA, 21 bp, Artificial Sequence
  Synthetic
tcgtatcctaatttttctgtt

SEQ ID NO: 21981 - DNA, 21 bp, Artificial Sequence
  Synthetic
actcatactggttttagtacg

SEQ ID NO: 21982 - DNA, 21 bp, Artificial Sequence
  Synthetic
gggtttggtgaggctaggtgg

SEQ ID NO: 21983 - DNA, 21 bp, Artificial Sequence
  Synthetic
tggtctccggggggttctcag

SEQ ID NO: 21984 - DNA, 21 bp, Artificial Sequence
  Synthetic
gggacttggagtaagtttccg

SEQ ID NO: 21985 - DNA, 21 bp, Artificial Sequence
  Synthetic
ttgtgggctggtacttctatg

SEQ ID NO: 21986 - DNA, 21 bp, Artificial Sequence
  Synthetic
cgttttcctggtgatgggtct

SEQ ID NO: 21987 - DNA, 21 bp, Artificial Sequence
  Synthetic
aaggagtatagtcttgagcgt

SEQ ID NO: 21988 - DNA, 21 bp, Artificial Sequence
  Synthetic
ttttctaagggttattcgacg

SEQ ID NO: 21989 - DNA, 21 bp, Artificial Sequence
  Synthetic
tataagtcggggtggtctagt

SEQ ID NO: 21990 - DNA, 21 bp, Artificial Sequence
  Synthetic
tgggcggcgcatgggagtcag

SEQ ID NO: 21991 - DNA, 21 bp, Artificial Sequence
  Synthetic
tggtctgtggggggttcgacg

SEQ ID NO: 21992 - DNA, 21 bp, Artificial Sequence
  Synthetic
cgttatccgggtgagtctatg

SEQ ID NO: 21993 - DNA, 21 bp, Artificial Sequence
  Synthetic
cggtatatgggtgagttgttg

SEQ ID NO: 21994 - DNA, 21 bp, Artificial Sequence
  Synthetic
agttttcctggttatgcgact

SEQ ID NO: 21995 - DNA, 21 bp, Artificial Sequence
  Synthetic
gatcctagtcggtcttggact

SEQ ID NO: 21996 - DNA, 21 bp, Artificial Sequence
  Synthetic
gcgtcgcgggggtcgatttat

SEQ ID NO: 21997 - DNA, 21 bp, Artificial Sequence
  Synthetic
aggggttctggtttgagtcag

SEQ ID NO: 21998 - DNA, 21 bp, Artificial Sequence
  Synthetic
gagcggtatgcggggtcttcg

SEQ ID NO: 21999 - DNA, 21 bp, Artificial Sequence
  Synthetic
ggtaagattgtgggtccttgg

SEQ ID NO: 22000 - DNA, 21 bp, Artificial Sequence
  Synthetic
gcggcttgggctgggtctcag

SEQ ID NO: 22001 - DNA, 21 bp, Artificial Sequence
  Synthetic
ggtggtgagacgggtaggtgg

SEQ ID NO: 22002 - DNA, 21 bp, Artificial Sequence
  Synthetic
ctttatattggtgcgtcttct

SEQ ID NO: 22003 - DNA, 21 bp, Artificial Sequence
  Synthetic
tggcattcgttggcgggtagt

SEQ ID NO: 22004 - DNA, 21 bp, Artificial Sequence
  Synthetic
gtgcatttggggtttagttct

SEQ ID NO: 22005 - DNA, 21 bp, Artificial Sequence
  Synthetic
tatgagaattatcgttatccg

SEQ ID NO: 22006 - DNA, 21 bp, Artificial Sequence
  Synthetic
tcgcattggcaggggtctgcg

SEQ ID NO: 22007 - DNA, 21 bp, Artificial Sequence
  Synthetic
cttctgggtggttatagtcag

SEQ ID NO: 22008 - DNA, 21 bp, Artificial Sequence
  Synthetic
tctatgtctaggtatgatatt

SEQ ID NO: 22009 - DNA, 21 bp, Artificial Sequence
  Synthetic
tcgtggcatagtgggagttcg

SEQ ID NO: 22010 - DNA, 21 bp, Artificial Sequence
  Synthetic
atttatcctggtacgtctacg

SEQ ID NO: 22011 - DNA, 21 bp, Artificial Sequence
  Synthetic
ccgcctaatgattctcgttgg

SEQ ID NO: 22012 - DNA, 21 bp, Artificial Sequence
  Synthetic
cggtatgttaatgatgctagt

SEQ ID NO: 22013 - DNA, 21 bp, Artificial Sequence
  Synthetic
acgattgtgtatggtagtagt

SEQ ID NO: 22014 - DNA, 21 bp, Artificial Sequence
  Synthetic
tggcggttggcgggttcggcg

SEQ ID NO: 22015 - DNA, 21 bp, Artificial Sequence
  Synthetic
tgggtttctttgcctcttaat

SEQ ID NO: 22016 - DNA, 21 bp, Artificial Sequence
  Synthetic
tgggggagtccggcgcatacg

SEQ ID NO: 22017 - DNA, 21 bp, Artificial Sequence
  Synthetic
tggagggatcaggggagtacg

SEQ ID NO: 22018 - DNA, 21 bp, Artificial Sequence
  Synthetic
tggggtgatgtgcgttggaat

SEQ ID NO: 22019 - DNA, 21 bp, Artificial Sequence
  Synthetic
cctagtgagcatagtcggtgg

SEQ ID NO: 22020 - DNA, 21 bp, Artificial Sequence
  Synthetic
attcctcatagtggggtttgg

SEQ ID NO: 22021 - DNA, 21 bp, Artificial Sequence
  Synthetic
ggggaggtgacggggcggtgg

SEQ ID NO: 22022 - DNA, 21 bp, Artificial Sequence
  Synthetic
actcagcggatgggtgcggcg

SEQ ID NO: 22023 - DNA, 21 bp, Artificial Sequence
  Synthetic
catgagtatcggggttctgcg

SEQ ID NO: 22024 - DNA, 21 bp, Artificial Sequence
  Synthetic
ccgccggctcatgggtcttgg

SEQ ID NO: 22025 - DNA, 21 bp, Artificial Sequence
  Synthetic
aagtttattgttggtactatt

SEQ ID NO: 22026 - DNA, 21 bp, Artificial Sequence
  Synthetic
aggtatacgctgggtgcggct

SEQ ID NO: 22027 - DNA, 21 bp, Artificial Sequence
  Synthetic
ccggtgtgggggtcgactagt

SEQ ID NO: 22028 - DNA, 21 bp, Artificial Sequence
  Synthetic
tgggatcttgttgagggttat

SEQ ID NO: 22029 - DNA, 21 bp, Artificial Sequence
  Synthetic
ttgaagtggggtaatgctacg

SEQ ID NO: 22030 - DNA, 21 bp, Artificial Sequence
  Synthetic
acgtctattgtgaggtgggat

SEQ ID NO: 22031 - DNA, 21 bp, Artificial Sequence
  Synthetic
tggtttgagcatggttcggcg

SEQ ID NO: 22032 - DNA, 21 bp, Artificial Sequence
  Synthetic
gtgccgtatagtctgactgtg

SEQ ID NO: 22033 - DNA, 21 bp, Artificial Sequence
  Synthetic
atggcggttgggtggagtgcg

SEQ ID NO: 22034 - DNA, 21 bp, Artificial Sequence
  Synthetic
actgttcctacgtctcattgg

SEQ ID NO: 22035 - DNA, 21 bp, Artificial Sequence
  Synthetic
ggtagtgttgcgtcgcattgg

SEQ ID NO: 22036 - DNA, 21 bp, Artificial Sequence
  Synthetic
cctcgggcgcctggggcttgg

SEQ ID NO: 22037 - DNA, 21 bp, Artificial Sequence
  Synthetic
gctgggtatgggtattctagt

SEQ ID NO: 22038 - DNA, 21 bp, Artificial Sequence
  Synthetic
caggggcatagtagttgggcg

SEQ ID NO: 22039 - DNA, 21 bp, Artificial Sequence
  Synthetic
gcgaggtgggagggttcggcg

SEQ ID NO: 22040 - DNA, 21 bp, Artificial Sequence
  Synthetic
gtttatattgggggggcgcag

SEQ ID NO: 22041 - DNA, 21 bp, Artificial Sequence
  Synthetic
tcggttcattggaaggctgat

SEQ ID NO: 22042 - DNA, 21 bp, Artificial Sequence
  Synthetic
atgtttcaggggtattctgtg

SEQ ID NO: 22043 - DNA, 21 bp, Artificial Sequence
  Synthetic
ctgcagcatgggctttcgcag

SEQ ID NO: 22044 - DNA, 21 bp, Artificial Sequence
  Synthetic
agttttctggggggggcgagt

SEQ ID NO: 22045 - DNA, 21 bp, Artificial Sequence
  Synthetic
gagtatattgggatgtcgtcg

SEQ ID NO: 22046 - DNA, 21 bp, Artificial Sequence
  Synthetic
catatttatagtgggtcgatg

SEQ ID NO: 22047 - DNA, 21 bp, Artificial Sequence
  Synthetic
gtgatgactgggtattcggcg

SEQ ID NO: 22048 - DNA, 21 bp, Artificial Sequence
  Synthetic
gctgctgtgacgcatgggtgg

SEQ ID NO: 22049 - DNA, 21 bp, Artificial Sequence
  Synthetic
gtggttccgtatggttcgtcg

SEQ ID NO: 22050 - DNA, 21 bp, Artificial Sequence
  Synthetic
ttgaatgtggggttttctacg

SEQ ID NO: 22051 - DNA, 21 bp, Artificial Sequence
  Synthetic
tatatgcagatgtattctaat

SEQ ID NO: 22052 - DNA, 21 bp, Artificial Sequence
  Synthetic
gcgagggctttggggagtgcg

SEQ ID NO: 22053 - DNA, 21 bp, Artificial Sequence
  Synthetic
tgggatattgcgactggttat

SEQ ID NO: 22054 - DNA, 21 bp, Artificial Sequence
  Synthetic
catgggcatgggtttgctcag

SEQ ID NO: 22055 - DNA, 21 bp, Artificial Sequence
  Synthetic
ccgcaggcgagtgggatttgg

SEQ ID NO: 22056 - DNA, 21 bp, Artificial Sequence
  Synthetic
gcggcgttgaggttgacgaat

SEQ ID NO: 22057 - DNA, 21 bp, Artificial Sequence
  Synthetic
tataggtcgctgccgcaggtt

SEQ ID NO: 22058 - DNA, 21 bp, Artificial Sequence
  Synthetic
cctaagattgtgctggcggct

SEQ ID NO: 22059 - DNA, 21 bp, Artificial Sequence
  Synthetic
gagcggacgtggagtgctgcg

SEQ ID NO: 22060 - DNA, 21 bp, Artificial Sequence
  Synthetic
actgggcttgggttttcttcg

SEQ ID NO: 22061 - DNA, 21 bp, Artificial Sequence
  Synthetic
gctctttgggcgggtagttcg

SEQ ID NO: 22062 - DNA, 21 bp, Artificial Sequence
  Synthetic
atgatgtcgaggttttctgct

SEQ ID NO: 22063 - DNA, 21 bp, Artificial Sequence
  Synthetic
cgtcagtatagtcttgagatg

SEQ ID NO: 22064 - DNA, 21 bp, Artificial Sequence
  Synthetic
gatgagagttcggcgctgagg

SEQ ID NO: 22065 - DNA, 21 bp, Artificial Sequence
  Synthetic
actgctgcgtggatggctcag

SEQ ID NO: 22066 - DNA, 21 bp, Artificial Sequence
  Synthetic
cggcatattggggagtcgtct

SEQ ID NO: 22067 - DNA, 21 bp, Artificial Sequence
  Synthetic
agttgggatcttaggcattct

SEQ ID NO: 22068 - DNA, 21 bp, Artificial Sequence
  Synthetic
gagtatcctgcgttttctatg

SEQ ID NO: 22069 - DNA, 21 bp, Artificial Sequence
  Synthetic
tcggatgcttggaatcgggtt

SEQ ID NO: 22070 - DNA, 21 bp, Artificial Sequence
  Synthetic
gatagggatgctgcgaggtgg

SEQ ID NO: 22071 - DNA, 21 bp, Artificial Sequence
  Synthetic
caggcttgggcgggttctact

SEQ ID NO: 22072 - DNA, 21 bp, Artificial Sequence
  Synthetic
gcttggggggggtttgggccg

SEQ ID NO: 22073 - DNA, 21 bp, Artificial Sequence
  Synthetic
ggggctgttcctggtgcttgg

SEQ ID NO: 22074 - DNA, 21 bp, Artificial Sequence
  Synthetic
ggttatgttccggcggcgagt

SEQ ID NO: 22075 - DNA, 21 bp, Artificial Sequence
  Synthetic
gatgctcggaatacgtggacg

SEQ ID NO: 22076 - DNA, 21 bp, Artificial Sequence
  Synthetic
ctttgggctggtaattcgagt

SEQ ID NO: 22077 - DNA, 21 bp, Artificial Sequence
  Synthetic
tcgtgggcgcagggttcgtct

SEQ ID NO: 22078 - DNA, 21 bp, Artificial Sequence
  Synthetic
attttgtcgggttttcgtgat

SEQ ID NO: 22079 - DNA, 21 bp, Artificial Sequence
  Synthetic
gagtcgacgaggtctatgtgg

SEQ ID NO: 22080 - DNA, 21 bp, Artificial Sequence
  Synthetic
gatttgttgtttggttatgct

SEQ ID NO: 22081 - DNA, 21 bp, Artificial Sequence
  Synthetic
acggttttgagggggtctacg

SEQ ID NO: 22082 - DNA, 21 bp, Artificial Sequence
  Synthetic
ggtgctaattctggtatgtgg

SEQ ID NO: 22083 - DNA, 21 bp, Artificial Sequence
  Synthetic
cataatgattattataggccg

SEQ ID NO: 22084 - DNA, 21 bp, Artificial Sequence
  Synthetic
catacgcaggatggtcgttgg

SEQ ID NO: 22085 - DNA, 21 bp, Artificial Sequence
  Synthetic
aatcagaggtatgagggttgg

SEQ ID NO: 22086 - DNA, 21 bp, Artificial Sequence
  Synthetic
cgttggacgggtgagagtcag

SEQ ID NO: 22087 - DNA, 21 bp, Artificial Sequence
  Synthetic
tataggcctcttcctgagtat

SEQ ID NO: 22088 - DNA, 21 bp, Artificial Sequence
  Synthetic
ggtacggaggcggggcggtgg

SEQ ID NO: 22089 - DNA, 21 bp, Artificial Sequence
  Synthetic
ggtgagggttcgagtcggtgg

SEQ ID NO: 22090 - DNA, 21 bp, Artificial Sequence
  Synthetic
tcttatcctggggagagttct

SEQ ID NO: 22091 - DNA, 21 bp, Artificial Sequence
  Synthetic
ttggagccgaattcgtggaag

SEQ ID NO: 22092 - DNA, 21 bp, Artificial Sequence
  Synthetic
cttaattataatctgagttcg

SEQ ID NO: 22093 - DNA, 21 bp, Artificial Sequence
  Synthetic
agtgggttgactcgttgggat

SEQ ID NO: 22094 - DNA, 21 bp, Artificial Sequence
  Synthetic
gtgcatattactcagggttgg

SEQ ID NO: 22095 - DNA, 21 bp, Artificial Sequence
  Synthetic
ggtattcatactggtatgtgg

SEQ ID NO: 22096 - DNA, 21 bp, Artificial Sequence
  Synthetic
gttaagctggggactatttat

SEQ ID NO: 22097 - DNA, 21 bp, Artificial Sequence
  Synthetic
caggggcattttgagtcgtgg

SEQ ID NO: 22098 - DNA, 21 bp, Artificial Sequence
  Synthetic
atgattcagcttgggtcggcg

SEQ ID NO: 22099 - DNA, 21 bp, Artificial Sequence
  Synthetic
actcattcgggttgggctagt

SEQ ID NO: 22100 - DNA, 21 bp, Artificial Sequence
  Synthetic
cgtgaggggtggcgtgttgat

SEQ ID NO: 22101 - DNA, 21 bp, Artificial Sequence
  Synthetic
gatacgaatacgggtcggtgg

SEQ ID NO: 22102 - DNA, 21 bp, Artificial Sequence
  Synthetic
gggtttgattctagtaggtgg

SEQ ID NO: 22103 - DNA, 21 bp, Artificial Sequence
  Synthetic
tgggcgaagctgtttagtgct

SEQ ID NO: 22104 - DNA, 21 bp, Artificial Sequence
  Synthetic
catttggctgggtatgcgctt

SEQ ID NO: 22105 - DNA, 21 bp, Artificial Sequence
  Synthetic
atggtgagtactcagcattgg

SEQ ID NO: 22106 - DNA, 21 bp, Artificial Sequence
  Synthetic
acgcattatagtggtagtacg

SEQ ID NO: 22107 - DNA, 21 bp, Artificial Sequence
  Synthetic
ggttctcggtatgatctgagt

SEQ ID NO: 22108 - DNA, 21 bp, Artificial Sequence
  Synthetic
tgggctcttatgggtgctgct

SEQ ID NO: 22109 - DNA, 21 bp, Artificial Sequence
  Synthetic
gagagggttcatggtagtagt

SEQ ID NO: 22110 - DNA, 21 bp, Artificial Sequence
  Synthetic
ttgaagccggcgtggtcttct

SEQ ID NO: 22111 - DNA, 21 bp, Artificial Sequence
  Synthetic
gttgggaagcctggggtttgg

SEQ ID NO: 22112 - DNA, 21 bp, Artificial Sequence
  Synthetic
tggacgcctggggcgggtttt

SEQ ID NO: 22113 - DNA, 21 bp, Artificial Sequence
  Synthetic
cctaataagtgggatattgcg

SEQ ID NO: 22114 - DNA, 21 bp, Artificial Sequence
  Synthetic
gagaaggctcagtggtctacg

SEQ ID NO: 22115 - DNA, 21 bp, Artificial Sequence
  Synthetic
gtggagcgtggttggagttct

SEQ ID NO: 22116 - DNA, 21 bp, Artificial Sequence
  Synthetic
tatcctccggggctgtcttcg

SEQ ID NO: 22117 - DNA, 21 bp, Artificial Sequence
  Synthetic
aggtttattggtaattcggct

SEQ ID NO: 22118 - DNA, 21 bp, Artificial Sequence
  Synthetic
ggtgggctgtcgcgttgggat

SEQ ID NO: 22119 - DNA, 21 bp, Artificial Sequence
  Synthetic
tcggggcctggtatgtcgcag

SEQ ID NO: 22120 - DNA, 21 bp, Artificial Sequence
  Synthetic
ttttataagttgggtagtgcg

SEQ ID NO: 22121 - DNA, 21 bp, Artificial Sequence
  Synthetic
aatgtgttgaatgggtttcgt

SEQ ID NO: 22122 - DNA, 21 bp, Artificial Sequence
  Synthetic
tgggttgatcttggtagtgtg

SEQ ID NO: 22123 - DNA, 21 bp, Artificial Sequence
  Synthetic
attgtgcctggtttttcggtg

SEQ ID NO: 22124 - DNA, 21 bp, Artificial Sequence
  Synthetic
atgcggtttaatggtagtgct

SEQ ID NO: 22125 - DNA, 21 bp, Artificial Sequence
  Synthetic
tatcgggagttgtggagtgct

SEQ ID NO: 22126 - DNA, 21 bp, Artificial Sequence
  Synthetic
tcggagggttcttctaggtgg

SEQ ID NO: 22127 - DNA, 21 bp, Artificial Sequence
  Synthetic
attcggcttggtgaggctcag

SEQ ID NO: 22128 - DNA, 21 bp, Artificial Sequence
  Synthetic
ctgcattattcgggtagtagt

SEQ ID NO: 22129 - DNA, 21 bp, Artificial Sequence
  Synthetic
tttcctgttgggtggagtgct

SEQ ID NO: 22130 - DNA, 21 bp, Artificial Sequence
  Synthetic
gggtttgctggtggtagtact

SEQ ID NO: 22131 - DNA, 21 bp, Artificial Sequence
  Synthetic
ccggattttaggctgcctcgt

SEQ ID NO: 22132 - DNA, 21 bp, Artificial Sequence
  Synthetic
cgttttcctgcggataggatt

SEQ ID NO: 22133 - DNA, 21 bp, Artificial Sequence
  Synthetic
ggggtttatggttcgatttat

SEQ ID NO: 22134 - DNA, 21 bp, Artificial Sequence
  Synthetic
acgatgccgcaggggatttgg

SEQ ID NO: 22135 - DNA, 21 bp, Artificial Sequence
  Synthetic
tttgagccttggttttctagt

SEQ ID NO: 22136 - DNA, 21 bp, Artificial Sequence
  Synthetic
tggcatcattcgttgagtttg

SEQ ID NO: 22137 - DNA, 21 bp, Artificial Sequence
  Synthetic
tgggctgagtggggtagtgcg

SEQ ID NO: 22138 - DNA, 21 bp, Artificial Sequence
  Synthetic
gatgcgattggtaatcgttgg

SEQ ID NO: 22139 - DNA, 21 bp, Artificial Sequence
  Synthetic
actgttgcgggttttagtagt

SEQ ID NO: 22140 - DNA, 21 bp, Artificial Sequence
  Synthetic
catcctgtttttcattcgtcg

SEQ ID NO: 22141 - DNA, 21 bp, Artificial Sequence
  Synthetic
gagaagtggtctggtagttcg

SEQ ID NO: 22142 - DNA, 21 bp, Artificial Sequence
  Synthetic
tggcctcggtatgttgatagt

SEQ ID NO: 22143 - DNA, 21 bp, Artificial Sequence
  Synthetic
gggcttgatgctgctaggtgg

SEQ ID NO: 22144 - DNA, 21 bp, Artificial Sequence
  Synthetic
gtttattattcgggttcgagt

SEQ ID NO: 22145 - DNA, 21 bp, Artificial Sequence
  Synthetic
ctttttcatgggatgagtatg

SEQ ID NO: 22146 - DNA, 21 bp, Artificial Sequence
  Synthetic
gatgtgaagtttggttctact

SEQ ID NO: 22147 - DNA, 21 bp, Artificial Sequence
  Synthetic
gttcggggggtggagtgggtt

SEQ ID NO: 22148 - DNA, 21 bp, Artificial Sequence
  Synthetic
tcgagtcggggttattcgagt

SEQ ID NO: 22149 - DNA, 21 bp, Artificial Sequence
  Synthetic
catacggggtatgggtcgtct

SEQ ID NO: 22150 - DNA, 21 bp, Artificial Sequence
  Synthetic
cctgctcgtgggagtgtttat

SEQ ID NO: 22151 - DNA, 21 bp, Artificial Sequence
  Synthetic
cgttgggatagggatgcgcag

SEQ ID NO: 22152 - DNA, 21 bp, Artificial Sequence
  Synthetic
catcttgctggttatactatt

SEQ ID NO: 22153 - DNA, 21 bp, Artificial Sequence
  Synthetic
gatgattataagtggccggtg

SEQ ID NO: 22154 - DNA, 21 bp, Artificial Sequence
  Synthetic
gagcagtataagggtagtacg

SEQ ID NO: 22155 - DNA, 21 bp, Artificial Sequence
  Synthetic
ggtgagcgtgttgggctttgg

SEQ ID NO: 22156 - DNA, 21 bp, Artificial Sequence
  Synthetic
attttgcatggttatgctacg

SEQ ID NO: 22157 - DNA, 21 bp, Artificial Sequence
  Synthetic
gctggggcgaattggtctcat

SEQ ID NO: 22158 - DNA, 21 bp, Artificial Sequence
  Synthetic
agtgtgtatatggggagttct

SEQ ID NO: 22159 - DNA, 21 bp, Artificial Sequence
  Synthetic
aaggattttcctggtccgtgg

SEQ ID NO: 22160 - DNA, 21 bp, Artificial Sequence
  Synthetic
tggtctaagtttagtgatggg

SEQ ID NO: 22161 - DNA, 21 bp, Artificial Sequence
  Synthetic
gtgactcctgttgggatttgg

SEQ ID NO: 22162 - DNA, 21 bp, Artificial Sequence
  Synthetic
cgtggtactcttggtccttat

SEQ ID NO: 22163 - DNA, 21 bp, Artificial Sequence
  Synthetic
tttgagtttcggggtagtagt

SEQ ID NO: 22164 - DNA, 21 bp, Artificial Sequence
  Synthetic
gctgctaatgagagtcggtgg

SEQ ID NO: 22165 - DNA, 21 bp, Artificial Sequence
  Synthetic
gttcctgagagtgttaggtgg

SEQ ID NO: 22166 - DNA, 21 bp, Artificial Sequence
  Synthetic
gagaattataggtatccggtt

SEQ ID NO: 22167 - DNA, 21 bp, Artificial Sequence
  Synthetic
tttggggttggtttttcttct

SEQ ID NO: 22168 - DNA, 21 bp, Artificial Sequence
  Synthetic
cttggtgcgtcgtcgcgtttt

SEQ ID NO: 22169 - DNA, 21 bp, Artificial Sequence
  Synthetic
ccgactgtgcataatcagtgg

SEQ ID NO: 22170 - DNA, 21 bp, Artificial Sequence
  Synthetic
tgggctgtgtatggtgcggcg

SEQ ID NO: 22171 - DNA, 21 bp, Artificial Sequence
  Synthetic
ctgtatagtttgggttcgtct

SEQ ID NO: 22172 - DNA, 21 bp, Artificial Sequence
  Synthetic
ctttttgagcatgggtctgtg

SEQ ID NO: 22173 - DNA, 21 bp, Artificial Sequence
  Synthetic
gcgggttctcctggggtttgg

SEQ ID NO: 22174 - DNA, 21 bp, Artificial Sequence
  Synthetic
tcttattatggtggttctgcg

SEQ ID NO: 22175 - DNA, 21 bp, Artificial Sequence
  Synthetic
catatgactcagggtagtgcg

SEQ ID NO: 22176 - DNA, 21 bp, Artificial Sequence
  Synthetic
gagcatgagtgggctctttcg

SEQ ID NO: 22177 - DNA, 21 bp, Artificial Sequence
  Synthetic
cctcatgcggggttttcttct

SEQ ID NO: 22178 - DNA, 21 bp, Artificial Sequence
  Synthetic
attaaggctggttatagtagt

SEQ ID NO: 22179 - DNA, 21 bp, Artificial Sequence
  Synthetic
gagtattataagttgcctact

SEQ ID NO: 22180 - DNA, 21 bp, Artificial Sequence
  Synthetic
ctgatggctgggtatagtgct

SEQ ID NO: 22181 - DNA, 21 bp, Artificial Sequence
  Synthetic
cctgtgaatgatcatcgttgg

SEQ ID NO: 22182 - DNA, 21 bp, Artificial Sequence
  Synthetic
aggtatccgggggatccgagt

SEQ ID NO: 22183 - DNA, 21 bp, Artificial Sequence
  Synthetic
caggcgcctttttatagtcag

SEQ ID NO: 22184 - DNA, 21 bp, Artificial Sequence
  Synthetic
tatcggccgcttcctggtctt

SEQ ID NO: 22185 - DNA, 21 bp, Artificial Sequence
  Synthetic
ggggcgtggcatgggtcttct

SEQ ID NO: 22186 - DNA, 21 bp, Artificial Sequence
  Synthetic
gagcttccgactgcgaggtat

SEQ ID NO: 22187 - DNA, 21 bp, Artificial Sequence
  Synthetic
gagcgtctttatgcttctagt

SEQ ID NO: 22188 - DNA, 21 bp, Artificial Sequence
  Synthetic
attgattttttgaagtttgag

SEQ ID NO: 22189 - DNA, 21 bp, Artificial Sequence
  Synthetic
actgcgtatgggcaggcgcag

SEQ ID NO: 22190 - DNA, 21 bp, Artificial Sequence
  Synthetic
tttactccttggattgatgag

SEQ ID NO: 22191 - DNA, 21 bp, Artificial Sequence
  Synthetic
cgtgctcttggtcttagttct

SEQ ID NO: 22192 - DNA, 21 bp, Artificial Sequence
  Synthetic
cgttatagtggggattctgtg

SEQ ID NO: 22193 - DNA, 21 bp, Artificial Sequence
  Synthetic
gctcagttttatggttctgct

SEQ ID NO: 22194 - DNA, 21 bp, Artificial Sequence
  Synthetic
atgatttatggtagtgctcag

SEQ ID NO: 22195 - DNA, 21 bp, Artificial Sequence
  Synthetic
ccttgggctgggaatctggct

SEQ ID NO: 22196 - DNA, 21 bp, Artificial Sequence
  Synthetic
gcgaggtttgggggtagtact

SEQ ID NO: 22197 - DNA, 21 bp, Artificial Sequence
  Synthetic
tttcgttcggggggggctcag

SEQ ID NO: 22198 - DNA, 21 bp, Artificial Sequence
  Synthetic
cctagggtgaattatagtagt

SEQ ID NO: 22199 - DNA, 21 bp, Artificial Sequence
  Synthetic
aatattattcgtcttcataat

SEQ ID NO: 22200 - DNA, 21 bp, Artificial Sequence
  Synthetic
gggactagtcctgggccttgg

SEQ ID NO: 22201 - DNA, 21 bp, Artificial Sequence
  Synthetic
ggggtgttggggaatatgtgg

SEQ ID NO: 22202 - DNA, 21 bp, Artificial Sequence
  Synthetic
gagtggttgggtggggctgct

SEQ ID NO: 22203 - DNA, 21 bp, Artificial Sequence
  Synthetic
cagattccgggtttttctgct

SEQ ID NO: 22204 - DNA, 21 bp, Artificial Sequence
  Synthetic
tttgtttctcttcctcatagt

SEQ ID NO: 22205 - DNA, 21 bp, Artificial Sequence
  Synthetic
tgggggtcgcttagtgatttg

SEQ ID NO: 22206 - DNA, 21 bp, Artificial Sequence
  Synthetic
aattgggatctgcgggatcgg

SEQ ID NO: 22207 - DNA, 21 bp, Artificial Sequence
  Synthetic
gttgctggtgatgggaggtgg

SEQ ID NO: 22208 - DNA, 21 bp, Artificial Sequence
  Synthetic
tggcaggttttgggtgctagt

SEQ ID NO: 22209 - DNA, 21 bp, Artificial Sequence
  Synthetic
ttggatcattcggggaggtgg

SEQ ID NO: 22210 - DNA, 21 bp, Artificial Sequence
  Synthetic
tcgcttctgacggggtatggg

SEQ ID NO: 22211 - DNA, 21 bp, Artificial Sequence
  Synthetic
gatttgcattctcctctgtgg

SEQ ID NO: 22212 - DNA, 21 bp, Artificial Sequence
  Synthetic
gagcgtacgaattgggctgcg

SEQ ID NO: 22213 - DNA, 21 bp, Artificial Sequence
  Synthetic
gaggttagttatggttcgtcg

SEQ ID NO: 22214 - DNA, 21 bp, Artificial Sequence
  Synthetic
ccgacgattgtgctgaagccg

SEQ ID NO: 22215 - DNA, 21 bp, Artificial Sequence
  Synthetic
gaggggaggccgggggtgtgg

SEQ ID NO: 22216 - DNA, 21 bp, Artificial Sequence
  Synthetic
gttgtggcgtgggatcgtgtg

SEQ ID NO: 22217 - DNA, 21 bp, Artificial Sequence
  Synthetic
attcattggcctcaggcttcg

SEQ ID NO: 22218 - DNA, 21 bp, Artificial Sequence
  Synthetic
gtgcttctgcgtggttataat

SEQ ID NO: 22219 - DNA, 21 bp, Artificial Sequence
  Synthetic
ctggggccgattcggtgggat

SEQ ID NO: 22220 - DNA, 21 bp, Artificial Sequence
  Synthetic
ccttcgggtaattgggcgtat

SEQ ID NO: 22221 - DNA, 21 bp, Artificial Sequence
  Synthetic
attccgaagttttggagtgat

SEQ ID NO: 22222 - DNA, 21 bp, Artificial Sequence
  Synthetic
gagtggccggggggggcgtcg

SEQ ID NO: 22223 - DNA, 21 bp, Artificial Sequence
  Synthetic
atggttgtgatgggtagtgcg

SEQ ID NO: 22224 - DNA, 21 bp, Artificial Sequence
  Synthetic
ccttatgagccgggtaggtgg

SEQ ID NO: 22225 - DNA, 21 bp, Artificial Sequence
  Synthetic
aggtatgctggtgaggctgct

SEQ ID NO: 22226 - DNA, 21 bp, Artificial Sequence
  Synthetic
tttattaggcttggtgctgct

SEQ ID NO: 22227 - DNA, 21 bp, Artificial Sequence
  Synthetic
ctgattcggggttatagtagt

SEQ ID NO: 22228 - DNA, 21 bp, Artificial Sequence
  Synthetic
cctagtggtcatgggagttgg

SEQ ID NO: 22229 - DNA, 21 bp, Artificial Sequence
  Synthetic
agggggttggggttgtcgagt

SEQ ID NO: 22230 - DNA, 21 bp, Artificial Sequence
  Synthetic
gtgtggcatgcggggtcgagt

SEQ ID NO: 22231 - DNA, 21 bp, Artificial Sequence
  Synthetic
actgtgtatggtgggagtacg

SEQ ID NO: 22232 - DNA, 21 bp, Artificial Sequence
  Synthetic
acgttgcgttatgaggcgtcg

SEQ ID NO: 22233 - DNA, 21 bp, Artificial Sequence
  Synthetic
ccgaagaataatggtgtttgg

SEQ ID NO: 22234 - DNA, 21 bp, Artificial Sequence
  Synthetic
catattacgcatggggctagt

SEQ ID NO: 22235 - DNA, 21 bp, Artificial Sequence
  Synthetic
tggggggttcttgataaggtg

SEQ ID NO: 22236 - DNA, 21 bp, Artificial Sequence
  Synthetic
agtaggagtggtatgcctgtt

SEQ ID NO: 22237 - DNA, 21 bp, Artificial Sequence
  Synthetic
gagaagtcgggttattctagt

SEQ ID NO: 22238 - DNA, 21 bp, Artificial Sequence
  Synthetic
tggaagttggctgggtctcag

SEQ ID NO: 22239 - DNA, 21 bp, Artificial Sequence
  Synthetic
gagatgccgggttttagtgcg

SEQ ID NO: 22240 - DNA, 21 bp, Artificial Sequence
  Synthetic
cagtttcatttgggttcggcg

SEQ ID NO: 22241 - DNA, 21 bp, Artificial Sequence
  Synthetic
atgggtcctggggggtattgg

SEQ ID NO: 22242 - DNA, 21 bp, Artificial Sequence
  Synthetic
ttgattcagtttcagagtagt

SEQ ID NO: 22243 - DNA, 21 bp, Artificial Sequence
  Synthetic
gattatcctgctcagagttcg

SEQ ID NO: 22244 - DNA, 21 bp, Artificial Sequence
  Synthetic
tggtctgttgggggggggcat

SEQ ID NO: 22245 - DNA, 21 bp, Artificial Sequence
  Synthetic
cattatactggtcattcgagt

SEQ ID NO: 22246 - DNA, 21 bp, Artificial Sequence
  Synthetic
caggggtataatagtagtttt

SEQ ID NO: 22247 - DNA, 21 bp, Artificial Sequence
  Synthetic
cggccttatcatgttgatact

SEQ ID NO: 22248 - DNA, 21 bp, Artificial Sequence
  Synthetic
ttgcggtatatgctttctgat

SEQ ID NO: 22249 - DNA, 21 bp, Artificial Sequence
  Synthetic
tcgcgggagtatgggtcgtcg

SEQ ID NO: 22250 - DNA, 21 bp, Artificial Sequence
  Synthetic
cctaaggttggtttttctgcg

SEQ ID NO: 22251 - DNA, 21 bp, Artificial Sequence
  Synthetic
gtgccggggctgggttttcgt

SEQ ID NO: 22252 - DNA, 21 bp, Artificial Sequence
  Synthetic
cgtcctctgaggattgatgtt

SEQ ID NO: 22253 - DNA, 21 bp, Artificial Sequence
  Synthetic
ctgagttattcgcatactctg

SEQ ID NO: 22254 - DNA, 21 bp, Artificial Sequence
  Synthetic
ggtgttcatagtgggcagtgg

SEQ ID NO: 22255 - DNA, 21 bp, Artificial Sequence
  Synthetic
ccgtgggctggtatgagtagt

SEQ ID NO: 22256 - DNA, 21 bp, Artificial Sequence
  Synthetic
aattatcgtgttggggttatt

SEQ ID NO: 22257 - DNA, 21 bp, Artificial Sequence
  Synthetic
tggggtagtcctgtgcatacg

SEQ ID NO: 22258 - DNA, 21 bp, Artificial Sequence
  Synthetic
tttacggttggttcgatttat

SEQ ID NO: 22259 - DNA, 21 bp, Artificial Sequence
  Synthetic
ctgttggatacgaattattgg

SEQ ID NO: 22260 - DNA, 21 bp, Artificial Sequence
  Synthetic
cgttatgttggggataatacg

SEQ ID NO: 22261 - DNA, 21 bp, Artificial Sequence
  Synthetic
acgatgtatggtgggtctacg

SEQ ID NO: 22262 - DNA, 21 bp, Artificial Sequence
  Synthetic
gtgcaggcgtgggatagggtg

SEQ ID NO: 22263 - DNA, 21 bp, Artificial Sequence
  Synthetic
catattggttttggtagtgcg

SEQ ID NO: 22264 - DNA, 21 bp, Artificial Sequence
  Synthetic
gagcgttatcatgttggtgtg

SEQ ID NO: 22265 - DNA, 21 bp, Artificial Sequence
  Synthetic
gcgaggagtggtttttctagt

SEQ ID NO: 22266 - DNA, 21 bp, Artificial Sequence
  Synthetic
gttgtttcgcatggttcgtcg

SEQ ID NO: 22267 - DNA, 21 bp, Artificial Sequence
  Synthetic
cttctgcattatggtagtagt

SEQ ID NO: 22268 - DNA, 21 bp, Artificial Sequence
  Synthetic
gcttatcatggtgcggctgcg

SEQ ID NO: 22269 - DNA, 21 bp, Artificial Sequence
  Synthetic
atggtgcatgggttttcgtct

SEQ ID NO: 22270 - DNA, 21 bp, Artificial Sequence
  Synthetic
ttgtatccgtcttatagttcg

SEQ ID NO: 22271 - DNA, 21 bp, Artificial Sequence
  Synthetic
atggttacgcatggttttagt

SEQ ID NO: 22272 - DNA, 21 bp, Artificial Sequence
  Synthetic
gatcgtttgcgtggttcggcg

SEQ ID NO: 22273 - DNA, 21 bp, Artificial Sequence
  Synthetic
catatgaagcttggttctact

SEQ ID NO: 22274 - DNA, 21 bp, Artificial Sequence
  Synthetic
gatcctatgtggaatcgtgcg

SEQ ID NO: 22275 - DNA, 21 bp, Artificial Sequence
  Synthetic
gctcgtgtggcgttggttaat

SEQ ID NO: 22276 - DNA, 21 bp, Artificial Sequence
  Synthetic
ccgtatcctatgatgtctagt

SEQ ID NO: 22277 - DNA, 21 bp, Artificial Sequence
  Synthetic
gtgaatgtttcgcattttcat

SEQ ID NO: 22278 - DNA, 21 bp, Artificial Sequence
  Synthetic
tatggggttcttaatcgtctg

SEQ ID NO: 22279 - DNA, 21 bp, Artificial Sequence
  Synthetic
gctgcgggggaggttcggtgg

SEQ ID NO: 22280 - DNA, 21 bp, Artificial Sequence
  Synthetic
atgaattttgggcttgcgcag

SEQ ID NO: 22281 - DNA, 21 bp, Artificial Sequence
  Synthetic
gagcctgttacgaatcgttgg

SEQ ID NO: 22282 - DNA, 21 bp, Artificial Sequence
  Synthetic
ttgtggaatatggggagttcg

SEQ ID NO: 22283 - DNA, 21 bp, Artificial Sequence
  Synthetic
ctgtatggtgggtatgcgcag

SEQ ID NO: 22284 - DNA, 21 bp, Artificial Sequence
  Synthetic
gcttgggcggggtctgcgagt

SEQ ID NO: 22285 - DNA, 21 bp, Artificial Sequence
  Synthetic
ggtagtgatgttggtgtgtgg

SEQ ID NO: 22286 - DNA, 21 bp, Artificial Sequence
  Synthetic
gcgtatcatatgggggctgcg

SEQ ID NO: 22287 - DNA, 21 bp, Artificial Sequence
  Synthetic
tggatgaagggttatagtatg

SEQ ID NO: 22288 - DNA, 21 bp, Artificial Sequence
  Synthetic
tcgctgtatttggggtctacg

SEQ ID NO: 22289 - DNA, 21 bp, Artificial Sequence
  Synthetic
acgactaatgatggtaggtgg

SEQ ID NO: 22290 - DNA, 21 bp, Artificial Sequence
  Synthetic
ctgcatattggtgctgcgcag

SEQ ID NO: 22291 - DNA, 21 bp, Artificial Sequence
  Synthetic
ccgtgggttcctgcgtctagt

SEQ ID NO: 22292 - DNA, 21 bp, Artificial Sequence
  Synthetic
ctggattatgggatggcgcag

SEQ ID NO: 22293 - DNA, 21 bp, Artificial Sequence
  Synthetic
gagcggacggggtggagtgtt

SEQ ID NO: 22294 - DNA, 21 bp, Artificial Sequence
  Synthetic
atgtttgggtatggttcgtct

SEQ ID NO: 22295 - DNA, 21 bp, Artificial Sequence
  Synthetic
atgaagtttagtgggtcgacg

SEQ ID NO: 22296 - DNA, 21 bp, Artificial Sequence
  Synthetic
gtgtttattggttcgagtacg

SEQ ID NO: 22297 - DNA, 21 bp, Artificial Sequence
  Synthetic
ggtgcttctcctgggttgtgg

SEQ ID NO: 22298 - DNA, 21 bp, Artificial Sequence
  Synthetic
gggcctacgtggacgtctagt

SEQ ID NO: 22299 - DNA, 21 bp, Artificial Sequence
  Synthetic
tggtctcttcatggttcgagt

SEQ ID NO: 22300 - DNA, 21 bp, Artificial Sequence
  Synthetic
gggtctgatagtggtaggtgg

SEQ ID NO: 22301 - DNA, 21 bp, Artificial Sequence
  Synthetic
tgggctgttgggcgggcgggt

SEQ ID NO: 22302 - DNA, 21 bp, Artificial Sequence
  Synthetic
aggcaggttgcggatcgtgct

SEQ ID NO: 22303 - DNA, 21 bp, Artificial Sequence
  Synthetic
ttgattactggggggtttcgg

SEQ ID NO: 22304 - DNA, 21 bp, Artificial Sequence
  Synthetic
acgctgaatcctggtcgttgg

SEQ ID NO: 22305 - DNA, 21 bp, Artificial Sequence
  Synthetic
gctggggattctaagaatgag

SEQ ID NO: 22306 - DNA, 21 bp, Artificial Sequence
  Synthetic
tttgagactagtaggtgggct

SEQ ID NO: 22307 - DNA, 21 bp, Artificial Sequence
  Synthetic
ttggttgggtctgggaagtgg

SEQ ID NO: 22308 - DNA, 21 bp, Artificial Sequence
  Synthetic
gattggggtcgtgttgggatt

SEQ ID NO: 22309 - DNA, 21 bp, Artificial Sequence
  Synthetic
tttgagccgattggtaggtgg

SEQ ID NO: 22310 - DNA, 21 bp, Artificial Sequence
  Synthetic
tatgatgtggggttgggttgg

SEQ ID NO: 22311 - DNA, 21 bp, Artificial Sequence
  Synthetic
actgctcggatggggagtgcg

SEQ ID NO: 22312 - DNA, 21 bp, Artificial Sequence
  Synthetic
cctattcctcggagtattggt

SEQ ID NO: 22313 - DNA, 21 bp, Artificial Sequence
  Synthetic
gtggggtattctagttcgctg

SEQ ID NO: 22314 - DNA, 21 bp, Artificial Sequence
  Synthetic
gtgagggtgtatgagagtagt

SEQ ID NO: 22315 - DNA, 21 bp, Artificial Sequence
  Synthetic
cttgttgtggggtcggtttat

SEQ ID NO: 22316 - DNA, 21 bp, Artificial Sequence
  Synthetic
gagcgtcttcagggttgggcg

SEQ ID NO: 22317 - DNA, 21 bp, Artificial Sequence
  Synthetic
cgtcggctgggtgatagttct

SEQ ID NO: 22318 - DNA, 21 bp, Artificial Sequence
  Synthetic
tgttatcctgttggtatttgt

SEQ ID NO: 22319 - DNA, 21 bp, Artificial Sequence
  Synthetic
gctggtacgcctgggccgtgg

SEQ ID NO: 22320 - DNA, 21 bp, Artificial Sequence
  Synthetic
ctttatttgggttctgcgagt

SEQ ID NO: 22321 - DNA, 21 bp, Artificial Sequence
  Synthetic
agggtttattctgggagtgcg

SEQ ID NO: 22322 - DNA, 21 bp, Artificial Sequence
  Synthetic
gctcggttgggttatagtacg

SEQ ID NO: 22323 - DNA, 21 bp, Artificial Sequence
  Synthetic
gatgggcggcctggtctttgg

SEQ ID NO: 22324 - DNA, 21 bp, Artificial Sequence
  Synthetic
tcgaaggcgggttatagtgcg

SEQ ID NO: 22325 - DNA, 21 bp, Artificial Sequence
  Synthetic
tggaagagtggtttttcttcg

SEQ ID NO: 22326 - DNA, 21 bp, Artificial Sequence
  Synthetic
gtgccgggtgaggttcgttgg

SEQ ID NO: 22327 - DNA, 21 bp, Artificial Sequence
  Synthetic
aatcagagtttgttttcttct

SEQ ID NO: 22328 - DNA, 21 bp, Artificial Sequence
  Synthetic
cagcatactgctcagacgtgg

SEQ ID NO: 22329 - DNA, 21 bp, Artificial Sequence
  Synthetic
ctgctgcctaggtggtcgact

SEQ ID NO: 22330 - DNA, 21 bp, Artificial Sequence
  Synthetic
ttgacttatggtggggctcag

SEQ ID NO: 22331 - DNA, 21 bp, Artificial Sequence
  Synthetic
ttggtggtgcgtggttctact

SEQ ID NO: 22332 - DNA, 21 bp, Artificial Sequence
  Synthetic
gagaggccgctgttttcggcg

SEQ ID NO: 22333 - DNA, 21 bp, Artificial Sequence
  Synthetic
gagattttggggaggggttgg

SEQ ID NO: 22334 - DNA, 21 bp, Artificial Sequence
  Synthetic
tctcggccgatgtatagtgcg

SEQ ID NO: 22335 - DNA, 21 bp, Artificial Sequence
  Synthetic
aagttttatggtgatgcgtct

SEQ ID NO: 22336 - DNA, 21 bp, Artificial Sequence
  Synthetic
ttgttgcatggttatagtgtt

SEQ ID NO: 22337 - DNA, 21 bp, Artificial Sequence
  Synthetic
cctcagcgtgggtctgtttat

SEQ ID NO: 22338 - DNA, 21 bp, Artificial Sequence
  Synthetic
gataggactatggggtattat

SEQ ID NO: 22339 - DNA, 21 bp, Artificial Sequence
  Synthetic
cagttttattctggggcggcg

SEQ ID NO: 22340 - DNA, 21 bp, Artificial Sequence
  Synthetic
actgtttttaagggtagtagt

SEQ ID NO: 22341 - DNA, 21 bp, Artificial Sequence
  Synthetic
aatgatgcgactgcgcgttat

SEQ ID NO: 22342 - DNA, 21 bp, Artificial Sequence
  Synthetic
cctcgggaggttcatgggtgg

SEQ ID NO: 22343 - DNA, 21 bp, Artificial Sequence
  Synthetic
tgggagactcatggttctagt

SEQ ID NO: 22344 - DNA, 21 bp, Artificial Sequence
  Synthetic
aggtatcttgcggatgcgagt

SEQ ID NO: 22345 - DNA, 21 bp, Artificial Sequence
  Synthetic
gcttatccggggtattcgtct

SEQ ID NO: 22346 - DNA, 21 bp, Artificial Sequence
  Synthetic
atgcgtgagacgtgggcgagt

SEQ ID NO: 22347 - DNA, 21 bp, Artificial Sequence
  Synthetic
tttcttccttttggttcgagt

SEQ ID NO: 22348 - DNA, 21 bp, Artificial Sequence
  Synthetic
cggtatgcgcatgatagtatg

SEQ ID NO: 22349 - DNA, 21 bp, Artificial Sequence
  Synthetic
attgctacgggttattcgtcg

SEQ ID NO: 22350 - DNA, 21 bp, Artificial Sequence
  Synthetic
gaggatacgaggaggtatttt

SEQ ID NO: 22351 - DNA, 21 bp, Artificial Sequence
  Synthetic
tctgagaagtggactgctagt

SEQ ID NO: 22352 - DNA, 21 bp, Artificial Sequence
  Synthetic
acgtctacgcatggtagtacg

SEQ ID NO: 22353 - DNA, 21 bp, Artificial Sequence
  Synthetic
cctacggattattcggcttgg

SEQ ID NO: 22354 - DNA, 21 bp, Artificial Sequence
  Synthetic
atgtctgctggttctatttat

SEQ ID NO: 22355 - DNA, 21 bp, Artificial Sequence
  Synthetic
ccggttagggggtttagtgct

SEQ ID NO: 22356 - DNA, 21 bp, Artificial Sequence
  Synthetic
tggacgatggagttggggtat

SEQ ID NO: 22357 - DNA, 21 bp, Artificial Sequence
  Synthetic
cctgcgtgggggtctgttgcg

SEQ ID NO: 22358 - DNA, 21 bp, Artificial Sequence
  Synthetic
atgcgtgtgggtacggtgtat

SEQ ID NO: 22359 - DNA, 21 bp, Artificial Sequence
  Synthetic
gctatggggagggagtggact

SEQ ID NO: 22360 - DNA, 21 bp, Artificial Sequence
  Synthetic
tttgcggctcattggtcgtct

SEQ ID NO: 22361 - DNA, 21 bp, Artificial Sequence
  Synthetic
cggcatgggactgagtgggcg

SEQ ID NO: 22362 - DNA, 21 bp, Artificial Sequence
  Synthetic
ggtaatgtgcttgagaggtgg

SEQ ID NO: 22363 - DNA, 21 bp, Artificial Sequence
  Synthetic
gatccgaggtggatgagtggt

SEQ ID NO: 22364 - DNA, 21 bp, Artificial Sequence
  Synthetic
tttattttgcatggtgcggcg

SEQ ID NO: 22365 - DNA, 21 bp, Artificial Sequence
  Synthetic
cctacggtgaattttagtgcg

SEQ ID NO: 22366 - DNA, 21 bp, Artificial Sequence
  Synthetic
cgtgcggttgggaatagttgg

SEQ ID NO: 22367 - DNA, 21 bp, Artificial Sequence
  Synthetic
gcttggccgggggggtcgtct

SEQ ID NO: 22368 - DNA, 21 bp, Artificial Sequence
  Synthetic
ggtcctgagtggaatcggccg

SEQ ID NO: 22369 - DNA, 21 bp, Artificial Sequence
  Synthetic
tggagggatcaggggtctcag

SEQ ID NO: 22370 - DNA, 21 bp, Artificial Sequence
  Synthetic
tggggtttgaatatggggtat

SEQ ID NO: 22371 - DNA, 21 bp, Artificial Sequence
  Synthetic
ttggttccggggtggagtgtg

SEQ ID NO: 22372 - DNA, 21 bp, Artificial Sequence
  Synthetic
tggagtgtttattcgagtaat

SEQ ID NO: 22373 - DNA, 21 bp, Artificial Sequence
  Synthetic
gagattctgaagtcgtttgcg

SEQ ID NO: 22374 - DNA, 21 bp, Artificial Sequence
  Synthetic
cctgcggttggttttagtgcg

SEQ ID NO: 22375 - DNA, 21 bp, Artificial Sequence
  Synthetic
aatactaatgagtataggtgg

SEQ ID NO: 22376 - DNA, 21 bp, Artificial Sequence
  Synthetic
gggtatctgcctcggcctggt

SEQ ID NO: 22377 - DNA, 21 bp, Artificial Sequence
  Synthetic
ttgggtttgggttttagtgtt

SEQ ID NO: 22378 - DNA, 21 bp, Artificial Sequence
  Synthetic
acggagaatgctgggaggtgg

SEQ ID NO: 22379 - DNA, 21 bp, Artificial Sequence
  Synthetic
tttcgtattctgggtgcggct

SEQ ID NO: 22380 - DNA, 21 bp, Artificial Sequence
  Synthetic
tgtgggcgtgcgtgttgggag

SEQ ID NO: 22381 - DNA, 21 bp, Artificial Sequence
  Synthetic
cagtggcctagtggttcgact

SEQ ID NO: 22382 - DNA, 21 bp, Artificial Sequence
  Synthetic
tggcatcatggtggggctcag

SEQ ID NO: 22383 - DNA, 21 bp, Artificial Sequence
  Synthetic
ctgctgagtggttatagtatt

SEQ ID NO: 22384 - DNA, 21 bp, Artificial Sequence
  Synthetic
ttgtgtgtgccttgtagtagt

SEQ ID NO: 22385 - DNA, 21 bp, Artificial Sequence
  Synthetic
tgggttgttgggggggctcag

SEQ ID NO: 22386 - DNA, 21 bp, Artificial Sequence
  Synthetic
atttcggttgggtggagtagt

SEQ ID NO: 22387 - DNA, 21 bp, Artificial Sequence
  Synthetic
gctcctgatgataataggtgg

SEQ ID NO: 22388 - DNA, 21 bp, Artificial Sequence
  Synthetic
ggttatggggaggttcggtgg

SEQ ID NO: 22389 - DNA, 21 bp, Artificial Sequence
  Synthetic
gttatgttgggtagtgtgtat

SEQ ID NO: 22390 - DNA, 21 bp, Artificial Sequence
  Synthetic
gttgggcatggtttttctcag

SEQ ID NO: 22391 - DNA, 21 bp, Artificial Sequence
  Synthetic
gatcgttgggttggttctgtt

SEQ ID NO: 22392 - DNA, 21 bp, Artificial Sequence
  Synthetic
ttgtttcctggggcgtcgatg

SEQ ID NO: 22393 - DNA, 21 bp, Artificial Sequence
  Synthetic
ttgatgccgggttgggcgcat

SEQ ID NO: 22394 - DNA, 21 bp, Artificial Sequence
  Synthetic
tcgcgggttggttatagtacg

SEQ ID NO: 22395 - DNA, 21 bp, Artificial Sequence
  Synthetic
atgcggcagatggggagtgtg

SEQ ID NO: 22396 - DNA, 21 bp, Artificial Sequence
  Synthetic
tttattccgctgggttcgacg

SEQ ID NO: 22397 - DNA, 21 bp, Artificial Sequence
  Synthetic
gggcggattattcttatgcct

SEQ ID NO: 22398 - DNA, 21 bp, Artificial Sequence
  Synthetic
gatattgagtggcttgcttct

SEQ ID NO: 22399 - DNA, 21 bp, Artificial Sequence
  Synthetic
gatgagccgcgttcgtggacg

SEQ ID NO: 22400 - DNA, 21 bp, Artificial Sequence
  Synthetic
gatcggacgtttgggagtgcg

SEQ ID NO: 22401 - DNA, 21 bp, Artificial Sequence
  Synthetic
actaggattcatggtagtgcg

SEQ ID NO: 22402 - DNA, 21 bp, Artificial Sequence
  Synthetic
ttggtgaggtttgagtctagt

SEQ ID NO: 22403 - DNA, 21 bp, Artificial Sequence
  Synthetic
acgcgggttgttttgattaat

SEQ ID NO: 22404 - DNA, 21 bp, Artificial Sequence
  Synthetic
gaggagcctgttggtcggtgg

SEQ ID NO: 22405 - DNA, 21 bp, Artificial Sequence
  Synthetic
gttgctgtttatatgagttct

SEQ ID NO: 22406 - DNA, 21 bp, Artificial Sequence
  Synthetic
gggagtaatgtgggtgtttgg

SEQ ID NO: 22407 - DNA, 21 bp, Artificial Sequence
  Synthetic
gaggatgggtcgggtcgttgg

SEQ ID NO: 22408 - DNA, 21 bp, Artificial Sequence
  Synthetic
aatgttgattcgcagtggtat

SEQ ID NO: 22409 - DNA, 21 bp, Artificial Sequence
  Synthetic
cctgatggtgttgtgaggtgg

SEQ ID NO: 22410 - DNA, 21 bp, Artificial Sequence
  Synthetic
ccgccttatgtgctgggtgag

SEQ ID NO: 22411 - DNA, 21 bp, Artificial Sequence
  Synthetic
cctgttttgaggcttcttaat

SEQ ID NO: 22412 - DNA, 21 bp, Artificial Sequence
  Synthetic
tttattcgtatgggttctgct

SEQ ID NO: 22413 - DNA, 21 bp, Artificial Sequence
  Synthetic
gagatttgggcggggtctgtg

SEQ ID NO: 22414 - DNA, 21 bp, Artificial Sequence
  Synthetic
gagccgggttctgggaggtgg

SEQ ID NO: 22415 - DNA, 21 bp, Artificial Sequence
  Synthetic
gatcttaatagttcgaggtgg

SEQ ID NO: 22416 - DNA, 21 bp, Artificial Sequence
  Synthetic
ttggcgccgtatcttagtagt

SEQ ID NO: 22417 - DNA, 21 bp, Artificial Sequence
  Synthetic
cttactccgtatgatcggatt

SEQ ID NO: 22418 - DNA, 21 bp, Artificial Sequence
  Synthetic
cgtgagaatgttggtgtttgg

SEQ ID NO: 22419 - DNA, 21 bp, Artificial Sequence
  Synthetic
aggtggccggcggatctggcg

SEQ ID NO: 22420 - DNA, 21 bp, Artificial Sequence
  Synthetic
ccgattggtgttggtagttgg

SEQ ID NO: 22421 - DNA, 21 bp, Artificial Sequence
  Synthetic
ggtatttggatttctagtcct

SEQ ID NO: 22422 - DNA, 21 bp, Artificial Sequence
  Synthetic
gaggatgggtggcgtgcggat

SEQ ID NO: 22423 - DNA, 21 bp, Artificial Sequence
  Synthetic
tggggtacgttgaatgttctg

SEQ ID NO: 22424 - DNA, 21 bp, Artificial Sequence
  Synthetic
cggtttgcgagtgatagttcg

SEQ ID NO: 22425 - DNA, 21 bp, Artificial Sequence
  Synthetic
agtgggagtgatggtcgttgg

SEQ ID NO: 22426 - DNA, 21 bp, Artificial Sequence
  Synthetic
attgcggattggtatcgggct

SEQ ID NO: 22427 - DNA, 21 bp, Artificial Sequence
  Synthetic
cgtggtgctgggctgtcgtcg

SEQ ID NO: 22428 - DNA, 21 bp, Artificial Sequence
  Synthetic
ggtgataatgtggggcggtgg

SEQ ID NO: 22429 - DNA, 21 bp, Artificial Sequence
  Synthetic
acggcggcttatgggagtagt

SEQ ID NO: 22430 - DNA, 21 bp, Artificial Sequence
  Synthetic
ctgctgtcgcatgggtcttcg

SEQ ID NO: 22431 - DNA, 21 bp, Artificial Sequence
  Synthetic
gagaagcatctttattcgacg

SEQ ID NO: 22432 - DNA, 21 bp, Artificial Sequence
  Synthetic
gagaggtttaatctttcttct

SEQ ID NO: 22433 - DNA, 21 bp, Artificial Sequence
  Synthetic
gaggcttggaagcatcctgtt

SEQ ID NO: 22434 - DNA, 21 bp, Artificial Sequence
  Synthetic
gtgtattatactggtagttcg

SEQ ID NO: 22435 - DNA, 21 bp, Artificial Sequence
  Synthetic
gggcggtgggaggtgtttgag

SEQ ID NO: 22436 - DNA, 21 bp, Artificial Sequence
  Synthetic
gagtattatacgggtagtact

SEQ ID NO: 22437 - DNA, 21 bp, Artificial Sequence
  Synthetic
ctgtttcatgggggtgcggct

SEQ ID NO: 22438 - DNA, 21 bp, Artificial Sequence
  Synthetic
atgtggactgctggtagtact

SEQ ID NO: 22439 - DNA, 21 bp, Artificial Sequence
  Synthetic
cgttatgcgggtgagtctgct

SEQ ID NO: 22440 - DNA, 21 bp, Artificial Sequence
  Synthetic
tatgggtcgttgtctgctctg

SEQ ID NO: 22441 - DNA, 21 bp, Artificial Sequence
  Synthetic
catgttaggctgggtagtagt

SEQ ID NO: 22442 - DNA, 21 bp, Artificial Sequence
  Synthetic
gatgctactgggcagtattgg

SEQ ID NO: 22443 - DNA, 21 bp, Artificial Sequence
  Synthetic
catccgtatgcgttgggggtg

SEQ ID NO: 22444 - DNA, 21 bp, Artificial Sequence
  Synthetic
agtgtggctgggtatagtcag

SEQ ID NO: 22445 - DNA, 21 bp, Artificial Sequence
  Synthetic
ttgttgtatggtggttctacg

SEQ ID NO: 22446 - DNA, 21 bp, Artificial Sequence
  Synthetic
gataatcatgcggggcgttgg

SEQ ID NO: 22447 - DNA, 21 bp, Artificial Sequence
  Synthetic
gatccttcgtggtcttctgcg

SEQ ID NO: 22448 - DNA, 21 bp, Artificial Sequence
  Synthetic
gagctgcctggttggagtgtg

SEQ ID NO: 22449 - DNA, 21 bp, Artificial Sequence
  Synthetic
tgggttgatctgccgagtgtg

SEQ ID NO: 22450 - DNA, 21 bp, Artificial Sequence
  Synthetic
ctggggtatacttttgctgat

SEQ ID NO: 22451 - DNA, 21 bp, Artificial Sequence
  Synthetic
gttcagcctgtttggtcgtcg

SEQ ID NO: 22452 - DNA, 21 bp, Artificial Sequence
  Synthetic
caggttagttctcagcattgg

SEQ ID NO: 22453 - DNA, 21 bp, Artificial Sequence
  Synthetic
gcttgggggtctctgggtgtt

SEQ ID NO: 22454 - DNA, 21 bp, Artificial Sequence
  Synthetic
ggtattaatgctggggtgtgg

SEQ ID NO: 22455 - DNA, 21 bp, Artificial Sequence
  Synthetic
gcgaattatatgggttcgatg

SEQ ID NO: 22456 - DNA, 21 bp, Artificial Sequence
  Synthetic
gataggtggcagggggcggtt

SEQ ID NO: 22457 - DNA, 21 bp, Artificial Sequence
  Synthetic
gagcgggatagtgggcgttgg

SEQ ID NO: 22458 - DNA, 21 bp, Artificial Sequence
  Synthetic
ctttctccgggtatgtcgcag

SEQ ID NO: 22459 - DNA, 21 bp, Artificial Sequence
  Synthetic
catctgaatttttattctgat

SEQ ID NO: 22460 - DNA, 21 bp, Artificial Sequence
  Synthetic
aggtcgccgggttattcgcag

SEQ ID NO: 22461 - DNA, 21 bp, Artificial Sequence
  Synthetic
tgggggacgtatacgtctctt

SEQ ID NO: 22462 - DNA, 21 bp, Artificial Sequence
  Synthetic
gctagggagtggggttcggct

SEQ ID NO: 22463 - DNA, 21 bp, Artificial Sequence
  Synthetic
ctggagacttatgggagtagt

SEQ ID NO: 22464 - DNA, 21 bp, Artificial Sequence
  Synthetic
tgttatcctgcgggtgagtgt

SEQ ID NO: 22465 - DNA, 21 bp, Artificial Sequence
  Synthetic
actcggactgggatggctcag

SEQ ID NO: 22466 - DNA, 21 bp, Artificial Sequence
  Synthetic
gcttctctgggtactgtttat

SEQ ID NO: 22467 - DNA, 21 bp, Artificial Sequence
  Synthetic
cgggcgtatagtcttgaggtt

SEQ ID NO: 22468 - DNA, 21 bp, Artificial Sequence
  Synthetic
tggagtacttttagtgtgggt

SEQ ID NO: 22469 - DNA, 21 bp, Artificial Sequence
  Synthetic
tttatttattcggggagtagt

SEQ ID NO: 22470 - DNA, 21 bp, Artificial Sequence
  Synthetic
tgggggagtcctcctcatgcg

SEQ ID NO: 22471 - DNA, 21 bp, Artificial Sequence
  Synthetic
gggaagcagttgggtgcgtgg

SEQ ID NO: 22472 - DNA, 21 bp, Artificial Sequence
  Synthetic
gggcctggggagtcgcgttgg

SEQ ID NO: 22473 - DNA, 21 bp, Artificial Sequence
  Synthetic
actctttatatggggagtagt

SEQ ID NO: 22474 - DNA, 21 bp, Artificial Sequence
  Synthetic
ttgggttatacttttcaggcg

SEQ ID NO: 22475 - DNA, 21 bp, Artificial Sequence
  Synthetic
gatcgtgttgggtatggttat

SEQ ID NO: 22476 - DNA, 21 bp, Artificial Sequence
  Synthetic
ctgtgggggtcgacgggtgcg

SEQ ID NO: 22477 - DNA, 21 bp, Artificial Sequence
  Synthetic
atgttgccgaattggagtcag

SEQ ID NO: 22478 - DNA, 21 bp, Artificial Sequence
  Synthetic
tttattccggggttttctcag

SEQ ID NO: 22479 - DNA, 21 bp, Artificial Sequence
  Synthetic
ttgtttggtgggtattcgacg

SEQ ID NO: 22480 - DNA, 21 bp, Artificial Sequence
  Synthetic
tggcatagtcttacgactgct

SEQ ID NO: 22481 - DNA, 21 bp, Artificial Sequence
  Synthetic
atgattaatgagggtcgttgg

SEQ ID NO: 22482 - DNA, 21 bp, Artificial Sequence
  Synthetic
ctggtgattgggcaggggtgg

SEQ ID NO: 22483 - DNA, 21 bp, Artificial Sequence
  Synthetic
tgggtgcttgagcaggggtat

SEQ ID NO: 22484 - DNA, 21 bp, Artificial Sequence
  Synthetic
ttgattgggcgtcttatgggg

SEQ ID NO: 22485 - DNA, 21 bp, Artificial Sequence
  Synthetic
gttggggttgggactatttat

SEQ ID NO: 22486 - DNA, 21 bp, Artificial Sequence
  Synthetic
tggcgggagtatcctgagagg

SEQ ID NO: 22487 - DNA, 21 bp, Artificial Sequence
  Synthetic
gttgatctgagtgctcggtat

SEQ ID NO: 22488 - DNA, 21 bp, Artificial Sequence
  Synthetic
gttgattatcgtatggcttat

SEQ ID NO: 22489 - DNA, 21 bp, Artificial Sequence
  Synthetic
ctgcgttgggagggtgcgact

SEQ ID NO: 22490 - DNA, 21 bp, Artificial Sequence
  Synthetic
ggtattgattctgctcgtttt

SEQ ID NO: 22491 - DNA, 21 bp, Artificial Sequence
  Synthetic
cctccgtatggttcgtttgat

SEQ ID NO: 22492 - DNA, 21 bp, Artificial Sequence
  Synthetic
gcggaggttgggagggtgtat

SEQ ID NO: 22493 - DNA, 21 bp, Artificial Sequence
  Synthetic
tggatgttgggtggttcgacg

SEQ ID NO: 22494 - DNA, 21 bp, Artificial Sequence
  Synthetic
ttggtgcctgggatgtcgagt

SEQ ID NO: 22495 - DNA, 21 bp, Artificial Sequence
  Synthetic
gtgacggatagggtgctttgg

SEQ ID NO: 22496 - DNA, 21 bp, Artificial Sequence
  Synthetic
aaggttccttatgctttggcg

SEQ ID NO: 22497 - DNA, 21 bp, Artificial Sequence
  Synthetic
ttttattatggtgggtcgagt

SEQ ID NO: 22498 - DNA, 21 bp, Artificial Sequence
  Synthetic
gattttactagggggtctacg

SEQ ID NO: 22499 - DNA, 21 bp, Artificial Sequence
  Synthetic
gattgggctcggggggctgct

SEQ ID NO: 22500 - DNA, 21 bp, Artificial Sequence
  Synthetic
tatcagcatttgggttcttat

SEQ ID NO: 22501 - DNA, 21 bp, Artificial Sequence
  Synthetic
gatcgtcattatggtgcgtct

SEQ ID NO: 22502 - DNA, 21 bp, Artificial Sequence
  Synthetic
ccgtctctgggtggtcattgg

SEQ ID NO: 22503 - DNA, 21 bp, Artificial Sequence
  Synthetic
gatgttccggggcttaggtgg

SEQ ID NO: 22504 - DNA, 21 bp, Artificial Sequence
  Synthetic
ttgtatgcgggtaggagtcag

SEQ ID NO: 22505 - DNA, 21 bp, Artificial Sequence
  Synthetic
tggggtagtctggctcagatg

SEQ ID NO: 22506 - DNA, 21 bp, Artificial Sequence
  Synthetic
gttcgtgatgggtggagttct

SEQ ID NO: 22507 - DNA, 21 bp, Artificial Sequence
  Synthetic
catgtgggtgatggtcggtgg

SEQ ID NO: 22508 - DNA, 21 bp, Artificial Sequence
  Synthetic
gtgcgtgttggtcaggctcag

SEQ ID NO: 22509 - DNA, 21 bp, Artificial Sequence
  Synthetic
ccgtatccggggtatgctagt

SEQ ID NO: 22510 - DNA, 21 bp, Artificial Sequence
  Synthetic
acggagtataggggtgctact

SEQ ID NO: 22511 - DNA, 21 bp, Artificial Sequence
  Synthetic
tgggggatgcttgctagtggg

SEQ ID NO: 22512 - DNA, 21 bp, Artificial Sequence
  Synthetic
actaaggcgtatgaggctagt

SEQ ID NO: 22513 - DNA, 21 bp, Artificial Sequence
  Synthetic
cagggtgattcgcggtggaat

SEQ ID NO: 22514 - DNA, 21 bp, Artificial Sequence
  Synthetic
cgggttggttatgattatatg

SEQ ID NO: 22515 - DNA, 21 bp, Artificial Sequence
  Synthetic
agggttattggtgaggctcag

SEQ ID NO: 22516 - DNA, 21 bp, Artificial Sequence
  Synthetic
cagcattgggcgggtagtagt

SEQ ID NO: 22517 - DNA, 21 bp, Artificial Sequence
  Synthetic
agggagtggagtgttgggttg

SEQ ID NO: 22518 - DNA, 21 bp, Artificial Sequence
  Synthetic
tttgatgagaggtattgggcg

SEQ ID NO: 22519 - DNA, 21 bp, Artificial Sequence
  Synthetic
atggatcgtgggttttcttct

SEQ ID NO: 22520 - DNA, 21 bp, Artificial Sequence
  Synthetic
caggcggcgaattgggctagt

SEQ ID NO: 22521 - DNA, 21 bp, Artificial Sequence
  Synthetic
ctggtgggtaggttgatgggg

SEQ ID NO: 22522 - DNA, 21 bp, Artificial Sequence
  Synthetic
tgggtttatcctgatgggggt

SEQ ID NO: 22523 - DNA, 21 bp, Artificial Sequence
  Synthetic
ctgtggagtggtgatcggtcg

SEQ ID NO: 22524 - DNA, 21 bp, Artificial Sequence
  Synthetic
atgtattctcttggtggtcct

SEQ ID NO: 22525 - DNA, 21 bp, Artificial Sequence
  Synthetic
ctgtcgattgggtggagtcag

SEQ ID NO: 22526 - DNA, 21 bp, Artificial Sequence
  Synthetic
gagagtccggggtatcgttgg

SEQ ID NO: 22527 - DNA, 21 bp, Artificial Sequence
  Synthetic
ggtattgatcatgcgaggttt

SEQ ID NO: 22528 - DNA, 21 bp, Artificial Sequence
  Synthetic
attcagtgggcgggtagtact

SEQ ID NO: 22529 - DNA, 21 bp, Artificial Sequence
  Synthetic
tggcgtccttctgatggttat

SEQ ID NO: 22530 - DNA, 21 bp, Artificial Sequence
  Synthetic
aggggtccgggtctgtcgatg

SEQ ID NO: 22531 - DNA, 21 bp, Artificial Sequence
  Synthetic
tctaggctgcttatgagttct

SEQ ID NO: 22532 - DNA, 21 bp, Artificial Sequence
  Synthetic
tctaggtttgataatcgtaat

SEQ ID NO: 22533 - DNA, 21 bp, Artificial Sequence
  Synthetic
tgggtgcatgagggttctaag

SEQ ID NO: 22534 - DNA, 21 bp, Artificial Sequence
  Synthetic
gagcattttcatgggagtgct

SEQ ID NO: 22535 - DNA, 21 bp, Artificial Sequence
  Synthetic
ggggagacggtggggaggtgg

SEQ ID NO: 22536 - DNA, 21 bp, Artificial Sequence
  Synthetic
agtagggcggggtatgcgact

SEQ ID NO: 22537 - DNA, 21 bp, Artificial Sequence
  Synthetic
atgtatccgcttgggagtgcg

SEQ ID NO: 22538 - DNA, 21 bp, Artificial Sequence
  Synthetic
ggtgttgtgaggttgatgaat

SEQ ID NO: 22539 - DNA, 21 bp, Artificial Sequence
  Synthetic
gctcaggttggttggtcggct

SEQ ID NO: 22540 - DNA, 21 bp, Artificial Sequence
  Synthetic
tcggcttgggggatggcgcag

SEQ ID NO: 22541 - DNA, 21 bp, Artificial Sequence
  Synthetic
gcgtggccggctgggtctagt

SEQ ID NO: 22542 - DNA, 21 bp, Artificial Sequence
  Synthetic
ttgtggcctggtgagtcgacg

SEQ ID NO: 22543 - DNA, 21 bp, Artificial Sequence
  Synthetic
gcgcttcatgggtggacgaat

SEQ ID NO: 22544 - DNA, 21 bp, Artificial Sequence
  Synthetic
aggcatgtgggggatagtagt

SEQ ID NO: 22545 - DNA, 21 bp, Artificial Sequence
  Synthetic
ctgttggcttttgggagtgct

SEQ ID NO: 22546 - DNA, 21 bp, Artificial Sequence
  Synthetic
gttactcgtgggtattcgatg

SEQ ID NO: 22547 - DNA, 21 bp, Artificial Sequence
  Synthetic
tggacgctgggggaggggcat

SEQ ID NO: 22548 - DNA, 21 bp, Artificial Sequence
  Synthetic
tgggggatgctggagagggtt

SEQ ID NO: 22549 - DNA, 21 bp, Artificial Sequence
  Synthetic
gctgagccgtggcttagttct

SEQ ID NO: 22550 - DNA, 21 bp, Artificial Sequence
  Synthetic
aggtatatgcctcagcctgat

SEQ ID NO: 22551 - DNA, 21 bp, Artificial Sequence
  Synthetic
gtgcagtttcagggtagtagt

SEQ ID NO: 22552 - DNA, 21 bp, Artificial Sequence
  Synthetic
tatgcgtcgtatgggtcgatg

SEQ ID NO: 22553 - DNA, 21 bp, Artificial Sequence
  Synthetic
ccggggtcgccggggaggtgg

SEQ ID NO: 22554 - DNA, 21 bp, Artificial Sequence
  Synthetic
agtatgcgtggttatgcgagt

SEQ ID NO: 22555 - DNA, 21 bp, Artificial Sequence
  Synthetic
cctccggttattatgcgtaat

SEQ ID NO: 22556 - DNA, 21 bp, Artificial Sequence
  Synthetic
gtgggggctcctggggcgtgg

SEQ ID NO: 22557 - DNA, 21 bp, Artificial Sequence
  Synthetic
tggggggttgggtcggggtat

SEQ ID NO: 22558 - DNA, 21 bp, Artificial Sequence
  Synthetic
attctgaggggttatgatatt

SEQ ID NO: 22559 - DNA, 21 bp, Artificial Sequence
  Synthetic
tggattctgaaggataaggtt

SEQ ID NO: 22560 - DNA, 21 bp, Artificial Sequence
  Synthetic
acgtttctgaatgggagtcag

SEQ ID NO: 22561 - DNA, 21 bp, Artificial Sequence
  Synthetic
atggatcagaggcattgggcg

SEQ ID NO: 22562 - DNA, 21 bp, Artificial Sequence
  Synthetic
cagtatgtgcctcatccgagt

SEQ ID NO: 22563 - DNA, 21 bp, Artificial Sequence
  Synthetic
aagggtccgcatgatttttat

SEQ ID NO: 22564 - DNA, 21 bp, Artificial Sequence
  Synthetic
gtggggaattggtatagggat

SEQ ID NO: 22565 - DNA, 21 bp, Artificial Sequence
  Synthetic
gctcgtattgttttgacgaat

SEQ ID NO: 22566 - DNA, 21 bp, Artificial Sequence
  Synthetic
ctgcttcctggttatagtgct

SEQ ID NO: 22567 - DNA, 21 bp, Artificial Sequence
  Synthetic
agttttaatactggtgtttgg

SEQ ID NO: 22568 - DNA, 21 bp, Artificial Sequence
  Synthetic
gttgtgcggcctcagggttgg

SEQ ID NO: 22569 - DNA, 21 bp, Artificial Sequence
  Synthetic
cgggtgcctggttatagtatg

SEQ ID NO: 22570 - DNA, 21 bp, Artificial Sequence
  Synthetic
ccggagtgggggggtctttct

SEQ ID NO: 22571 - DNA, 21 bp, Artificial Sequence
  Synthetic
actgtgcatggttatagtacg

SEQ ID NO: 22572 - DNA, 21 bp, Artificial Sequence
  Synthetic
cgttgggagggttttagtcag

SEQ ID NO: 22573 - DNA, 21 bp, Artificial Sequence
  Synthetic
acgtatccgggtcgttctatt

SEQ ID NO: 22574 - DNA, 21 bp, Artificial Sequence
  Synthetic
tcgaagccgggttattctatg

SEQ ID NO: 22575 - DNA, 21 bp, Artificial Sequence
  Synthetic
ctggctagtcattttagtgtt

SEQ ID NO: 22576 - DNA, 21 bp, Artificial Sequence
  Synthetic
tcttataagccggctgcgagt

SEQ ID NO: 22577 - DNA, 21 bp, Artificial Sequence
  Synthetic
tggtctgttcatgggagtgcg

SEQ ID NO: 22578 - DNA, 21 bp, Artificial Sequence
  Synthetic
ggggatcttgctgggcgttgg

SEQ ID NO: 22579 - DNA, 21 bp, Artificial Sequence
  Synthetic
agttgggctgcgggtgctagt

SEQ ID NO: 22580 - DNA, 21 bp, Artificial Sequence
  Synthetic
gtggctgttggtatgcattgg

SEQ ID NO: 22581 - DNA, 21 bp, Artificial Sequence
  Synthetic
tgggcggtgaatgggtcttcg

SEQ ID NO: 22582 - DNA, 21 bp, Artificial Sequence
  Synthetic
aagagtgagtttattacttgg

SEQ ID NO: 22583 - DNA, 21 bp, Artificial Sequence
  Synthetic
gtgctgtataatggtagtatg

SEQ ID NO: 22584 - DNA, 21 bp, Artificial Sequence
  Synthetic
tggcgtcctcttggggcgagt

SEQ ID NO: 22585 - DNA, 21 bp, Artificial Sequence
  Synthetic
ctgaggtatgcgggttcgact

SEQ ID NO: 22586 - DNA, 21 bp, Artificial Sequence
  Synthetic
cgttggaatgctgatcttctg

SEQ ID NO: 22587 - DNA, 21 bp, Artificial Sequence
  Synthetic
ggtggggatccggggaggtgg

SEQ ID NO: 22588 - DNA, 21 bp, Artificial Sequence
  Synthetic
acggtgacgggttttagtcag

SEQ ID NO: 22589 - DNA, 21 bp, Artificial Sequence
  Synthetic
aggctgcctggtatgtcgcag

SEQ ID NO: 22590 - DNA, 21 bp, Artificial Sequence
  Synthetic
actttggataggtatcatacg

SEQ ID NO: 22591 - DNA, 21 bp, Artificial Sequence
  Synthetic
gttagtaattatgcgggttgg

SEQ ID NO: 22592 - DNA, 21 bp, Artificial Sequence
  Synthetic
catcctgtttataattcgtcg

SEQ ID NO: 22593 - DNA, 21 bp, Artificial Sequence
  Synthetic
cagtgggctggtgcttctcag

SEQ ID NO: 22594 - DNA, 21 bp, Artificial Sequence
  Synthetic
cggtctgcggggttttcttct

SEQ ID NO: 22595 - DNA, 21 bp, Artificial Sequence
  Synthetic
attttggtgggttatcagaag

SEQ ID NO: 22596 - DNA, 21 bp, Artificial Sequence
  Synthetic
ttgtgggtttcgagttcttct

SEQ ID NO: 22597 - DNA, 21 bp, Artificial Sequence
  Synthetic
atggttcggatggggtcgtct

SEQ ID NO: 22598 - DNA, 21 bp, Artificial Sequence
  Synthetic
gcggcgtttactcggtttgat

SEQ ID NO: 22599 - DNA, 21 bp, Artificial Sequence
  Synthetic
ggtgttgaggtggggcgttgg

SEQ ID NO: 22600 - DNA, 21 bp, Artificial Sequence
  Synthetic
gatgagaggtggattgctgct

SEQ ID NO: 22601 - DNA, 21 bp, Artificial Sequence
  Synthetic
gatgtgagggaggtgaggtgg

SEQ ID NO: 22602 - DNA, 21 bp, Artificial Sequence
  Synthetic
aaggctcctagtttttcttcg

SEQ ID NO: 22603 - DNA, 21 bp, Artificial Sequence
  Synthetic
ggggttgatctgggtatgtgg

SEQ ID NO: 22604 - DNA, 21 bp, Artificial Sequence
  Synthetic
gttcttcatgggtatactaat

SEQ ID NO: 22605 - DNA, 21 bp, Artificial Sequence
  Synthetic
aggtatgtgcatgagattgct

SEQ ID NO: 22606 - DNA, 21 bp, Artificial Sequence
  Synthetic
aagatggatcatggttattgg

SEQ ID NO: 22607 - DNA, 21 bp, Artificial Sequence
  Synthetic
cgggagcattattctgattgg

SEQ ID NO: 22608 - DNA, 21 bp, Artificial Sequence
  Synthetic
gctgtgcctacgggtctgtgg

SEQ ID NO: 22609 - DNA, 21 bp, Artificial Sequence
  Synthetic
tttggggttcttaatgggatt

SEQ ID NO: 22610 - DNA, 21 bp, Artificial Sequence
  Synthetic
gatgataggacggggaggtgg

SEQ ID NO: 22611 - DNA, 21 bp, Artificial Sequence
  Synthetic
agtagggtgattttgtttgat

SEQ ID NO: 22612 - DNA, 21 bp, Artificial Sequence
  Synthetic
gggccggggtattcgagtact

SEQ ID NO: 22613 - DNA, 21 bp, Artificial Sequence
  Synthetic
gtttttccttttcctaatgtt

SEQ ID NO: 22614 - DNA, 21 bp, Artificial Sequence
  Synthetic
ggtcaggtgagttggtcgagt

SEQ ID NO: 22615 - DNA, 21 bp, Artificial Sequence
  Synthetic
agtactgcgaattggcatgtg

SEQ ID NO: 22616 - DNA, 21 bp, Artificial Sequence
  Synthetic
tcgtttcctggttggagtgcg

SEQ ID NO: 22617 - DNA, 21 bp, Artificial Sequence
  Synthetic
ctgttgcctaattgtaggttg

SEQ ID NO: 22618 - DNA, 21 bp, Artificial Sequence
  Synthetic
acgactcgttgggagtctagt

SEQ ID NO: 22619 - DNA, 21 bp, Artificial Sequence
  Synthetic
cgtgagtttgttttgcctact

SEQ ID NO: 22620 - DNA, 21 bp, Artificial Sequence
  Synthetic
cattatgttggggggtcgact

SEQ ID NO: 22621 - DNA, 21 bp, Artificial Sequence
  Synthetic
tctagtgaggtgcgttggaat

SEQ ID NO: 22622 - DNA, 21 bp, Artificial Sequence
  Synthetic
ttgcattatgctggtgctatg

SEQ ID NO: 22623 - DNA, 21 bp, Artificial Sequence
  Synthetic
aagtggcagaatgatatgtat

SEQ ID NO: 22624 - DNA, 21 bp, Artificial Sequence
  Synthetic
gaggtgtataagcgttatgat

SEQ ID NO: 22625 - DNA, 21 bp, Artificial Sequence
  Synthetic
catgcgtatcatggttctact

SEQ ID NO: 22626 - DNA, 21 bp, Artificial Sequence
  Synthetic
cttaagtatgggatgtcgtcg

SEQ ID NO: 22627 - DNA, 21 bp, Artificial Sequence
  Synthetic
cagtcgatgtctcagcattgg

SEQ ID NO: 22628 - DNA, 21 bp, Artificial Sequence
  Synthetic
cttatgtattctgggtctcag

SEQ ID NO: 22629 - DNA, 21 bp, Artificial Sequence
  Synthetic
gatgctcgttggcctgggagt

SEQ ID NO: 22630 - DNA, 21 bp, Artificial Sequence
  Synthetic
gtttattgggagggttctgct

SEQ ID NO: 22631 - DNA, 21 bp, Artificial Sequence
  Synthetic
cttgcgtatggtgctgctcag

SEQ ID NO: 22632 - DNA, 21 bp, Artificial Sequence
  Synthetic
ccgattagtttgtatggggcg

SEQ ID NO: 22633 - DNA, 21 bp, Artificial Sequence
  Synthetic
tgttatgggaatagttgtggg

SEQ ID NO: 22634 - DNA, 21 bp, Artificial Sequence
  Synthetic
cagagggtggttttggagcgt

SEQ ID NO: 22635 - DNA, 21 bp, Artificial Sequence
  Synthetic
tgggttcgtgagggggatcgg

SEQ ID NO: 22636 - DNA, 21 bp, Artificial Sequence
  Synthetic
tttcctactgataataggtgg

SEQ ID NO: 22637 - DNA, 21 bp, Artificial Sequence
  Synthetic
tttccgcgttttcatgctgat

SEQ ID NO: 22638 - DNA, 21 bp, Artificial Sequence
  Synthetic
tattatgatacgtataggcct

SEQ ID NO: 22639 - DNA, 21 bp, Artificial Sequence
  Synthetic
actgcgcggcttgggtcgacg

SEQ ID NO: 22640 - DNA, 21 bp, Artificial Sequence
  Synthetic
tggatgacttcggggtctgcg

SEQ ID NO: 22641 - DNA, 21 bp, Artificial Sequence
  Synthetic
agtaataggtatgaggcttcg

SEQ ID NO: 22642 - DNA, 21 bp, Artificial Sequence
  Synthetic
gaggctggtacgcatcgttgg

SEQ ID NO: 22643 - DNA, 21 bp, Artificial Sequence
  Synthetic
tattctctgagtcaggggttt

SEQ ID NO: 22644 - DNA, 21 bp, Artificial Sequence
  Synthetic
gagtgggatcatggtagttcg

SEQ ID NO: 22645 - DNA, 21 bp, Artificial Sequence
  Synthetic
gatgtgcggtggggggctgct

SEQ ID NO: 22646 - DNA, 21 bp, Artificial Sequence
  Synthetic
tggtcgctgccttctatgggt

SEQ ID NO: 22647 - DNA, 21 bp, Artificial Sequence
  Synthetic
gcgtatctgggggctgctcag

SEQ ID NO: 22648 - DNA, 21 bp, Artificial Sequence
  Synthetic
gagcatcgtggttctctgtgg

SEQ ID NO: 22649 - DNA, 21 bp, Artificial Sequence
  Synthetic
gagatgcgtccgggtgcttgg

SEQ ID NO: 22650 - DNA, 21 bp, Artificial Sequence
  Synthetic
catgttgtgaatcaggcgagg

SEQ ID NO: 22651 - DNA, 21 bp, Artificial Sequence
  Synthetic
tatgggatgctggggccgatg

SEQ ID NO: 22652 - DNA, 21 bp, Artificial Sequence
  Synthetic
aagtttgcgggtggtagtcag

SEQ ID NO: 22653 - DNA, 21 bp, Artificial Sequence
  Synthetic
gagtggcgttcgggttctgct

SEQ ID NO: 22654 - DNA, 21 bp, Artificial Sequence
  Synthetic
gatctgtatcatttgccgcat

SEQ ID NO: 22655 - DNA, 21 bp, Artificial Sequence
  Synthetic
actcgggattcggggtattgg

SEQ ID NO: 22656 - DNA, 21 bp, Artificial Sequence
  Synthetic
acgcggcttctggggagttct

SEQ ID NO: 22657 - DNA, 21 bp, Artificial Sequence
  Synthetic
tggagggatcaggggtcgact

SEQ ID NO: 22658 - DNA, 21 bp, Artificial Sequence
  Synthetic
gggactccttatctttcgagt

SEQ ID NO: 22659 - DNA, 21 bp, Artificial Sequence
  Synthetic
ggtttgattgggtggtctagt

SEQ ID NO: 22660 - DNA, 21 bp, Artificial Sequence
  Synthetic
tcgcctgattctggtcgttgg

SEQ ID NO: 22661 - DNA, 21 bp, Artificial Sequence
  Synthetic
atgctggttggtatggcgcag

SEQ ID NO: 22662 - DNA, 21 bp, Artificial Sequence
  Synthetic
tggttggctggttatcgggat

SEQ ID NO: 22663 - DNA, 21 bp, Artificial Sequence
  Synthetic
acgtttacgcttggtgcggcg

SEQ ID NO: 22664 - DNA, 21 bp, Artificial Sequence
  Synthetic
ctggggagtcctggtctttgg

SEQ ID NO: 22665 - DNA, 21 bp, Artificial Sequence
  Synthetic
agggagccgtggtcgtcgtct

SEQ ID NO: 22666 - DNA, 21 bp, Artificial Sequence
  Synthetic
agggagtattcgctggataag

SEQ ID NO: 22667 - DNA, 21 bp, Artificial Sequence
  Synthetic
gcgaagtatgcgttgccgact

SEQ ID NO: 22668 - DNA, 21 bp, Artificial Sequence
  Synthetic
tctggtgttggttggagttct

SEQ ID NO: 22669 - DNA, 21 bp, Artificial Sequence
  Synthetic
gagtataggggtgggtcgacg

SEQ ID NO: 22670 - DNA, 21 bp, Artificial Sequence
  Synthetic
ttgaggtttaatggggctatg

SEQ ID NO: 22671 - DNA, 21 bp, Artificial Sequence
  Synthetic
tcttcgaatcaggctcgttat

SEQ ID NO: 22672 - DNA, 21 bp, Artificial Sequence
  Synthetic
cagatgacgggttggtcgtct

SEQ ID NO: 22673 - DNA, 21 bp, Artificial Sequence
  Synthetic
tctattgctgatcggctttat

SEQ ID NO: 22674 - DNA, 21 bp, Artificial Sequence
  Synthetic
ctgattgagcatggttgggcg

SEQ ID NO: 22675 - DNA, 21 bp, Artificial Sequence
  Synthetic
gggcgtattatgcttaatcag

SEQ ID NO: 22676 - DNA, 21 bp, Artificial Sequence
  Synthetic
ccgcttcatagtgcttttcgt

SEQ ID NO: 22677 - DNA, 21 bp, Artificial Sequence
  Synthetic
ctgcagctgaattgggcgagt

SEQ ID NO: 22678 - DNA, 21 bp, Artificial Sequence
  Synthetic
aggtatactggtggttcgagt

SEQ ID NO: 22679 - DNA, 21 bp, Artificial Sequence
  Synthetic
gagtcttgggctggttcgtct

SEQ ID NO: 22680 - DNA, 21 bp, Artificial Sequence
  Synthetic
tctgtttatcatgggagttct

SEQ ID NO: 22681 - DNA, 21 bp, Artificial Sequence
  Synthetic
ttgaattattcgattgcgttg

SEQ ID NO: 22682 - DNA, 21 bp, Artificial Sequence
  Synthetic
ctgtatagtgctcatgcgtct

SEQ ID NO: 22683 - DNA, 21 bp, Artificial Sequence
  Synthetic
acttctcgtggttattcgatg

SEQ ID NO: 22684 - DNA, 21 bp, Artificial Sequence
  Synthetic
tgggttattgagggtgcgcgt

SEQ ID NO: 22685 - DNA, 21 bp, Artificial Sequence
  Synthetic
gagtatccgtttggttctagt

SEQ ID NO: 22686 - DNA, 21 bp, Artificial Sequence
  Synthetic
ttgaattctatgttttctgtg

SEQ ID NO: 22687 - DNA, 21 bp, Artificial Sequence
  Synthetic
ttgatttctcgggggagtact

SEQ ID NO: 22688 - DNA, 21 bp, Artificial Sequence
  Synthetic
actgtgttgcgtggtagtact

SEQ ID NO: 22689 - DNA, 21 bp, Artificial Sequence
  Synthetic
gcgaggcctggtttttcgagt

SEQ ID NO: 22690 - DNA, 21 bp, Artificial Sequence
  Synthetic
gagcctcagacggtgcgttgg

SEQ ID NO: 22691 - DNA, 21 bp, Artificial Sequence
  Synthetic
ccgcgtttggctggtgggtgg

SEQ ID NO: 22692 - DNA, 21 bp, Artificial Sequence
  Synthetic
ggtacgtttggggggtcttcg

SEQ ID NO: 22693 - DNA, 21 bp, Artificial Sequence
  Synthetic
tggacggttgggagtgtttat

SEQ ID NO: 22694 - DNA, 21 bp, Artificial Sequence
  Synthetic
catccggagtggatggcgtcg

SEQ ID NO: 22695 - DNA, 21 bp, Artificial Sequence
  Synthetic
gggtttcctgggtattcgtct

SEQ ID NO: 22696 - DNA, 21 bp, Artificial Sequence
  Synthetic
tcgctggtggggaataggtgg

SEQ ID NO: 22697 - DNA, 21 bp, Artificial Sequence
  Synthetic
acgctgtatcttggtgctagt

SEQ ID NO: 22698 - DNA, 21 bp, Artificial Sequence
  Synthetic
tatgttaggggtacttgggat

SEQ ID NO: 22699 - DNA, 21 bp, Artificial Sequence
  Synthetic
tatggggctctggctgggttg

SEQ ID NO: 22700 - DNA, 21 bp, Artificial Sequence
  Synthetic
agtgtgtatctggggtcggtt

SEQ ID NO: 22701 - DNA, 21 bp, Artificial Sequence
  Synthetic
cgttggccggctgaggctagt

SEQ ID NO: 22702 - DNA, 21 bp, Artificial Sequence
  Synthetic
gttattcctttgggtagtacg

SEQ ID NO: 22703 - DNA, 21 bp, Artificial Sequence
  Synthetic
aggctgagtgggtattctcag

SEQ ID NO: 22704 - DNA, 21 bp, Artificial Sequence
  Synthetic
acttatgtgccgagtggtcat

SEQ ID NO: 22705 - DNA, 21 bp, Artificial Sequence
  Synthetic
tatatgctgcctgggcgtggt

SEQ ID NO: 22706 - DNA, 21 bp, Artificial Sequence
  Synthetic
ctttcttatagtactggtttg

SEQ ID NO: 22707 - DNA, 21 bp, Artificial Sequence
  Synthetic
cgtcgtgagcttggttatggt

SEQ ID NO: 22708 - DNA, 21 bp, Artificial Sequence
  Synthetic
aatgggactgaggggcgttgg

SEQ ID NO: 22709 - DNA, 21 bp, Artificial Sequence
  Synthetic
gatattgggactaggtattat

SEQ ID NO: 22710 - DNA, 21 bp, Artificial Sequence
  Synthetic
tgggggactctggctgcgcat

SEQ ID NO: 22711 - DNA, 21 bp, Artificial Sequence
  Synthetic
caggcggctggttgggcttct

SEQ ID NO: 22712 - DNA, 21 bp, Artificial Sequence
  Synthetic
ttgtggacgcatggggcggct

SEQ ID NO: 22713 - DNA, 21 bp, Artificial Sequence
  Synthetic
tgggctgtggataatgggttt

SEQ ID NO: 22714 - DNA, 21 bp, Artificial Sequence
  Synthetic
gaggctattggttgggcgtcg

SEQ ID NO: 22715 - DNA, 21 bp, Artificial Sequence
  Synthetic
cttgagaggaattgggcttct

SEQ ID NO: 22716 - DNA, 21 bp, Artificial Sequence
  Synthetic
ttgtattatggggcggctagt

SEQ ID NO: 22717 - DNA, 21 bp, Artificial Sequence
  Synthetic
cggaggttgggtgatgcggct

SEQ ID NO: 22718 - DNA, 21 bp, Artificial Sequence
  Synthetic
cttgtgcctcatggttggaat

SEQ ID NO: 22719 - DNA, 21 bp, Artificial Sequence
  Synthetic
tggatgcctggtgggtcgacg

SEQ ID NO: 22720 - DNA, 21 bp, Artificial Sequence
  Synthetic
tggggggcgccgttgcatagt

SEQ ID NO: 22721 - DNA, 21 bp, Artificial Sequence
  Synthetic
acgaatcagatggttgcggtg

SEQ ID NO: 22722 - DNA, 21 bp, Artificial Sequence
  Synthetic
gctaggccgggtcagagtcag

SEQ ID NO: 22723 - DNA, 21 bp, Artificial Sequence
  Synthetic
cgttttcgtccggatcctggg

SEQ ID NO: 22724 - DNA, 21 bp, Artificial Sequence
  Synthetic
tggtctgttggtgggagtacg

SEQ ID NO: 22725 - DNA, 21 bp, Artificial Sequence
  Synthetic
gtttttgatttgaggctgtcg

SEQ ID NO: 22726 - DNA, 21 bp, Artificial Sequence
  Synthetic
ctgatgcatgggcgggcgcag

SEQ ID NO: 22727 - DNA, 21 bp, Artificial Sequence
  Synthetic
ccgcttaatgctggtatgtgg

SEQ ID NO: 22728 - DNA, 21 bp, Artificial Sequence
  Synthetic
gttcctaagtggtcgttggat

SEQ ID NO: 22729 - DNA, 21 bp, Artificial Sequence
  Synthetic
ctgtatcctgggatggctact

SEQ ID NO: 22730 - DNA, 21 bp, Artificial Sequence
  Synthetic
cctaattcgtcgggtatttgg

SEQ ID NO: 22731 - DNA, 21 bp, Artificial Sequence
  Synthetic
gttgtgtggggggaggcgcag

SEQ ID NO: 22732 - DNA, 21 bp, Artificial Sequence
  Synthetic
aagagtcctggtatgagttgg

SEQ ID NO: 22733 - DNA, 21 bp, Artificial Sequence
  Synthetic
gagggtccttcgcgttggtcg

SEQ ID NO: 22734 - DNA, 21 bp, Artificial Sequence
  Synthetic
ttgacgaagggttctgtgtat

SEQ ID NO: 22735 - DNA, 21 bp, Artificial Sequence
  Synthetic
tttgatattgggccgaatgct

SEQ ID NO: 22736 - DNA, 21 bp, Artificial Sequence
  Synthetic
tcgtttcggccggctcctgcg

SEQ ID NO: 22737 - DNA, 21 bp, Artificial Sequence
  Synthetic
gaggctccgtgggagtctcag

SEQ ID NO: 22738 - DNA, 21 bp, Artificial Sequence
  Synthetic
actgctcgtttgggttcgacg

SEQ ID NO: 22739 - DNA, 21 bp, Artificial Sequence
  Synthetic
tctcttcggtgggaggcgtcg

SEQ ID NO: 22740 - DNA, 21 bp, Artificial Sequence
  Synthetic
cgggttgagatggggtttagt

SEQ ID NO: 22741 - DNA, 21 bp, Artificial Sequence
  Synthetic
gagaggtatcatgggtctcag

SEQ ID NO: 22742 - DNA, 21 bp, Artificial Sequence
  Synthetic
gtgcctgggtggggtagttcg

SEQ ID NO: 22743 - DNA, 21 bp, Artificial Sequence
  Synthetic
aggtatccggcggaggcgatg

SEQ ID NO: 22744 - DNA, 21 bp, Artificial Sequence
  Synthetic
aagtctattgggactatttat

SEQ ID NO: 22745 - DNA, 21 bp, Artificial Sequence
  Synthetic
gggagttatactaatagttgg

SEQ ID NO: 22746 - DNA, 21 bp, Artificial Sequence
  Synthetic
gcgacgcagtgggatagggtt

SEQ ID NO: 22747 - DNA, 21 bp, Artificial Sequence
  Synthetic
gcgcggaatggtagtgtttat

SEQ ID NO: 22748 - DNA, 21 bp, Artificial Sequence
  Synthetic
ggttttgcttatggttcgagt

SEQ ID NO: 22749 - DNA, 21 bp, Artificial Sequence
  Synthetic
agttttattcatggtagtagt

SEQ ID NO: 22750 - DNA, 21 bp, Artificial Sequence
  Synthetic
agtgagagggggagttggaat

SEQ ID NO: 22751 - DNA, 21 bp, Artificial Sequence
  Synthetic
ggtttggatcgtgggcattgg

SEQ ID NO: 22752 - DNA, 21 bp, Artificial Sequence
  Synthetic
gttctgtatctggggagtgcg

SEQ ID NO: 22753 - DNA, 21 bp, Artificial Sequence
  Synthetic
atggagcggtttggttctgct

SEQ ID NO: 22754 - DNA, 21 bp, Artificial Sequence
  Synthetic
acgtatgctgggtattcggct

SEQ ID NO: 22755 - DNA, 21 bp, Artificial Sequence
  Synthetic
cgttatcctgctgaggcgact

SEQ ID NO: 22756 - DNA, 21 bp, Artificial Sequence
  Synthetic
actgcgacgagggggtctacg

SEQ ID NO: 22757 - DNA, 21 bp, Artificial Sequence
  Synthetic
cctcaggttcataatcagtgg

SEQ ID NO: 22758 - DNA, 21 bp, Artificial Sequence
  Synthetic
gattatgtggggcaggctagt

SEQ ID NO: 22759 - DNA, 21 bp, Artificial Sequence
  Synthetic
ctggatcgggggttttcttcg

SEQ ID NO: 22760 - DNA, 21 bp, Artificial Sequence
  Synthetic
catgggaatcctggtatttgg

SEQ ID NO: 22761 - DNA, 21 bp, Artificial Sequence
  Synthetic
caggcgatgcatatgtcgtgg

SEQ ID NO: 22762 - DNA, 21 bp, Artificial Sequence
  Synthetic
agttcgcctgggtttagttcg

SEQ ID NO: 22763 - DNA, 21 bp, Artificial Sequence
  Synthetic
atttatgcgggttatacggtt

SEQ ID NO: 22764 - DNA, 21 bp, Artificial Sequence
  Synthetic
gggtcgaatttgggtgcgtgg

SEQ ID NO: 22765 - DNA, 21 bp, Artificial Sequence
  Synthetic
tctgtttttcatgggtcggcg

SEQ ID NO: 22766 - DNA, 21 bp, Artificial Sequence
  Synthetic
gagaagccttatactaattgg

SEQ ID NO: 22767 - DNA, 21 bp, Artificial Sequence
  Synthetic
tggttggattttacgtatggt

SEQ ID NO: 22768 - DNA, 21 bp, Artificial Sequence
  Synthetic
ttttcgagttgggcgactggg

SEQ ID NO: 22769 - DNA, 21 bp, Artificial Sequence
  Synthetic
agttatattgggggggctcag

SEQ ID NO: 22770 - DNA, 21 bp, Artificial Sequence
  Synthetic
ggtgatggggctcgttggaat

SEQ ID NO: 22771 - DNA, 21 bp, Artificial Sequence
  Synthetic
aagatgcctgggtggtctact

SEQ ID NO: 22772 - DNA, 21 bp, Artificial Sequence
  Synthetic
ccggcgccgtattctagttct

SEQ ID NO: 22773 - DNA, 21 bp, Artificial Sequence
  Synthetic
gttgcgaggggttatagtatg

SEQ ID NO: 22774 - DNA, 21 bp, Artificial Sequence
  Synthetic
tttagtcttgattctaggccg

SEQ ID NO: 22775 - DNA, 21 bp, Artificial Sequence
  Synthetic
tatgctacttatggttcgacg

SEQ ID NO: 22776 - DNA, 21 bp, Artificial Sequence
  Synthetic
ggtcatcctacgtggtcttcg

SEQ ID NO: 22777 - DNA, 21 bp, Artificial Sequence
  Synthetic
cgtagttttggtttggcgcag

SEQ ID NO: 22778 - DNA, 21 bp, Artificial Sequence
  Synthetic
gcgctgtctaggtatgatatt

SEQ ID NO: 22779 - DNA, 21 bp, Artificial Sequence
  Synthetic
gcgggtgttggttttagttcg

SEQ ID NO: 22780 - DNA, 21 bp, Artificial Sequence
  Synthetic
gcggttaggggtttttcttcg

SEQ ID NO: 22781 - DNA, 21 bp, Artificial Sequence
  Synthetic
atgtctaatgaggggaggtgg

SEQ ID NO: 22782 - DNA, 21 bp, Artificial Sequence
  Synthetic
cttagtggtcgtgagtggacg

SEQ ID NO: 22783 - DNA, 21 bp, Artificial Sequence
  Synthetic
cagcattatcttggtagttct

SEQ ID NO: 22784 - DNA, 21 bp, Artificial Sequence
  Synthetic
tgtcgtgagtggggtgcggcg

SEQ ID NO: 22785 - DNA, 21 bp, Artificial Sequence
  Synthetic
gatgcttcgtcgaatcgttgg

SEQ ID NO: 22786 - DNA, 21 bp, Artificial Sequence
  Synthetic
atgattgcgaattttagtgcg

SEQ ID NO: 22787 - DNA, 21 bp, Artificial Sequence
  Synthetic
atgctgagtgggtattcgatg

SEQ ID NO: 22788 - DNA, 21 bp, Artificial Sequence
  Synthetic
tggagggttacggatggtttt

SEQ ID NO: 22789 - DNA, 21 bp, Artificial Sequence
  Synthetic
tggtcgatgaatggttctatg

SEQ ID NO: 22790 - DNA, 21 bp, Artificial Sequence
  Synthetic
ggttttgatgctgtgaggtgg

SEQ ID NO: 22791 - DNA, 21 bp, Artificial Sequence
  Synthetic
tggtcgctgggtgagggttat

SEQ ID NO: 22792 - DNA, 21 bp, Artificial Sequence
  Synthetic
ccggctaatagggctattttt

SEQ ID NO: 22793 - DNA, 21 bp, Artificial Sequence
  Synthetic
cgtcagtttgagcttccggtg

SEQ ID NO: 22794 - DNA, 21 bp, Artificial Sequence
  Synthetic
gcgtggagtcatggtagtacg

SEQ ID NO: 22795 - DNA, 21 bp, Artificial Sequence
  Synthetic
gagaggtatcagggttctcat

SEQ ID NO: 22796 - DNA, 21 bp, Artificial Sequence
  Synthetic
gattggagggggtattctagt

SEQ ID NO: 22797 - DNA, 21 bp, Artificial Sequence
  Synthetic
cgtcatactggtgatgctgct

SEQ ID NO: 22798 - DNA, 21 bp, Artificial Sequence
  Synthetic
gtgaggagtatggggagtagt

SEQ ID NO: 22799 - DNA, 21 bp, Artificial Sequence
  Synthetic
ctttttccttctggttcgacg

SEQ ID NO: 22800 - DNA, 21 bp, Artificial Sequence
  Synthetic
ctttatcatggttctagtcat

SEQ ID NO: 22801 - DNA, 21 bp, Artificial Sequence
  Synthetic
ctgggtccgcattggagtacg

SEQ ID NO: 22802 - DNA, 21 bp, Artificial Sequence
  Synthetic
ttgtattctgagtttcattat

SEQ ID NO: 22803 - DNA, 21 bp, Artificial Sequence
  Synthetic
ctggtgtcgtatgggagtagt

SEQ ID NO: 22804 - DNA, 21 bp, Artificial Sequence
  Synthetic
agtccgtatagtggttttcat

SEQ ID NO: 22805 - DNA, 21 bp, Artificial Sequence
  Synthetic
agtcgtccgatgggttcttct

SEQ ID NO: 22806 - DNA, 21 bp, Artificial Sequence
  Synthetic
gctaatgtgttggctggttgg

SEQ ID NO: 22807 - DNA, 21 bp, Artificial Sequence
  Synthetic
catggtcagccgggtgtttgg

SEQ ID NO: 22808 - DNA, 21 bp, Artificial Sequence
  Synthetic
atgtttcttgcggggagtacg

SEQ ID NO: 22809 - DNA, 21 bp, Artificial Sequence
  Synthetic
ggtggggggttgaggtgggat

SEQ ID NO: 22810 - DNA, 21 bp, Artificial Sequence
  Synthetic
gagcttgtgggtcatgggtgg

SEQ ID NO: 22811 - DNA, 21 bp, Artificial Sequence
  Synthetic
atttatcatggtagttcgact

SEQ ID NO: 22812 - DNA, 21 bp, Artificial Sequence
  Synthetic
tctatgacgagtagtatgtgg

SEQ ID NO: 22813 - DNA, 21 bp, Artificial Sequence
  Synthetic
catggggctggttggagtacg

SEQ ID NO: 22814 - DNA, 21 bp, Artificial Sequence
  Synthetic
aagccggcttgggcggttgat

SEQ ID NO: 22815 - DNA, 21 bp, Artificial Sequence
  Synthetic
tggggtgtgttgcatagtatt

SEQ ID NO: 22816 - DNA, 21 bp, Artificial Sequence
  Synthetic
gtttttggttataatgtgacg

SEQ ID NO: 22817 - DNA, 21 bp, Artificial Sequence
  Synthetic
ctggggtattctatgagtctt

SEQ ID NO: 22818 - DNA, 21 bp, Artificial Sequence
  Synthetic
atgtggcatggggatgcgagt

SEQ ID NO: 22819 - DNA, 21 bp, Artificial Sequence
  Synthetic
gagcggactctttattcgtct

SEQ ID NO: 22820 - DNA, 21 bp, Artificial Sequence
  Synthetic
aagggggcgtcgggtaattgg

SEQ ID NO: 22821 - DNA, 21 bp, Artificial Sequence
  Synthetic
gatgttactgtgtcgcggtgg

SEQ ID NO: 22822 - DNA, 21 bp, Artificial Sequence
  Synthetic
tggtctgctactgcgggttat

SEQ ID NO: 22823 - DNA, 21 bp, Artificial Sequence
  Synthetic
gaggctagttggtctgcttct

SEQ ID NO: 22824 - DNA, 21 bp, Artificial Sequence
  Synthetic
tttagtaagttttatgattcg

SEQ ID NO: 22825 - DNA, 21 bp, Artificial Sequence
  Synthetic
gatcatagttggcaggcgagt

SEQ ID NO: 22826 - DNA, 21 bp, Artificial Sequence
  Synthetic
gcttttcatggtgggtctatg

SEQ ID NO: 22827 - DNA, 21 bp, Artificial Sequence
  Synthetic
acttatgcgtttagtgctagt

SEQ ID NO: 22828 - DNA, 21 bp, Artificial Sequence
  Synthetic
ggttctcatgttggggcttgg

SEQ ID NO: 22829 - DNA, 21 bp, Artificial Sequence
  Synthetic
gggcttgagggtgggcggtgg

SEQ ID NO: 22830 - DNA, 21 bp, Artificial Sequence
  Synthetic
gagaaggatagtgcgaggtgg

SEQ ID NO: 22831 - DNA, 21 bp, Artificial Sequence
  Synthetic
ggtgctagtcctggtcggtgg

SEQ ID NO: 22832 - DNA, 21 bp, Artificial Sequence
  Synthetic
tatgggaggctggagttgttg

SEQ ID NO: 22833 - DNA, 21 bp, Artificial Sequence
  Synthetic
cctgctccgcttttttctgct

SEQ ID NO: 22834 - DNA, 21 bp, Artificial Sequence
  Synthetic
cagagttatgatactcggtgg

SEQ ID NO: 22835 - DNA, 21 bp, Artificial Sequence
  Synthetic
aggtattctggtgattctgcg

SEQ ID NO: 22836 - DNA, 21 bp, Artificial Sequence
  Synthetic
aggctttttgagttgcctact

SEQ ID NO: 22837 - DNA, 21 bp, Artificial Sequence
  Synthetic
gagactcctcttcagcggtgg

SEQ ID NO: 22838 - DNA, 21 bp, Artificial Sequence
  Synthetic
attgtgccgggtatgtctagt

SEQ ID NO: 22839 - DNA, 21 bp, Artificial Sequence
  Synthetic
agttggcctggtgaggcttct

SEQ ID NO: 22840 - DNA, 21 bp, Artificial Sequence
  Synthetic
tggaaggagatggggtctgtt

SEQ ID NO: 22841 - DNA, 21 bp, Artificial Sequence
  Synthetic
ggtgaggcggctggtaggtgg

SEQ ID NO: 22842 - DNA, 21 bp, Artificial Sequence
  Synthetic
ttggtgcatcatgggtttagt

SEQ ID NO: 22843 - DNA, 21 bp, Artificial Sequence
  Synthetic
tctattcctgggatgagttct

SEQ ID NO: 22844 - DNA, 21 bp, Artificial Sequence
  Synthetic
tgggcggctgggtatagttat

SEQ ID NO: 22845 - DNA, 21 bp, Artificial Sequence
  Synthetic
gagtggcggattggtcaggtg

SEQ ID NO: 22846 - DNA, 21 bp, Artificial Sequence
  Synthetic
tgggctcatgcggggtctagt

SEQ ID NO: 22847 - DNA, 21 bp, Artificial Sequence
  Synthetic
ccgctgcaggctagtggttgg

SEQ ID NO: 22848 - DNA, 21 bp, Artificial Sequence
  Synthetic
tggattggtggggggagtcag

SEQ ID NO: 22849 - DNA, 21 bp, Artificial Sequence
  Synthetic
atgcattgggagggtagttct

SEQ ID NO: 22850 - DNA, 21 bp, Artificial Sequence
  Synthetic
cttacgggggattttcgttgg

SEQ ID NO: 22851 - DNA, 21 bp, Artificial Sequence
  Synthetic
gttgtgcttggttatagtatg

SEQ ID NO: 22852 - DNA, 21 bp, Artificial Sequence
  Synthetic
cggtttgctgagggttttaag

SEQ ID NO: 22853 - DNA, 21 bp, Artificial Sequence
  Synthetic
tgggtgtctttgccggttact

SEQ ID NO: 22854 - DNA, 21 bp, Artificial Sequence
  Synthetic
atgtatgagggtcattctcag

SEQ ID NO: 22855 - DNA, 21 bp, Artificial Sequence
  Synthetic
gtgcatcaggggtatagtact

SEQ ID NO: 22856 - DNA, 21 bp, Artificial Sequence
  Synthetic
aatcatgtgggtaatctttgg

SEQ ID NO: 22857 - DNA, 21 bp, Artificial Sequence
  Synthetic
tggtcgttgggtgggagtact

SEQ ID NO: 22858 - DNA, 21 bp, Artificial Sequence
  Synthetic
actcggacgatgggttcggtg

SEQ ID NO: 22859 - DNA, 21 bp, Artificial Sequence
  Synthetic
agggttgcttggcctggtgat

SEQ ID NO: 22860 - DNA, 21 bp, Artificial Sequence
  Synthetic
tgggcggttgggagtatttat

SEQ ID NO: 22861 - DNA, 21 bp, Artificial Sequence
  Synthetic
gggtatactgagggtaggtgg

SEQ ID NO: 22862 - DNA, 21 bp, Artificial Sequence
  Synthetic
agtgatcggtttaggtttgat

SEQ ID NO: 22863 - DNA, 21 bp, Artificial Sequence
  Synthetic
ttggggagtggttggagtact

SEQ ID NO: 22864 - DNA, 21 bp, Artificial Sequence
  Synthetic
ggtgctaatcctgggctttgg

SEQ ID NO: 22865 - DNA, 21 bp, Artificial Sequence
  Synthetic
atgtggagtggtggttctcag

SEQ ID NO: 22866 - DNA, 21 bp, Artificial Sequence
  Synthetic
gagcgtaagtatgcttttgat

SEQ ID NO: 22867 - DNA, 21 bp, Artificial Sequence
  Synthetic
ccgagtcctcattcttatcat

SEQ ID NO: 22868 - DNA, 21 bp, Artificial Sequence
  Synthetic
cgttgggctgcggatcctgct

SEQ ID NO: 22869 - DNA, 21 bp, Artificial Sequence
  Synthetic
ggtgatagggttggggtgtgg

SEQ ID NO: 22870 - DNA, 21 bp, Artificial Sequence
  Synthetic
gagagggggtgggggtctact

SEQ ID NO: 22871 - DNA, 21 bp, Artificial Sequence
  Synthetic
ccggctattaggcttgctagt

SEQ ID NO: 22872 - DNA, 21 bp, Artificial Sequence
  Synthetic
ctggtgtatcatggggcgtct

SEQ ID NO: 22873 - DNA, 21 bp, Artificial Sequence
  Synthetic
actccttttaggctgccggat

SEQ ID NO: 22874 - DNA, 21 bp, Artificial Sequence
  Synthetic
aagtcgtatggtatgagttcg

SEQ ID NO: 22875 - DNA, 21 bp, Artificial Sequence
  Synthetic
atggttgtgactgggcgttgg

SEQ ID NO: 22876 - DNA, 21 bp, Artificial Sequence
  Synthetic
tttgtgccgggttttagtcag

SEQ ID NO: 22877 - DNA, 21 bp, Artificial Sequence
  Synthetic
gatgcgaattcgcataggtgg

SEQ ID NO: 22878 - DNA, 21 bp, Artificial Sequence
  Synthetic
ttggcggagattggtcgttgg

SEQ ID NO: 22879 - DNA, 21 bp, Artificial Sequence
  Synthetic
tggtatgtttctgggtcgtcg

SEQ ID NO: 22880 - DNA, 21 bp, Artificial Sequence
  Synthetic
cctgatcatgtgacgcgttgg

SEQ ID NO: 22881 - DNA, 21 bp, Artificial Sequence
  Synthetic
ccgacgtggggtgttgctgag

SEQ ID NO: 22882 - DNA, 21 bp, Artificial Sequence
  Synthetic
cctcgtttgggtacggtttat

SEQ ID NO: 22883 - DNA, 21 bp, Artificial Sequence
  Synthetic
cgtgcgtatgatccttcgggt

SEQ ID NO: 22884 - DNA, 21 bp, Artificial Sequence
  Synthetic
gataatagggggtggtctacg

SEQ ID NO: 22885 - DNA, 21 bp, Artificial Sequence
  Synthetic
gtttggcagcatgggtcgact

SEQ ID NO: 22886 - DNA, 21 bp, Artificial Sequence
  Synthetic
acggttaagggttattctacg

SEQ ID NO: 22887 - DNA, 21 bp, Artificial Sequence
  Synthetic
ggtccgagttttgttgcgtat

SEQ ID NO: 22888 - DNA, 21 bp, Artificial Sequence
  Synthetic
cctccgaaggatgtgaggtgg

SEQ ID NO: 22889 - DNA, 21 bp, Artificial Sequence
  Synthetic
gattggcggcggttggatccg

SEQ ID NO: 22890 - DNA, 21 bp, Artificial Sequence
  Synthetic
aatattgataggtatcatgtt

SEQ ID NO: 22891 - DNA, 21 bp, Artificial Sequence
  Synthetic
cagcttgttggtgcggggtgg

SEQ ID NO: 22892 - DNA, 21 bp, Artificial Sequence
  Synthetic
ggtaaggaggggaatacgtgg

SEQ ID NO: 22893 - DNA, 21 bp, Artificial Sequence
  Synthetic
actgttcggactttgaatacg

SEQ ID NO: 22894 - DNA, 21 bp, Artificial Sequence
  Synthetic
gtgtttaagtgggagagtacg

SEQ ID NO: 22895 - DNA, 21 bp, Artificial Sequence
  Synthetic
gataggcaggcgtggtcgtct

SEQ ID NO: 22896 - DNA, 21 bp, Artificial Sequence
  Synthetic
ccggctaatcgggctatgtat

SEQ ID NO: 22897 - DNA, 21 bp, Artificial Sequence
  Synthetic
gagcatccgagtgcgcggtat

SEQ ID NO: 22898 - DNA, 21 bp, Artificial Sequence
  Synthetic
gagcgttcggggtttagtagt

SEQ ID NO: 22899 - DNA, 21 bp, Artificial Sequence
  Synthetic
tgggggacgtatattcatact

SEQ ID NO: 22900 - DNA, 21 bp, Artificial Sequence
  Synthetic
ggggggtggggtatgagttct

SEQ ID NO: 22901 - DNA, 21 bp, Artificial Sequence
  Synthetic
aggtatgcgcatgatgctagt

SEQ ID NO: 22902 - DNA, 21 bp, Artificial Sequence
  Synthetic
tctgtgccttatggggcttcg

SEQ ID NO: 22903 - DNA, 21 bp, Artificial Sequence
  Synthetic
acggttcctggttgggcggcg

SEQ ID NO: 22904 - DNA, 21 bp, Artificial Sequence
  Synthetic
acttatattggtcgggctcag

SEQ ID NO: 22905 - DNA, 21 bp, Artificial Sequence
  Synthetic
cctgaggggagtagtcgttgg

SEQ ID NO: 22906 - DNA, 21 bp, Artificial Sequence
  Synthetic
tttttggttgggtttcgtgag

SEQ ID NO: 22907 - DNA, 21 bp, Artificial Sequence
  Synthetic
tgggttattcctagtggggct

SEQ ID NO: 22908 - DNA, 21 bp, Artificial Sequence
  Synthetic
actggtattggttattctcag

SEQ ID NO: 22909 - DNA, 21 bp, Artificial Sequence
  Synthetic
ttgtttaggactggttctacg

SEQ ID NO: 22910 - DNA, 21 bp, Artificial Sequence
  Synthetic
gatgtggatggttggcattat

SEQ ID NO: 22911 - DNA, 21 bp, Artificial Sequence
  Synthetic
ggtagtaatttgggggtttgg

SEQ ID NO: 22912 - DNA, 21 bp, Artificial Sequence
  Synthetic
catttgcgggggtattcggag

SEQ ID NO: 22913 - DNA, 21 bp, Artificial Sequence
  Synthetic
ggtgagcgtcctggtgtgtgg

SEQ ID NO: 22914 - DNA, 21 bp, Artificial Sequence
  Synthetic
atttatcgtggtatgtcgact

SEQ ID NO: 22915 - DNA, 21 bp, Artificial Sequence
  Synthetic
ggggggtttgggatgtcgcag

SEQ ID NO: 22916 - DNA, 21 bp, Artificial Sequence
  Synthetic
cgggtgcctggtcttagtagt

SEQ ID NO: 22917 - DNA, 21 bp, Artificial Sequence
  Synthetic
tatgatggttttcgttatggg

SEQ ID NO: 22918 - DNA, 21 bp, Artificial Sequence
  Synthetic
gatccgcgtttgcttgcttat

SEQ ID NO: 22919 - DNA, 21 bp, Artificial Sequence
  Synthetic
cggcagcttgctggtgatcgt

SEQ ID NO: 22920 - DNA, 21 bp, Artificial Sequence
  Synthetic
catcgtgagagggggtcttct

SEQ ID NO: 22921 - DNA, 21 bp, Artificial Sequence
  Synthetic
gggggtagtcagtatattaag

SEQ ID NO: 22922 - DNA, 21 bp, Artificial Sequence
  Synthetic
gtggtgaagacgcagtcttgg

SEQ ID NO: 22923 - DNA, 21 bp, Artificial Sequence
  Synthetic
atggatggtagtgctaggtgg

SEQ ID NO: 22924 - DNA, 21 bp, Artificial Sequence
  Synthetic
ggtggggctattgggccttgg

SEQ ID NO: 22925 - DNA, 21 bp, Artificial Sequence
  Synthetic
gtgtatcggccggcgccgggg

SEQ ID NO: 22926 - DNA, 21 bp, Artificial Sequence
  Synthetic
gcttatatgccggcggtgcat

SEQ ID NO: 22927 - DNA, 21 bp, Artificial Sequence
  Synthetic
atgattgctcggggtagtacg

SEQ ID NO: 22928 - DNA, 21 bp, Artificial Sequence
  Synthetic
gtgcatcggggtctgagtcag

SEQ ID NO: 22929 - DNA, 21 bp, Artificial Sequence
  Synthetic
cctaaggagctgggttcgtgg

SEQ ID NO: 22930 - DNA, 21 bp, Artificial Sequence
  Synthetic
gaggatgcgcggcgttttgtt

SEQ ID NO: 22931 - DNA, 21 bp, Artificial Sequence
  Synthetic
gatctttttcatctgcggccg

SEQ ID NO: 22932 - DNA, 21 bp, Artificial Sequence
  Synthetic
tgggcttatggtggtagttcg

SEQ ID NO: 22933 - DNA, 21 bp, Artificial Sequence
  Synthetic
gatattacttggtcggctagt

SEQ ID NO: 22934 - DNA, 21 bp, Artificial Sequence
  Synthetic
atttcgattggttctgtttat

SEQ ID NO: 22935 - DNA, 21 bp, Artificial Sequence
  Synthetic
gtgcatacgtatggtagttct

SEQ ID NO: 22936 - DNA, 21 bp, Artificial Sequence
  Synthetic
tcgatgagttatgggtcttcg

SEQ ID NO: 22937 - DNA, 21 bp, Artificial Sequence
  Synthetic
cgtagtgttgggctggctcag

SEQ ID NO: 22938 - DNA, 21 bp, Artificial Sequence
  Synthetic
gaggcgtggaagggggcggct

SEQ ID NO: 22939 - DNA, 21 bp, Artificial Sequence
  Synthetic
ccttatcctggggggacgtgg

SEQ ID NO: 22940 - DNA, 21 bp, Artificial Sequence
  Synthetic
tttgtgagtcttcctcgtgtg

SEQ ID NO: 22941 - DNA, 21 bp, Artificial Sequence
  Synthetic
acgaattatggtatgagtcag

SEQ ID NO: 22942 - DNA, 21 bp, Artificial Sequence
  Synthetic
gagtcgaggtatggttctgct

SEQ ID NO: 22943 - DNA, 21 bp, Artificial Sequence
  Synthetic
gatggtatggggtggtcgtcg

SEQ ID NO: 22944 - DNA, 21 bp, Artificial Sequence
  Synthetic
cgttatttgtctgattcttcg

SEQ ID NO: 22945 - DNA, 21 bp, Artificial Sequence
  Synthetic
ggggtgaatgagggtaggtgg

SEQ ID NO: 22946 - DNA, 21 bp, Artificial Sequence
  Synthetic
agtgttcgtcttgggtcgact

SEQ ID NO: 22947 - DNA, 21 bp, Artificial Sequence
  Synthetic
catcttgtggggagtgcttgg

SEQ ID NO: 22948 - DNA, 21 bp, Artificial Sequence
  Synthetic
ttgaggtatgctgtggatgtg

SEQ ID NO: 22949 - DNA, 21 bp, Artificial Sequence
  Synthetic
ctttcttatagtcttggtttg

SEQ ID NO: 22950 - DNA, 21 bp, Artificial Sequence
  Synthetic
catgttgctttgggttcttcg

SEQ ID NO: 22951 - DNA, 21 bp, Artificial Sequence
  Synthetic
tggtttagtggggggtcgatg

SEQ ID NO: 22952 - DNA, 21 bp, Artificial Sequence
  Synthetic
aggctggtgcatgctgctaat

SEQ ID NO: 22953 - DNA, 21 bp, Artificial Sequence
  Synthetic
gagaggcatcatgggagttcg

SEQ ID NO: 22954 - DNA, 21 bp, Artificial Sequence
  Synthetic
ctggttcatcctacgtggaat

SEQ ID NO: 22955 - DNA, 21 bp, Artificial Sequence
  Synthetic
gagtatcattttgggtctgcg

SEQ ID NO: 22956 - DNA, 21 bp, Artificial Sequence
  Synthetic
gtggtgggtggtgatcttcgt

SEQ ID NO: 22957 - DNA, 21 bp, Artificial Sequence
  Synthetic
gggggtattgggtggtctagt

SEQ ID NO: 22958 - DNA, 21 bp, Artificial Sequence
  Synthetic
aatgagccgtcggggaggatg

SEQ ID NO: 22959 - DNA, 21 bp, Artificial Sequence
  Synthetic
ggtctttatccgccgatggct

SEQ ID NO: 22960 - DNA, 21 bp, Artificial Sequence
  Synthetic
gggtggcatgcgggggctagt

SEQ ID NO: 22961 - DNA, 21 bp, Artificial Sequence
  Synthetic
gatcgttggaggttggatcct

SEQ ID NO: 22962 - DNA, 21 bp, Artificial Sequence
  Synthetic
atgctggggaggtattcgcag

SEQ ID NO: 22963 - DNA, 21 bp, Artificial Sequence
  Synthetic
ctttttcctgggtctgcgatg

SEQ ID NO: 22964 - DNA, 21 bp, Artificial Sequence
  Synthetic
atggatttggcgaatagttgg

SEQ ID NO: 22965 - DNA, 21 bp, Artificial Sequence
  Synthetic
tgggttcttcatggggctagt

SEQ ID NO: 22966 - DNA, 21 bp, Artificial Sequence
  Synthetic
gagttttttaatggtagtgcg

SEQ ID NO: 22967 - DNA, 21 bp, Artificial Sequence
  Synthetic
agggagcggtcgtcgtcgcgt

SEQ ID NO: 22968 - DNA, 21 bp, Artificial Sequence
  Synthetic
cggttggcgcaggatggtagg

SEQ ID NO: 22969 - DNA, 21 bp, Artificial Sequence
  Synthetic
ccggctgcggggatgtcttgg

SEQ ID NO: 22970 - DNA, 21 bp, Artificial Sequence
  Synthetic
tggagtcatcaggggtcgatg

SEQ ID NO: 22971 - DNA, 21 bp, Artificial Sequence
  Synthetic
ctttggactaatgggtcgagt

SEQ ID NO: 22972 - DNA, 21 bp, Artificial Sequence
  Synthetic
aagccttatactctgcctagt

SEQ ID NO: 22973 - DNA, 21 bp, Artificial Sequence
  Synthetic
ctgcatgtggggtatagtgcg

SEQ ID NO: 22974 - DNA, 21 bp, Artificial Sequence
  Synthetic
gggtcgccttgggatctggct

SEQ ID NO: 22975 - DNA, 21 bp, Artificial Sequence
  Synthetic
ggtactgattatacgcgttgg

SEQ ID NO: 22976 - DNA, 21 bp, Artificial Sequence
  Synthetic
gagagtgttcgttcgttgtgg

SEQ ID NO: 22977 - DNA, 21 bp, Artificial Sequence
  Synthetic
ttgaatcatccgggggcttgg

SEQ ID NO: 22978 - DNA, 21 bp, Artificial Sequence
  Synthetic
gcgatttatcatggttctact

SEQ ID NO: 22979 - DNA, 21 bp, Artificial Sequence
  Synthetic
tggaggggtggtggttcgacg

SEQ ID NO: 22980 - DNA, 21 bp, Artificial Sequence
  Synthetic
atggatttgatgcctgcgggt

SEQ ID NO: 22981 - DNA, 21 bp, Artificial Sequence
  Synthetic
tgggctgtgaagagtggtttt

SEQ ID NO: 22982 - DNA, 21 bp, Artificial Sequence
  Synthetic
tgggcgtctttggggtctact

SEQ ID NO: 22983 - DNA, 21 bp, Artificial Sequence
  Synthetic
ctttctattggtactgtgtat

SEQ ID NO: 22984 - DNA, 21 bp, Artificial Sequence
  Synthetic
acgtatgttcgtgagctggct

SEQ ID NO: 22985 - DNA, 21 bp, Artificial Sequence
  Synthetic
cagattgggacgggtatttgg

SEQ ID NO: 22986 - DNA, 21 bp, Artificial Sequence
  Synthetic
gatctttattttagtagttcg

SEQ ID NO: 22987 - DNA, 21 bp, Artificial Sequence
  Synthetic
tgggggtctccggagcattcg

SEQ ID NO: 22988 - DNA, 21 bp, Artificial Sequence
  Synthetic
aatcgtaatccggggatgtgg

SEQ ID NO: 22989 - DNA, 21 bp, Artificial Sequence
  Synthetic
gcgtatcctggtaatggttgg

SEQ ID NO: 22990 - DNA, 21 bp, Artificial Sequence
  Synthetic
gtttatgagattggttttaag

SEQ ID NO: 22991 - DNA, 21 bp, Artificial Sequence
  Synthetic
caggttgagtggggtagtgct

SEQ ID NO: 22992 - DNA, 21 bp, Artificial Sequence
  Synthetic
cgttttattccggagccgagt

SEQ ID NO: 22993 - DNA, 21 bp, Artificial Sequence
  Synthetic
catcgggtggatattttgagg

SEQ ID NO: 22994 - DNA, 21 bp, Artificial Sequence
  Synthetic
tcttggtctgggtattctgct

SEQ ID NO: 22995 - DNA, 21 bp, Artificial Sequence
  Synthetic
caggcgtataattcgtcttgg

SEQ ID NO: 22996 - DNA, 21 bp, Artificial Sequence
  Synthetic
tttctgtcgggttggaaggat

SEQ ID NO: 22997 - DNA, 21 bp, Artificial Sequence
  Synthetic
tggcagtcgtatgggagtgcg

SEQ ID NO: 22998 - DNA, 21 bp, Artificial Sequence
  Synthetic
ggttggctggggggtgcgtct

SEQ ID NO: 22999 - DNA, 21 bp, Artificial Sequence
  Synthetic
tatgagaatccgggtatgtgg

SEQ ID NO: 23000 - DNA, 21 bp, Artificial Sequence
  Synthetic
gagggggggagtgggcggtgg

SEQ ID NO: 23001 - DNA, 21 bp, Artificial Sequence
  Synthetic
ctgagggcgggttatgcgagt

SEQ ID NO: 23002 - DNA, 21 bp, Artificial Sequence
  Synthetic
gagcgttatggtacggctcag

SEQ ID NO: 23003 - DNA, 21 bp, Artificial Sequence
  Synthetic
ggtccggagtataggggttgg

SEQ ID NO: 23004 - DNA, 21 bp, Artificial Sequence
  Synthetic
ctgcgtgggcaggattggctg

SEQ ID NO: 23005 - DNA, 21 bp, Artificial Sequence
  Synthetic
cctagggagacgaatggttgg

SEQ ID NO: 23006 - DNA, 21 bp, Artificial Sequence
  Synthetic
cgggatcttcttcagctgagg

SEQ ID NO: 23007 - DNA, 21 bp, Artificial Sequence
  Synthetic
ccggggaatcatgcgcattgg

SEQ ID NO: 23008 - DNA, 21 bp, Artificial Sequence
  Synthetic
gaggctaagtatgcgaattgg

SEQ ID NO: 23009 - DNA, 21 bp, Artificial Sequence
  Synthetic
tgggtgtatgaggggtcggcg

SEQ ID NO: 23010 - DNA, 21 bp, Artificial Sequence
  Synthetic
gagcatgcgtgggagcggacg

SEQ ID NO: 23011 - DNA, 21 bp, Artificial Sequence
  Synthetic
ggtgcgaatgtgggggtgtgg

SEQ ID NO: 23012 - DNA, 21 bp, Artificial Sequence
  Synthetic
gttcgggagtttggtagtagt

SEQ ID NO: 23013 - DNA, 21 bp, Artificial Sequence
  Synthetic
gctgtgcagtatggttctagt

SEQ ID NO: 23014 - DNA, 21 bp, Artificial Sequence
  Synthetic
gagaattatcggtattcggcg

SEQ ID NO: 23015 - DNA, 21 bp, Artificial Sequence
  Synthetic
gggtctgatatggcgcgtttt

SEQ ID NO: 23016 - DNA, 21 bp, Artificial Sequence
  Synthetic
attcctttgcgtgcgccttat

SEQ ID NO: 23017 - DNA, 21 bp, Artificial Sequence
  Synthetic
gataagatgtggggtgttgtg

SEQ ID NO: 23018 - DNA, 21 bp, Artificial Sequence
  Synthetic
gctgtgtggggtacggtgccg

SEQ ID NO: 23019 - DNA, 21 bp, Artificial Sequence
  Synthetic
tatcgtgagtttcctcagcgg

SEQ ID NO: 23020 - DNA, 21 bp, Artificial Sequence
  Synthetic
ttgcagtataggggttctagt

SEQ ID NO: 23021 - DNA, 21 bp, Artificial Sequence
  Synthetic
gagtttcttcatggtgctgct

SEQ ID NO: 23022 - DNA, 21 bp, Artificial Sequence
  Synthetic
gtttttgcgggttttagtgcg

SEQ ID NO: 23023 - DNA, 21 bp, Artificial Sequence
  Synthetic
ttgaagtatgggatggcgtcg

SEQ ID NO: 23024 - DNA, 21 bp, Artificial Sequence
  Synthetic
ttttatgctcttgggtcgtcg

SEQ ID NO: 23025 - DNA, 21 bp, Artificial Sequence
  Synthetic
tcggttaggatgggttcgacg

SEQ ID NO: 23026 - DNA, 21 bp, Artificial Sequence
  Synthetic
attacgattggttattcgcag

SEQ ID NO: 23027 - DNA, 21 bp, Artificial Sequence
  Synthetic
gcgggttataatagtagtttt

SEQ ID NO: 23028 - DNA, 21 bp, Artificial Sequence
  Synthetic
attccggcgtggtcttcgagt

SEQ ID NO: 23029 - DNA, 21 bp, Artificial Sequence
  Synthetic
agtctttcgtggaaggttgat

SEQ ID NO: 23030 - DNA, 21 bp, Artificial Sequence
  Synthetic
atgattggttatgggagtacg

SEQ ID NO: 23031 - DNA, 21 bp, Artificial Sequence
  Synthetic
tttgggagtctgaatcagttg

SEQ ID NO: 23032 - DNA, 21 bp, Artificial Sequence
  Synthetic
atggctccgatgtggagtcag

SEQ ID NO: 23033 - DNA, 21 bp, Artificial Sequence
  Synthetic
ctttatgttgggtttagttct

SEQ ID NO: 23034 - DNA, 21 bp, Artificial Sequence
  Synthetic
tttatgacgcaggggagtgcg

SEQ ID NO: 23035 - DNA, 21 bp, Artificial Sequence
  Synthetic
gagggggctgctcgttgggcg

SEQ ID NO: 23036 - DNA, 21 bp, Artificial Sequence
  Synthetic
gagaaggttggttggtcgcag

SEQ ID NO: 23037 - DNA, 21 bp, Artificial Sequence
  Synthetic
ttggcgattgggtggagttct

SEQ ID NO: 23038 - DNA, 21 bp, Artificial Sequence
  Synthetic
gtttttcctggttcttcggtt

SEQ ID NO: 23039 - DNA, 21 bp, Artificial Sequence
  Synthetic
tggagtccgtatgctgcggat

SEQ ID NO: 23040 - DNA, 21 bp, Artificial Sequence
  Synthetic
gagtttcattctggtgcgtgg

SEQ ID NO: 23041 - DNA, 21 bp, Artificial Sequence
  Synthetic
gtgcggacgatggggtcgagt

SEQ ID NO: 23042 - DNA, 21 bp, Artificial Sequence
  Synthetic
attttggttggttctgtgtat

SEQ ID NO: 23043 - DNA, 21 bp, Artificial Sequence
  Synthetic
tggggtgtgttggagcgtgtt

SEQ ID NO: 23044 - DNA, 21 bp, Artificial Sequence
  Synthetic
tggggggtgcttgattctctt

SEQ ID NO: 23045 - DNA, 21 bp, Artificial Sequence
  Synthetic
gcgtggccgtctgggtctacg

SEQ ID NO: 23046 - DNA, 21 bp, Artificial Sequence
  Synthetic
ccgccgaatacggggatttgg

SEQ ID NO: 23047 - DNA, 21 bp, Artificial Sequence
  Synthetic
gatgctatgtctagtcgttgg

SEQ ID NO: 23048 - DNA, 21 bp, Artificial Sequence
  Synthetic
gcggagctttctgggaggtgg

SEQ ID NO: 23049 - DNA, 21 bp, Artificial Sequence
  Synthetic
gcgatgtggggttcgattgcg

SEQ ID NO: 23050 - DNA, 21 bp, Artificial Sequence
  Synthetic
cggttttcgttgggtgatgag

SEQ ID NO: 23051 - DNA, 21 bp, Artificial Sequence
  Synthetic
agggggatgtctccggagcgt

SEQ ID NO: 23052 - DNA, 21 bp, Artificial Sequence
  Synthetic
acggcgatttatggttcgacg

SEQ ID NO: 23053 - DNA, 21 bp, Artificial Sequence
  Synthetic
ttggctcttgggactgtttat

SEQ ID NO: 23054 - DNA, 21 bp, Artificial Sequence
  Synthetic
tcttatacgcatggttcggcg

SEQ ID NO: 23055 - DNA, 21 bp, Artificial Sequence
  Synthetic
agggcgagttatagtgagtgg

SEQ ID NO: 23056 - DNA, 21 bp, Artificial Sequence
  Synthetic
agtattaggatggggagtact

SEQ ID NO: 23057 - DNA, 21 bp, Artificial Sequence
  Synthetic
tcgtggcaggggggttcgagt

SEQ ID NO: 23058 - DNA, 21 bp, Artificial Sequence
  Synthetic
agtcatgcggggtattctact

SEQ ID NO: 23059 - DNA, 21 bp, Artificial Sequence
  Synthetic
catggttttgatcttaatagg

SEQ ID NO: 23060 - DNA, 21 bp, Artificial Sequence
  Synthetic
ttgctgactggttatgcgcag

SEQ ID NO: 23061 - DNA, 21 bp, Artificial Sequence
  Synthetic
gtgagggttgggttttcttct

SEQ ID NO: 23062 - DNA, 21 bp, Artificial Sequence
  Synthetic
actgctaagggttggtcgagt

SEQ ID NO: 23063 - DNA, 21 bp, Artificial Sequence
  Synthetic
tgggagcttaatgagggttgg

SEQ ID NO: 23064 - DNA, 21 bp, Artificial Sequence
  Synthetic
gcgtggcctggttctgctact

SEQ ID NO: 23065 - DNA, 21 bp, Artificial Sequence
  Synthetic
gagtttaggctgggttctacg

SEQ ID NO: 23066 - DNA, 21 bp, Artificial Sequence
  Synthetic
gagcgtgagcggtatagttcg

SEQ ID NO: 23067 - DNA, 21 bp, Artificial Sequence
  Synthetic
gaggggcctgtgaggtgggat

SEQ ID NO: 23068 - DNA, 21 bp, Artificial Sequence
  Synthetic
ttggttttgcgtcttgcgagt

SEQ ID NO: 23069 - DNA, 21 bp, Artificial Sequence
  Synthetic
ttgtatccggctatgagttct

SEQ ID NO: 23070 - DNA, 21 bp, Artificial Sequence
  Synthetic
gagaggactggttggtctgct

SEQ ID NO: 23071 - DNA, 21 bp, Artificial Sequence
  Synthetic
ttggagcgtgggtattctact

SEQ ID NO: 23072 - DNA, 21 bp, Artificial Sequence
  Synthetic
tatgctagttggatgccggtt

SEQ ID NO: 23073 - DNA, 21 bp, Artificial Sequence
  Synthetic
ggttatcctgggttttctact

SEQ ID NO: 23074 - DNA, 21 bp, Artificial Sequence
  Synthetic
ggtagtgggtcgtctctgtgg

SEQ ID NO: 23075 - DNA, 21 bp, Artificial Sequence
  Synthetic
ttgcagtattcgtattcgagt

SEQ ID NO: 23076 - DNA, 21 bp, Artificial Sequence
  Synthetic
atgcgtactgggttttcgcag

SEQ ID NO: 23077 - DNA, 21 bp, Artificial Sequence
  Synthetic
aggtatcttggggatactaag

SEQ ID NO: 23078 - DNA, 21 bp, Artificial Sequence
  Synthetic
aagagtccttatgcgattccg

SEQ ID NO: 23079 - DNA, 21 bp, Artificial Sequence
  Synthetic
gaggtggtgaattgggcgtcg

SEQ ID NO: 23080 - DNA, 21 bp, Artificial Sequence
  Synthetic
attcttgttgggcgggagggg

SEQ ID NO: 23081 - DNA, 21 bp, Artificial Sequence
  Synthetic
tggggtgttgagcttggttat

SEQ ID NO: 23082 - DNA, 21 bp, Artificial Sequence
  Synthetic
agtgttctgacgggttatggt

SEQ ID NO: 23083 - DNA, 21 bp, Artificial Sequence
  Synthetic
aatcctggtgagcatcggtgg

SEQ ID NO: 23084 - DNA, 21 bp, Artificial Sequence
  Synthetic
tgggggttgcctaatcattcg

SEQ ID NO: 23085 - DNA, 21 bp, Artificial Sequence
  Synthetic
aggggtacttgggagggtgtg

SEQ ID NO: 23086 - DNA, 21 bp, Artificial Sequence
  Synthetic
gaggttcgtttgatgacgtat

SEQ ID NO: 23087 - DNA, 21 bp, Artificial Sequence
  Synthetic
atgtgggtgggtcattcttcg

SEQ ID NO: 23088 - DNA, 21 bp, Artificial Sequence
  Synthetic
attcagcttggtttttcttcg

SEQ ID NO: 23089 - DNA, 21 bp, Artificial Sequence
  Synthetic
attgctaggggttatagtgtt

SEQ ID NO: 23090 - DNA, 21 bp, Artificial Sequence
  Synthetic
gcgctttataggggttcttct

SEQ ID NO: 23091 - DNA, 21 bp, Artificial Sequence
  Synthetic
atggtttctcatggttctgcg

SEQ ID NO: 23092 - DNA, 21 bp, Artificial Sequence
  Synthetic
gagttgtattatgggtctgct

SEQ ID NO: 23093 - DNA, 21 bp, Artificial Sequence
  Synthetic
agtatgccttttggtgcttcg

SEQ ID NO: 23094 - DNA, 21 bp, Artificial Sequence
  Synthetic
gcgttgccgtgggggtctgcg

SEQ ID NO: 23095 - DNA, 21 bp, Artificial Sequence
  Synthetic
gaggtggtggggctgcgttgg

SEQ ID NO: 23096 - DNA, 21 bp, Artificial Sequence
  Synthetic
catgcgtttcagggttcgagt

SEQ ID NO: 23097 - DNA, 21 bp, Artificial Sequence
  Synthetic
cagagtgggtatagtgggtgg

SEQ ID NO: 23098 - DNA, 21 bp, Artificial Sequence
  Synthetic
tttcgtcagtatccggagatt

SEQ ID NO: 23099 - DNA, 21 bp, Artificial Sequence
  Synthetic
cggtatcagatggatagtgcg

SEQ ID NO: 23100 - DNA, 21 bp, Artificial Sequence
  Synthetic
atgccgcataggctgcctatt

SEQ ID NO: 23101 - DNA, 21 bp, Artificial Sequence
  Synthetic
gtgggttctattccggctctt

SEQ ID NO: 23102 - DNA, 21 bp, Artificial Sequence
  Synthetic
tgggtgtttggtggtgcggct

SEQ ID NO: 23103 - DNA, 21 bp, Artificial Sequence
  Synthetic
ggtcctgaggttggtcgttgg

SEQ ID NO: 23104 - DNA, 21 bp, Artificial Sequence
  Synthetic
cggtatttgccggcgccgggt

SEQ ID NO: 23105 - DNA, 21 bp, Artificial Sequence
  Synthetic
tatggtagtctggctgctatg

SEQ ID NO: 23106 - DNA, 21 bp, Artificial Sequence
  Synthetic
atttttgcggggtatgtgaat

SEQ ID NO: 23107 - DNA, 21 bp, Artificial Sequence
  Synthetic
ctgtatcatggtggttcttcg

SEQ ID NO: 23108 - DNA, 21 bp, Artificial Sequence
  Synthetic
tatggtctgcttatttctaat

SEQ ID NO: 23109 - DNA, 21 bp, Artificial Sequence
  Synthetic
gatattcctgggtggagtcat

SEQ ID NO: 23110 - DNA, 21 bp, Artificial Sequence
  Synthetic
ggttatgttctgcagtatggt

SEQ ID NO: 23111 - DNA, 21 bp, Artificial Sequence
  Synthetic
tatcggggtacgtgggatcct

SEQ ID NO: 23112 - DNA, 21 bp, Artificial Sequence
  Synthetic
ctgtatgcgggttggaatgag

SEQ ID NO: 23113 - DNA, 21 bp, Artificial Sequence
  Synthetic
gtgttgattgggcgtgctggg

SEQ ID NO: 23114 - DNA, 21 bp, Artificial Sequence
  Synthetic
tgggttacgcatgggtcgagt

SEQ ID NO: 23115 - DNA, 21 bp, Artificial Sequence
  Synthetic
actattcggggtttttctgtg

SEQ ID NO: 23116 - DNA, 21 bp, Artificial Sequence
  Synthetic
tttgtttttggggcggaggtt

SEQ ID NO: 23117 - DNA, 21 bp, Artificial Sequence
  Synthetic
cttttgccgccgtggcatgcg

SEQ ID NO: 23118 - DNA, 21 bp, Artificial Sequence
  Synthetic
cttatggttggttattctgtg

SEQ ID NO: 23119 - DNA, 21 bp, Artificial Sequence
  Synthetic
tggccgcttttgactcctaat

SEQ ID NO: 23120 - DNA, 21 bp, Artificial Sequence
  Synthetic
ttgttgcagtatggtagtcag

SEQ ID NO: 23121 - DNA, 21 bp, Artificial Sequence
  Synthetic
cctaggacgtatggttcgtct

SEQ ID NO: 23122 - DNA, 21 bp, Artificial Sequence
  Synthetic
ggtcaggatctggggaggtgg

SEQ ID NO: 23123 - DNA, 21 bp, Artificial Sequence
  Synthetic
ggttgtacgagtgttggggct

SEQ ID NO: 23124 - DNA, 21 bp, Artificial Sequence
  Synthetic
atgcggaatttgacttttggt

SEQ ID NO: 23125 - DNA, 21 bp, Artificial Sequence
  Synthetic
actactcatgggtatggttat

SEQ ID NO: 23126 - DNA, 21 bp, Artificial Sequence
  Synthetic
gagaggtttcatgggtatagt

SEQ ID NO: 23127 - DNA, 21 bp, Artificial Sequence
  Synthetic
agtgattgtcgggggtgttgg

SEQ ID NO: 23128 - DNA, 21 bp, Artificial Sequence
  Synthetic
atgaatcgtccttcggagcgg

SEQ ID NO: 23129 - DNA, 21 bp, Artificial Sequence
  Synthetic
cgttataatggggagagtcag

SEQ ID NO: 23130 - DNA, 21 bp, Artificial Sequence
  Synthetic
cggttttctggggatcctagt

SEQ ID NO: 23131 - DNA, 21 bp, Artificial Sequence
  Synthetic
gataatactagtggtcggtgg

SEQ ID NO: 23132 - DNA, 21 bp, Artificial Sequence
  Synthetic
attactactttgattaggcag

SEQ ID NO: 23133 - DNA, 21 bp, Artificial Sequence
  Synthetic
cctattttgaagtatggggcg

SEQ ID NO: 23134 - DNA, 21 bp, Artificial Sequence
  Synthetic
tggttggcgaagggtacggtt

SEQ ID NO: 23135 - DNA, 21 bp, Artificial Sequence
  Synthetic
tattttcatagtcattcgatg

SEQ ID NO: 23136 - DNA, 21 bp, Artificial Sequence
  Synthetic
aggtttagtgctgattctagt

SEQ ID NO: 23137 - DNA, 21 bp, Artificial Sequence
  Synthetic
acgaggacgggttatagtacg

SEQ ID NO: 23138 - DNA, 21 bp, Artificial Sequence
  Synthetic
gggggtaatagtcgttgggat

SEQ ID NO: 23139 - DNA, 21 bp, Artificial Sequence
  Synthetic
tcgtatgttggtggggcgagt

SEQ ID NO: 23140 - DNA, 21 bp, Artificial Sequence
  Synthetic
gctgttggggatgggaggtgg

SEQ ID NO: 23141 - DNA, 21 bp, Artificial Sequence
  Synthetic
tttgttattggtagtccgttt

SEQ ID NO: 23142 - DNA, 21 bp, Artificial Sequence
  Synthetic
atgtatgggggttatgcgcag

SEQ ID NO: 23143 - DNA, 21 bp, Artificial Sequence
  Synthetic
ttgtttcctgcggatcgttct

SEQ ID NO: 23144 - DNA, 21 bp, Artificial Sequence
  Synthetic
cttaattatagtgggtcgacg

SEQ ID NO: 23145 - DNA, 21 bp, Artificial Sequence
  Synthetic
cttatttatcagcattcgagt

SEQ ID NO: 23146 - DNA, 21 bp, Artificial Sequence
  Synthetic
tggcatagttatgggtctgcg

SEQ ID NO: 23147 - DNA, 21 bp, Artificial Sequence
  Synthetic
gatcttcgttgggatcgggcg

SEQ ID NO: 23148 - DNA, 21 bp, Artificial Sequence
  Synthetic
gagaggacttatggtagtcag

SEQ ID NO: 23149 - DNA, 21 bp, Artificial Sequence
  Synthetic
agtcatgtggggtggagtcag

SEQ ID NO: 23150 - DNA, 21 bp, Artificial Sequence
  Synthetic
tttttgcgtggttatgagaat

SEQ ID NO: 23151 - DNA, 21 bp, Artificial Sequence
  Synthetic
gcgggggatcctgggcgttgg

SEQ ID NO: 23152 - DNA, 21 bp, Artificial Sequence
  Synthetic
gttgagcatagtgggaggtgg

SEQ ID NO: 23153 - DNA, 21 bp, Artificial Sequence
  Synthetic
actcgtacgcttacgcagtat

SEQ ID NO: 23154 - DNA, 21 bp, Artificial Sequence
  Synthetic
cctcagcattctggtatgtgg

SEQ ID NO: 23155 - DNA, 21 bp, Artificial Sequence
  Synthetic
gatcttcctggttggtcttct

SEQ ID NO: 23156 - DNA, 21 bp, Artificial Sequence
  Synthetic
aatcctgtgcggcttcataat

SEQ ID NO: 23157 - DNA, 21 bp, Artificial Sequence
  Synthetic
gatcagactcctgggaggtgg

SEQ ID NO: 23158 - DNA, 21 bp, Artificial Sequence
  Synthetic
tctgtgacttggggtagtgcg

SEQ ID NO: 23159 - DNA, 21 bp, Artificial Sequence
  Synthetic
ccttatcctggtcttgcggcg

SEQ ID NO: 23160 - DNA, 21 bp, Artificial Sequence
  Synthetic
cctcgtgtgagttatgcggct

SEQ ID NO: 23161 - DNA, 21 bp, Artificial Sequence
  Synthetic
catcttgttgggtatgcggtt

SEQ ID NO: 23162 - DNA, 21 bp, Artificial Sequence
  Synthetic
aagcgtgagtatgattatagt

SEQ ID NO: 23163 - DNA, 21 bp, Artificial Sequence
  Synthetic
ctggagcagggttggagtacg

SEQ ID NO: 23164 - DNA, 21 bp, Artificial Sequence
  Synthetic
agggatgtggggactgtttat

SEQ ID NO: 23165 - DNA, 21 bp, Artificial Sequence
  Synthetic
aagtatactgatagtttgtgg

SEQ ID NO: 23166 - DNA, 21 bp, Artificial Sequence
  Synthetic
tttggggcgccgggtatgtgg

SEQ ID NO: 23167 - DNA, 21 bp, Artificial Sequence
  Synthetic
tgggtggttggtgttgagtat

SEQ ID NO: 23168 - DNA, 21 bp, Artificial Sequence
  Synthetic
agtgtgcctgctcatcaggtg

SEQ ID NO: 23169 - DNA, 21 bp, Artificial Sequence
  Synthetic
ttgcgttattcggttggtctg

SEQ ID NO: 23170 - DNA, 21 bp, Artificial Sequence
  Synthetic
gtgaatcctggggggtggacg

SEQ ID NO: 23171 - DNA, 21 bp, Artificial Sequence
  Synthetic
tggggttctttggctagtttg

SEQ ID NO: 23172 - DNA, 21 bp, Artificial Sequence
  Synthetic
acgcgtcctgcgatgtgggag

SEQ ID NO: 23173 - DNA, 21 bp, Artificial Sequence
  Synthetic
tttggtcgtcttgagcagttt

SEQ ID NO: 23174 - DNA, 21 bp, Artificial Sequence
  Synthetic
attgcgcaggggtattcgacg

SEQ ID NO: 23175 - DNA, 21 bp, Artificial Sequence
  Synthetic
ttggttggggagggtcgttgg

SEQ ID NO: 23176 - DNA, 21 bp, Artificial Sequence
  Synthetic
tggtctgcggggggtgctcag

SEQ ID NO: 23177 - DNA, 21 bp, Artificial Sequence
  Synthetic
gataagactggttggtctagt

SEQ ID NO: 23178 - DNA, 21 bp, Artificial Sequence
  Synthetic
gttgagcggtttggttctgct

SEQ ID NO: 23179 - DNA, 21 bp, Artificial Sequence
  Synthetic
tggacggagatgaggtatggt

SEQ ID NO: 23180 - DNA, 21 bp, Artificial Sequence
  Synthetic
ctgcgtgagcatgggtgggcg

SEQ ID NO: 23181 - DNA, 21 bp, Artificial Sequence
  Synthetic
gatttgatgccgggtaggtgg

SEQ ID NO: 23182 - DNA, 21 bp, Artificial Sequence
  Synthetic
aagccgtattctttgtcgcct

SEQ ID NO: 23183 - DNA, 21 bp, Artificial Sequence
  Synthetic
gaggcggcggggatgcgttgg

SEQ ID NO: 23184 - DNA, 21 bp, Artificial Sequence
  Synthetic
tattctgttagtggggggtgg

SEQ ID NO: 23185 - DNA, 21 bp, Artificial Sequence
  Synthetic
cctcaggatatggggatttgg

SEQ ID NO: 23186 - DNA, 21 bp, Artificial Sequence
  Synthetic
tatacgggggctcttagttgg

SEQ ID NO: 23187 - DNA, 21 bp, Artificial Sequence
  Synthetic
tctgctgggtgggggtcttct

SEQ ID NO: 23188 - DNA, 21 bp, Artificial Sequence
  Synthetic
gataagtatcattttcctgtg

SEQ ID NO: 23189 - DNA, 21 bp, Artificial Sequence
  Synthetic
ttggtgggtggttatgcttgg

SEQ ID NO: 23190 - DNA, 21 bp, Artificial Sequence
  Synthetic
cgggttggtgattatagttgg

SEQ ID NO: 23191 - DNA, 21 bp, Artificial Sequence
  Synthetic
gctgcggagtttggttctagt

SEQ ID NO: 23192 - DNA, 21 bp, Artificial Sequence
  Synthetic
gcggggtctccggggccgtgg

SEQ ID NO: 23193 - DNA, 21 bp, Artificial Sequence
  Synthetic
atgtctcatggtgcggcgcag

SEQ ID NO: 23194 - DNA, 21 bp, Artificial Sequence
  Synthetic
gagcgtgcgcatgggagttct

SEQ ID NO: 23195 - DNA, 21 bp, Artificial Sequence
  Synthetic
cttgttgagaattggcataag

SEQ ID NO: 23196 - DNA, 21 bp, Artificial Sequence
  Synthetic
tttgataatattgggcgttgg

SEQ ID NO: 23197 - DNA, 21 bp, Artificial Sequence
  Synthetic
gataattatcaggggtcggcg

SEQ ID NO: 23198 - DNA, 21 bp, Artificial Sequence
  Synthetic
gcggggattgtgaggtttaat

SEQ ID NO: 23199 - DNA, 21 bp, Artificial Sequence
  Synthetic
gtgtatgtgggtcagtcgtcg

SEQ ID NO: 23200 - DNA, 21 bp, Artificial Sequence
  Synthetic
tggacgaggcaggagggtttt

SEQ ID NO: 23201 - DNA, 21 bp, Artificial Sequence
  Synthetic
tggacggctggttcgggttat

SEQ ID NO: 23202 - DNA, 21 bp, Artificial Sequence
  Synthetic
acgacgcgggctgagttttgg

SEQ ID NO: 23203 - DNA, 21 bp, Artificial Sequence
  Synthetic
tctgttgagacgtggcatact

SEQ ID NO: 23204 - DNA, 21 bp, Artificial Sequence
  Synthetic
cagagttatcaggggagtact

SEQ ID NO: 23205 - DNA, 21 bp, Artificial Sequence
  Synthetic
cctgcgtttagtgttgataag

SEQ ID NO: 23206 - DNA, 21 bp, Artificial Sequence
  Synthetic
gagcaggtttttggttcggcg

SEQ ID NO: 23207 - DNA, 21 bp, Artificial Sequence
  Synthetic
cctgcgcgtcctgggccttgg

SEQ ID NO: 23208 - DNA, 21 bp, Artificial Sequence
  Synthetic
ccggatcatgctaggacttgg

SEQ ID NO: 23209 - DNA, 21 bp, Artificial Sequence
  Synthetic
ggtgatactcaggggcggtgg

SEQ ID NO: 23210 - DNA, 21 bp, Artificial Sequence
  Synthetic
attcctagttgttattcgtgt

SEQ ID NO: 23211 - DNA, 21 bp, Artificial Sequence
  Synthetic
attgtttataaggggtctgcg

SEQ ID NO: 23212 - DNA, 21 bp, Artificial Sequence
  Synthetic
cattttagtgggtattctacg

SEQ ID NO: 23213 - DNA, 21 bp, Artificial Sequence
  Synthetic
aagaggtttgatctgaatccg

SEQ ID NO: 23214 - DNA, 21 bp, Artificial Sequence
  Synthetic
ggtatttggggtttggcgcag

SEQ ID NO: 23215 - DNA, 21 bp, Artificial Sequence
  Synthetic
gttgcgccgtgggatcgtact

SEQ ID NO: 23216 - DNA, 21 bp, Artificial Sequence
  Synthetic
gatcatgtgagttctcggtgg

SEQ ID NO: 23217 - DNA, 21 bp, Artificial Sequence
  Synthetic
gtgcatgcgatgcagatttat

SEQ ID NO: 23218 - DNA, 21 bp, Artificial Sequence
  Synthetic
atgattccgtatggggcgtct

SEQ ID NO: 23219 - DNA, 21 bp, Artificial Sequence
  Synthetic
aagtatcagggttttgcttct

SEQ ID NO: 23220 - DNA, 21 bp, Artificial Sequence
  Synthetic
ttgctgaggttggggtctact

SEQ ID NO: 23221 - DNA, 21 bp, Artificial Sequence
  Synthetic
gagcggagttatatggctcag

SEQ ID NO: 23222 - DNA, 21 bp, Artificial Sequence
  Synthetic
gctatgcatatggggagttcg

SEQ ID NO: 23223 - DNA, 21 bp, Artificial Sequence
  Synthetic
gagcctcatcaggcgaggtgg

SEQ ID NO: 23224 - DNA, 21 bp, Artificial Sequence
  Synthetic
agtatttatcatggttcttcg

SEQ ID NO: 23225 - DNA, 21 bp, Artificial Sequence
  Synthetic
tatgtttatcatggttcgtcg

SEQ ID NO: 23226 - DNA, 21 bp, Artificial Sequence
  Synthetic
cttaatagtaattttagttcg

SEQ ID NO: 23227 - DNA, 21 bp, Artificial Sequence
  Synthetic
gctgcttttcatcttccggtt

SEQ ID NO: 23228 - DNA, 21 bp, Artificial Sequence
  Synthetic
ctggaggtgggttggagtact

SEQ ID NO: 23229 - DNA, 21 bp, Artificial Sequence
  Synthetic
ccgtcttattctcttaatgtg

SEQ ID NO: 23230 - DNA, 21 bp, Artificial Sequence
  Synthetic
agttttgtgtatagtagtgct

SEQ ID NO: 23231 - DNA, 21 bp, Artificial Sequence
  Synthetic
ggtcgtttgatgggtagtact

SEQ ID NO: 23232 - DNA, 21 bp, Artificial Sequence
  Synthetic
ttgaattatggtggtgctagt

SEQ ID NO: 23233 - DNA, 21 bp, Artificial Sequence
  Synthetic
gggttgtatagggagtttcat

SEQ ID NO: 23234 - DNA, 21 bp, Artificial Sequence
  Synthetic
ttgaatgtgggttgggcttcg

SEQ ID NO: 23235 - DNA, 21 bp, Artificial Sequence
  Synthetic
gagaagtggggtagttcgcag

SEQ ID NO: 23236 - DNA, 21 bp, Artificial Sequence
  Synthetic
ggggtgagtcagggtcgtttt

SEQ ID NO: 23237 - DNA, 21 bp, Artificial Sequence
  Synthetic
ttgaggctgcttgggtctgcg

SEQ ID NO: 23238 - DNA, 21 bp, Artificial Sequence
  Synthetic
gtgactttgggtacggtttat

SEQ ID NO: 23239 - DNA, 21 bp, Artificial Sequence
  Synthetic
tgggtgtttggttctgatgct

SEQ ID NO: 23240 - DNA, 21 bp, Artificial Sequence
  Synthetic
gcgtatcctgggcgttctcag

SEQ ID NO: 23241 - DNA, 21 bp, Artificial Sequence
  Synthetic
aggtggcagggtgaggcgtcg

SEQ ID NO: 23242 - DNA, 21 bp, Artificial Sequence
  Synthetic
attggggatgttggtcgttgg

SEQ ID NO: 23243 - DNA, 21 bp, Artificial Sequence
  Synthetic
ggtttggttgatgggcggtgg

SEQ ID NO: 23244 - DNA, 21 bp, Artificial Sequence
  Synthetic
ggggagaatcagggtaagtgg

SEQ ID NO: 23245 - DNA, 21 bp, Artificial Sequence
  Synthetic
gagtatgcttttcatagttcg

SEQ ID NO: 23246 - DNA, 21 bp, Artificial Sequence
  Synthetic
ttgattcctagtttttcttct

SEQ ID NO: 23247 - DNA, 21 bp, Artificial Sequence
  Synthetic
tctcatccgggtggttggagt

SEQ ID NO: 23248 - DNA, 21 bp, Artificial Sequence
  Synthetic
atgtttcatggtgcgtctact

SEQ ID NO: 23249 - DNA, 21 bp, Artificial Sequence
  Synthetic
ggtacttatgagagtaggtgg

SEQ ID NO: 23250 - DNA, 21 bp, Artificial Sequence
  Synthetic
agttattttgggagtgcgtct

SEQ ID NO: 23251 - DNA, 21 bp, Artificial Sequence
  Synthetic
atttcgattggttatgggtat

SEQ ID NO: 23252 - DNA, 21 bp, Artificial Sequence
  Synthetic
ggtcaggattcggcgaggtgg

SEQ ID NO: 23253 - DNA, 21 bp, Artificial Sequence
  Synthetic
gatattcggcatggttgggct

SEQ ID NO: 23254 - DNA, 21 bp, Artificial Sequence
  Synthetic
agttataatactgcttattat

SEQ ID NO: 23255 - DNA, 21 bp, Artificial Sequence
  Synthetic
gatcatcggtatgggagtgct

SEQ ID NO: 23256 - DNA, 21 bp, Artificial Sequence
  Synthetic
tggggtattttggatggtttg

SEQ ID NO: 23257 - DNA, 21 bp, Artificial Sequence
  Synthetic
ggtcgtgttccgatgggttat

SEQ ID NO: 23258 - DNA, 21 bp, Artificial Sequence
  Synthetic
ctttttcatgtggggtctact

SEQ ID NO: 23259 - DNA, 21 bp, Artificial Sequence
  Synthetic
ttgcgtgttgggtattcgatg

SEQ ID NO: 23260 - DNA, 21 bp, Artificial Sequence
  Synthetic
gttggttattctgttggtatt

SEQ ID NO: 23261 - DNA, 21 bp, Artificial Sequence
  Synthetic
gagcggagttttgggtatgcg

SEQ ID NO: 23262 - DNA, 21 bp, Artificial Sequence
  Synthetic
tctgtggagtatcgttttgtt

SEQ ID NO: 23263 - DNA, 21 bp, Artificial Sequence
  Synthetic
gctaattgggggctggcgagt

SEQ ID NO: 23264 - DNA, 21 bp, Artificial Sequence
  Synthetic
aggattttgttgacgccgatt

SEQ ID NO: 23265 - DNA, 21 bp, Artificial Sequence
  Synthetic
gggattccgcgggagtggaat

SEQ ID NO: 23266 - DNA, 21 bp, Artificial Sequence
  Synthetic
aataggtatgattataatgtt

SEQ ID NO: 23267 - DNA, 21 bp, Artificial Sequence
  Synthetic
gctcgtgttcagctggtggct

SEQ ID NO: 23268 - DNA, 21 bp, Artificial Sequence
  Synthetic
caggctttgtatgggtctacg

SEQ ID NO: 23269 - DNA, 21 bp, Artificial Sequence
  Synthetic
gttcagtcgtttacgagtttg

SEQ ID NO: 23270 - DNA, 21 bp, Artificial Sequence
  Synthetic
ttgcgtatggggggttcgcag

SEQ ID NO: 23271 - DNA, 21 bp, Artificial Sequence
  Synthetic
cttcgtgctacttatagtatg

SEQ ID NO: 23272 - DNA, 21 bp, Artificial Sequence
  Synthetic
attgttggtgggagtcttcgt

SEQ ID NO: 23273 - DNA, 21 bp, Artificial Sequence
  Synthetic
ggttggcctgggggtagtact

SEQ ID NO: 23274 - DNA, 21 bp, Artificial Sequence
  Synthetic
agtgagaagtttggttctagt

SEQ ID NO: 23275 - DNA, 21 bp, Artificial Sequence
  Synthetic
ctgtatgtgcctcatgcgagt

SEQ ID NO: 23276 - DNA, 21 bp, Artificial Sequence
  Synthetic
aggggtgcgtatgaggggtgg

SEQ ID NO: 23277 - DNA, 21 bp, Artificial Sequence
  Synthetic
gttgtttggggtggtagtgtg

SEQ ID NO: 23278 - DNA, 21 bp, Artificial Sequence
  Synthetic
ctttgggctggtacggctacg

SEQ ID NO: 23279 - DNA, 21 bp, Artificial Sequence
  Synthetic
tggaaggtgaatgatgggtat

SEQ ID NO: 23280 - DNA, 21 bp, Artificial Sequence
  Synthetic
aatcgtgagtgggcgattgct

SEQ ID NO: 23281 - DNA, 21 bp, Artificial Sequence
  Synthetic
gggactcatgtgggtgtttgg

SEQ ID NO: 23282 - DNA, 21 bp, Artificial Sequence
  Synthetic
gaggtgaagtgggggtcggct

SEQ ID NO: 23283 - DNA, 21 bp, Artificial Sequence
  Synthetic
atgatgattggttggtctgct

SEQ ID NO: 23284 - DNA, 21 bp, Artificial Sequence
  Synthetic
tggggtgtggatagggggtgg

SEQ ID NO: 23285 - DNA, 21 bp, Artificial Sequence
  Synthetic
gtttttacgattcggggtatt

SEQ ID NO: 23286 - DNA, 21 bp, Artificial Sequence
  Synthetic
ggtgataatgtggggtattgg

SEQ ID NO: 23287 - DNA, 21 bp, Artificial Sequence
  Synthetic
cgtgctccgtttcagtcggcg

SEQ ID NO: 23288 - DNA, 21 bp, Artificial Sequence
  Synthetic
cagctgagttggggtagtgct

SEQ ID NO: 23289 - DNA, 21 bp, Artificial Sequence
  Synthetic
ccgggtgattatgcgcgttat

SEQ ID NO: 23290 - DNA, 21 bp, Artificial Sequence
  Synthetic
cttaattcgttgtggtctggg

SEQ ID NO: 23291 - DNA, 21 bp, Artificial Sequence
  Synthetic
cttggtattaattggtctagt

SEQ ID NO: 23292 - DNA, 21 bp, Artificial Sequence
  Synthetic
ggtaggattatgttgacgtcg

SEQ ID NO: 23293 - DNA, 21 bp, Artificial Sequence
  Synthetic
gggctgcgtgtgggggcgtgg

SEQ ID NO: 23294 - DNA, 21 bp, Artificial Sequence
  Synthetic
ttggtgcatggttttagtgtg

SEQ ID NO: 23295 - DNA, 21 bp, Artificial Sequence
  Synthetic
aattcgcctgtgtggggttct

SEQ ID NO: 23296 - DNA, 21 bp, Artificial Sequence
  Synthetic
acgtatgatattcggtctatt

SEQ ID NO: 23297 - DNA, 21 bp, Artificial Sequence
  Synthetic
catcggcgggatcctcgtgag

SEQ ID NO: 23298 - DNA, 21 bp, Artificial Sequence
  Synthetic
gagggtacggtgcggtgggct

SEQ ID NO: 23299 - DNA, 21 bp, Artificial Sequence
  Synthetic
gagattcctgggtattcgcag

SEQ ID NO: 23300 - DNA, 21 bp, Artificial Sequence
  Synthetic
gctattactcggtattatgag

SEQ ID NO: 23301 - DNA, 21 bp, Artificial Sequence
  Synthetic
aagagtccttatgtgggtttt

SEQ ID NO: 23302 - DNA, 21 bp, Artificial Sequence
  Synthetic
cgtaattggtctctgaatgat

SEQ ID NO: 23303 - DNA, 21 bp, Artificial Sequence
  Synthetic
atgcagggtgagtatcggtgg

SEQ ID NO: 23304 - DNA, 21 bp, Artificial Sequence
  Synthetic
cgggagaatgatggtcgttgg

SEQ ID NO: 23305 - DNA, 21 bp, Artificial Sequence
  Synthetic
atggttaattatgggtctacg

SEQ ID NO: 23306 - DNA, 21 bp, Artificial Sequence
  Synthetic
ttgaggctgggtgaggcgcag

SEQ ID NO: 23307 - DNA, 21 bp, Artificial Sequence
  Synthetic
tttctgaatatgtatggtcag

SEQ ID NO: 23308 - DNA, 21 bp, Artificial Sequence
  Synthetic
gatcattggaagggtgcgagt

SEQ ID NO: 23309 - DNA, 21 bp, Artificial Sequence
  Synthetic
ctgcttaattcggggatttgg

SEQ ID NO: 23310 - DNA, 21 bp, Artificial Sequence
  Synthetic
gcgcatcctaattggtcgacg

SEQ ID NO: 23311 - DNA, 21 bp, Artificial Sequence
  Synthetic
ttgcctacggatactcgttgg

SEQ ID NO: 23312 - DNA, 21 bp, Artificial Sequence
  Synthetic
tttggtagtctgcagttgtat

SEQ ID NO: 23313 - DNA, 21 bp, Artificial Sequence
  Synthetic
tatccgagggggctgagttcg

SEQ ID NO: 23314 - DNA, 21 bp, Artificial Sequence
  Synthetic
agtgcttgggctgggtctatg

SEQ ID NO: 23315 - DNA, 21 bp, Artificial Sequence
  Synthetic
cgtgctgttgctcaggattgg

SEQ ID NO: 23316 - DNA, 21 bp, Artificial Sequence
  Synthetic
gaggcgccgggttattcgagt

SEQ ID NO: 23317 - DNA, 21 bp, Artificial Sequence
  Synthetic
cgtcatgtgacggattatgct

SEQ ID NO: 23318 - DNA, 21 bp, Artificial Sequence
  Synthetic
tttgggtcgttggcgggttat

SEQ ID NO: 23319 - DNA, 21 bp, Artificial Sequence
  Synthetic
ttggttcagaagggttggtct

SEQ ID NO: 23320 - DNA, 21 bp, Artificial Sequence
  Synthetic
gaggagtggaagggggcggcg

SEQ ID NO: 23321 - DNA, 21 bp, Artificial Sequence
  Synthetic
atgggtgttggttttagtagt

SEQ ID NO: 23322 - DNA, 21 bp, Artificial Sequence
  Synthetic
gctgtggttgggactatttat

SEQ ID NO: 23323 - DNA, 21 bp, Artificial Sequence
  Synthetic
tggaggaatcttgggtctgcg

SEQ ID NO: 23324 - DNA, 21 bp, Artificial Sequence
  Synthetic
ggtgggtataatgggatgtat

SEQ ID NO: 23325 - DNA, 21 bp, Artificial Sequence
  Synthetic
gatattgggagtagtaggtgg

SEQ ID NO: 23326 - DNA, 21 bp, Artificial Sequence
  Synthetic
cttcctttgcgtttggtgaat

SEQ ID NO: 23327 - DNA, 21 bp, Artificial Sequence
  Synthetic
ttttttcatgcgggttctagt

SEQ ID NO: 23328 - DNA, 21 bp, Artificial Sequence
  Synthetic
caggtggcgggttggagtgct

SEQ ID NO: 23329 - DNA, 21 bp, Artificial Sequence
  Synthetic
cttaagcctggtttttcttct

SEQ ID NO: 23330 - DNA, 21 bp, Artificial Sequence
  Synthetic
gatctgcggctgttttctgct

SEQ ID NO: 23331 - DNA, 21 bp, Artificial Sequence
  Synthetic
tctctgacgggggggtttagg

SEQ ID NO: 23332 - DNA, 21 bp, Artificial Sequence
  Synthetic
ccgtttccggggcttgctgct

SEQ ID NO: 23333 - DNA, 21 bp, Artificial Sequence
  Synthetic
catatgaatatgtatgggact

SEQ ID NO: 23334 - DNA, 21 bp, Artificial Sequence
  Synthetic
ctggagaggcagtcgactact

SEQ ID NO: 23335 - DNA, 21 bp, Artificial Sequence
  Synthetic
agtgctgtgcggaatggttgg

SEQ ID NO: 23336 - DNA, 21 bp, Artificial Sequence
  Synthetic
gttccgagttgggatcgtgcg

SEQ ID NO: 23337 - DNA, 21 bp, Artificial Sequence
  Synthetic
ccttcgaatccgggtttttgg

SEQ ID NO: 23338 - DNA, 21 bp, Artificial Sequence
  Synthetic
gcgttgtatggtactcagtgg

SEQ ID NO: 23339 - DNA, 21 bp, Artificial Sequence
  Synthetic
gcgcgtattcttggtgcggcg

SEQ ID NO: 23340 - DNA, 21 bp, Artificial Sequence
  Synthetic
aatcagaggcttcttccgtat

SEQ ID NO: 23341 - DNA, 21 bp, Artificial Sequence
  Synthetic
gatcggagtcagtggtctcag

SEQ ID NO: 23342 - DNA, 21 bp, Artificial Sequence
  Synthetic
ggtgtttgggggctgagtggt

SEQ ID NO: 23343 - DNA, 21 bp, Artificial Sequence
  Synthetic
ggtgctgatgttggggtttgg

SEQ ID NO: 23344 - DNA, 21 bp, Artificial Sequence
  Synthetic
tatcagcatgagcgttggaat

SEQ ID NO: 23345 - DNA, 21 bp, Artificial Sequence
  Synthetic
gatcctcatacggctcggtgg

SEQ ID NO: 23346 - DNA, 21 bp, Artificial Sequence
  Synthetic
tcgttttctatggggagttcg

SEQ ID NO: 23347 - DNA, 21 bp, Artificial Sequence
  Synthetic
actcattatgagggttcgacg

SEQ ID NO: 23348 - DNA, 21 bp, Artificial Sequence
  Synthetic
tatgttcatttggggtctgcg

SEQ ID NO: 23349 - DNA, 21 bp, Artificial Sequence
  Synthetic
gagtttctgcgtggtgcggcg

SEQ ID NO: 23350 - DNA, 21 bp, Artificial Sequence
  Synthetic
atgctgcatgctgggacgtgg

SEQ ID NO: 23351 - DNA, 21 bp, Artificial Sequence
  Synthetic
gtttttttggggtcgagtact

SEQ ID NO: 23352 - DNA, 21 bp, Artificial Sequence
  Synthetic
ggttcttctccggggcagtgg

SEQ ID NO: 23353 - DNA, 21 bp, Artificial Sequence
  Synthetic
ctttgggagcggggtgcgcag

SEQ ID NO: 23354 - DNA, 21 bp, Artificial Sequence
  Synthetic
tgttttgttcctgctcctgct

SEQ ID NO: 23355 - DNA, 21 bp, Artificial Sequence
  Synthetic
tgggaggttagtagtggttat

SEQ ID NO: 23356 - DNA, 21 bp, Artificial Sequence
  Synthetic
atgatgtctaggttttctgct

SEQ ID NO: 23357 - DNA, 21 bp, Artificial Sequence
  Synthetic
agggctccggggttgagttcg

SEQ ID NO: 23358 - DNA, 21 bp, Artificial Sequence
  Synthetic
ggggcgattgttgggccgtgg

SEQ ID NO: 23359 - DNA, 21 bp, Artificial Sequence
  Synthetic
ccgctggtgagtggtcgttat

SEQ ID NO: 23360 - DNA, 21 bp, Artificial Sequence
  Synthetic
ccggctgcgtatgctattggt

SEQ ID NO: 23361 - DNA, 21 bp, Artificial Sequence
  Synthetic
gatgttaagctttggagtagt

SEQ ID NO: 23362 - DNA, 21 bp, Artificial Sequence
  Synthetic
attcgggagtgggataggagt

SEQ ID NO: 23363 - DNA, 21 bp, Artificial Sequence
  Synthetic
ctttggcctgggagtgcgtcg

SEQ ID NO: 23364 - DNA, 21 bp, Artificial Sequence
  Synthetic
tggaattctttgcctcatatt

SEQ ID NO: 23365 - DNA, 21 bp, Artificial Sequence
  Synthetic
gctgtgtttatgggggcggct

SEQ ID NO: 23366 - DNA, 21 bp, Artificial Sequence
  Synthetic
tggcgtgataggggtagtcag

SEQ ID NO: 23367 - DNA, 21 bp, Artificial Sequence
  Synthetic
actctgtcttatgggtcgtcg

SEQ ID NO: 23368 - DNA, 21 bp, Artificial Sequence
  Synthetic
gatattttgagtggttatagg

SEQ ID NO: 23369 - DNA, 21 bp, Artificial Sequence
  Synthetic
aatgatcattggaagtatggt

SEQ ID NO: 23370 - DNA, 21 bp, Artificial Sequence
  Synthetic
cctgggccggggtcttcgtgg

SEQ ID NO: 23371 - DNA, 21 bp, Artificial Sequence
  Synthetic
ttgtttgcttatggtagtgtt

SEQ ID NO: 23372 - DNA, 21 bp, Artificial Sequence
  Synthetic
tcgcctaattcggtgaggtgg

SEQ ID NO: 23373 - DNA, 21 bp, Artificial Sequence
  Synthetic
actatttggcaggggtctact

SEQ ID NO: 23374 - DNA, 21 bp, Artificial Sequence
  Synthetic
gcgtcgctgtggcattgtatt

SEQ ID NO: 23375 - DNA, 21 bp, Artificial Sequence
  Synthetic
gctgtttgggctggtagtatt

SEQ ID NO: 23376 - DNA, 21 bp, Artificial Sequence
  Synthetic
gctgcttcgtttggtagtagt

SEQ ID NO: 23377 - DNA, 21 bp, Artificial Sequence
  Synthetic
ggtttgggttatgatcttagg

SEQ ID NO: 23378 - DNA, 21 bp, Artificial Sequence
  Synthetic
acgtatgcggctcaggctagt

SEQ ID NO: 23379 - DNA, 21 bp, Artificial Sequence
  Synthetic
catgctcttcatgggtctgct

SEQ ID NO: 23380 - DNA, 21 bp, Artificial Sequence
  Synthetic
cgttatgctggggatgctgtg

SEQ ID NO: 23381 - DNA, 21 bp, Artificial Sequence
  Synthetic
gcttttttgggtcatagtagt

SEQ ID NO: 23382 - DNA, 21 bp, Artificial Sequence
  Synthetic
aattggcctgggacttcttcg

SEQ ID NO: 23383 - DNA, 21 bp, Artificial Sequence
  Synthetic
gagactgggcgtttgacttgg

SEQ ID NO: 23384 - DNA, 21 bp, Artificial Sequence
  Synthetic
atgatgtatcatgggagtact

SEQ ID NO: 23385 - DNA, 21 bp, Artificial Sequence
  Synthetic
agtaggcagctgggttcgtcg

SEQ ID NO: 23386 - DNA, 21 bp, Artificial Sequence
  Synthetic
agtgagcggctgtattctgct

SEQ ID NO: 23387 - DNA, 21 bp, Artificial Sequence
  Synthetic
gttgctaatgaggcgcggtgg

SEQ ID NO: 23388 - DNA, 21 bp, Artificial Sequence
  Synthetic
cgttttgggactccgttggct

SEQ ID NO: 23389 - DNA, 21 bp, Artificial Sequence
  Synthetic
gaggcttcttttgggtctagt

SEQ ID NO: 23390 - DNA, 21 bp, Artificial Sequence
  Synthetic
cagcctcgttatctgggggat

SEQ ID NO: 23391 - DNA, 21 bp, Artificial Sequence
  Synthetic
gatgagactcctggtcgttgg

SEQ ID NO: 23392 - DNA, 21 bp, Artificial Sequence
  Synthetic
agttctccgcatggtttttat

SEQ ID NO: 23393 - DNA, 21 bp, Artificial Sequence
  Synthetic
tggatgactaatgggagttcg

SEQ ID NO: 23394 - DNA, 21 bp, Artificial Sequence
  Synthetic
ctttcgggggaggggcgttgg

SEQ ID NO: 23395 - DNA, 21 bp, Artificial Sequence
  Synthetic
ctgcagattggtttttctact

SEQ ID NO: 23396 - DNA, 21 bp, Artificial Sequence
  Synthetic
ggtcatgtttatacttcgagt

SEQ ID NO: 23397 - DNA, 21 bp, Artificial Sequence
  Synthetic
ctttggcatgcggcggctagt

SEQ ID NO: 23398 - DNA, 21 bp, Artificial Sequence
  Synthetic
ggtgttgcgtttgatttgcgt

SEQ ID NO: 23399 - DNA, 21 bp, Artificial Sequence
  Synthetic
cgggagtgggcgggttcgacg

SEQ ID NO: 23400 - DNA, 21 bp, Artificial Sequence
  Synthetic
gcgcatttgagtgatttttat

SEQ ID NO: 23401 - DNA, 21 bp, Artificial Sequence
  Synthetic
aagttttttgagggttcgagt

SEQ ID NO: 23402 - DNA, 21 bp, Artificial Sequence
  Synthetic
ggtgttttggatggttttcgg

SEQ ID NO: 23403 - DNA, 21 bp, Artificial Sequence
  Synthetic
tctaagttgctgtattcggcg

SEQ ID NO: 23404 - DNA, 21 bp, Artificial Sequence
  Synthetic
gtttatattggtcattcgatg

SEQ ID NO: 23405 - DNA, 21 bp, Artificial Sequence
  Synthetic
gagggtcctcagtggtcttcg

SEQ ID NO: 23406 - DNA, 21 bp, Artificial Sequence
  Synthetic
tgggcgcatagtggttctact

SEQ ID NO: 23407 - DNA, 21 bp, Artificial Sequence
  Synthetic
aagtcgcagccgtcgtatgtg

SEQ ID NO: 23408 - DNA, 21 bp, Artificial Sequence
  Synthetic
tcgatttatcataggtttgat

SEQ ID NO: 23409 - DNA, 21 bp, Artificial Sequence
  Synthetic
agttttgtggggtttagtgct

SEQ ID NO: 23410 - DNA, 21 bp, Artificial Sequence
  Synthetic
cataaggcgttggggtctacg

SEQ ID NO: 23411 - DNA, 21 bp, Artificial Sequence
  Synthetic
atgatgcgtatgggtagttct

SEQ ID NO: 23412 - DNA, 21 bp, Artificial Sequence
  Synthetic
aggccttatgatttgaagaat

SEQ ID NO: 23413 - DNA, 21 bp, Artificial Sequence
  Synthetic
ctttatcttggtggggctact

SEQ ID NO: 23414 - DNA, 21 bp, Artificial Sequence
  Synthetic
cgttatagtttgggtggggag

SEQ ID NO: 23415 - DNA, 21 bp, Artificial Sequence
  Synthetic
cgtactagtatgcatgattgg

SEQ ID NO: 23416 - DNA, 21 bp, Artificial Sequence
  Synthetic
acgaaggtgcagtggtcgtcg

SEQ ID NO: 23417 - DNA, 21 bp, Artificial Sequence
  Synthetic
tatagggttctgccgcaggtt

SEQ ID NO: 23418 - DNA, 21 bp, Artificial Sequence
  Synthetic
ggtcatacgccgaattggaat

SEQ ID NO: 23419 - DNA, 21 bp, Artificial Sequence
  Synthetic
cggccggcgattcaggagagg

SEQ ID NO: 23420 - DNA, 21 bp, Artificial Sequence
  Synthetic
tattcgcatggttattctcag

SEQ ID NO: 23421 - DNA, 21 bp, Artificial Sequence
  Synthetic
gttatgctggggtatagtgct

SEQ ID NO: 23422 - DNA, 21 bp, Artificial Sequence
  Synthetic
ctgatgactaagttttcttcg

SEQ ID NO: 23423 - DNA, 21 bp, Artificial Sequence
  Synthetic
tttagtgattattcgacgtgg

SEQ ID NO: 23424 - DNA, 21 bp, Artificial Sequence
  Synthetic
cagtatgagaatcataggtat

SEQ ID NO: 23425 - DNA, 21 bp, Artificial Sequence
  Synthetic
tggtctgcgtatcgtgagggt

SEQ ID NO: 23426 - DNA, 21 bp, Artificial Sequence
  Synthetic
atgtttccgggtttgtcttcg

SEQ ID NO: 23427 - DNA, 21 bp, Artificial Sequence
  Synthetic
atggcggggtctgcttattgg

SEQ ID NO: 23428 - DNA, 21 bp, Artificial Sequence
  Synthetic
tgtggtaagacgtgttgggag

SEQ ID NO: 23429 - DNA, 21 bp, Artificial Sequence
  Synthetic
atggcttatttggggtctcag

SEQ ID NO: 23430 - DNA, 21 bp, Artificial Sequence
  Synthetic
ttgttgaaggggtgggcgtct

SEQ ID NO: 23431 - DNA, 21 bp, Artificial Sequence
  Synthetic
tatcatattggttattctgct

SEQ ID NO: 23432 - DNA, 21 bp, Artificial Sequence
  Synthetic
ctggtttcgggttgggcgcag

SEQ ID NO: 23433 - DNA, 21 bp, Artificial Sequence
  Synthetic
ccgagtccgggtggtttttgg

SEQ ID NO: 23434 - DNA, 21 bp, Artificial Sequence
  Synthetic
gagtggaggatggggagtagt

SEQ ID NO: 23435 - DNA, 21 bp, Artificial Sequence
  Synthetic
atgattcagcgtgggagtgcg

SEQ ID NO: 23436 - DNA, 21 bp, Artificial Sequence
  Synthetic
actctgactggtgggtttcgt

SEQ ID NO: 23437 - DNA, 21 bp, Artificial Sequence
  Synthetic
agtcttattggtatggctcag

SEQ ID NO: 23438 - DNA, 21 bp, Artificial Sequence
  Synthetic
ggggattggagtaggccggtg

SEQ ID NO: 23439 - DNA, 21 bp, Artificial Sequence
  Synthetic
gttcgtgagcatgggagtgcg

SEQ ID NO: 23440 - DNA, 21 bp, Artificial Sequence
  Synthetic
ttggtgcgtttggggtcggct

SEQ ID NO: 23441 - DNA, 21 bp, Artificial Sequence
  Synthetic
ggttttcctggtttttctact

SEQ ID NO: 23442 - DNA, 21 bp, Artificial Sequence
  Synthetic
attggtcatggttatgctcag

SEQ ID NO: 23443 - DNA, 21 bp, Artificial Sequence
  Synthetic
cagtatcataattattctgct

SEQ ID NO: 23444 - DNA, 21 bp, Artificial Sequence
  Synthetic
gagtggtttaatggttctacg

SEQ ID NO: 23445 - DNA, 21 bp, Artificial Sequence
  Synthetic
gcgcagtggcagggtgcggct

SEQ ID NO: 23446 - DNA, 21 bp, Artificial Sequence
  Synthetic
actactaggggttatgcttct

SEQ ID NO: 23447 - DNA, 21 bp, Artificial Sequence
  Synthetic
gctggggttggtgggcattgg

SEQ ID NO: 23448 - DNA, 21 bp, Artificial Sequence
  Synthetic
acttatcatttgggtgcgtcg

SEQ ID NO: 23449 - DNA, 21 bp, Artificial Sequence
  Synthetic
gattcttttagtgcgcgttat

SEQ ID NO: 23450 - DNA, 21 bp, Artificial Sequence
  Synthetic
tcgtatgttcatgggagttct

SEQ ID NO: 23451 - DNA, 21 bp, Artificial Sequence
  Synthetic
aatgttcagtatggttatgcg

SEQ ID NO: 23452 - DNA, 21 bp, Artificial Sequence
  Synthetic
attcataataagtcggggcat

SEQ ID NO: 23453 - DNA, 21 bp, Artificial Sequence
  Synthetic
tggggtatggttgcttcgcat

SEQ ID NO: 23454 - DNA, 21 bp, Artificial Sequence
  Synthetic
gagatgtttcgggggagtact

SEQ ID NO: 23455 - DNA, 21 bp, Artificial Sequence
  Synthetic
gcttttagtttgagtgggtat

SEQ ID NO: 23456 - DNA, 21 bp, Artificial Sequence
  Synthetic
tatgctcagtggcagcagcat

SEQ ID NO: 23457 - DNA, 21 bp, Artificial Sequence
  Synthetic
gatcataggctgattggttat

SEQ ID NO: 23458 - DNA, 21 bp, Artificial Sequence
  Synthetic
gatgcttggagggggagtgtt

SEQ ID NO: 23459 - DNA, 21 bp, Artificial Sequence
  Synthetic
agggagtatggtagtgtgtat

SEQ ID NO: 23460 - DNA, 21 bp, Artificial Sequence
  Synthetic
cctaggattggtgtttctcag

SEQ ID NO: 23461 - DNA, 21 bp, Artificial Sequence
  Synthetic
actaaggctgggtatgggtat

SEQ ID NO: 23462 - DNA, 21 bp, Artificial Sequence
  Synthetic
tggactgcgacgcagggttgg

SEQ ID NO: 23463 - DNA, 21 bp, Artificial Sequence
  Synthetic
tgggggctgctgacgacggcg

SEQ ID NO: 23464 - DNA, 21 bp, Artificial Sequence
  Synthetic
cttacttatagtctggcgcat

SEQ ID NO: 23465 - DNA, 21 bp, Artificial Sequence
  Synthetic
ttgacttatagtaatgctctg

SEQ ID NO: 23466 - DNA, 21 bp, Artificial Sequence
  Synthetic
cctgatccttgggcgcgtcag

SEQ ID NO: 23467 - DNA, 21 bp, Artificial Sequence
  Synthetic
tctgcgtatcggctgccgaat

SEQ ID NO: 23468 - DNA, 21 bp, Artificial Sequence
  Synthetic
tttcatctgccttttccgggt

SEQ ID NO: 23469 - DNA, 21 bp, Artificial Sequence
  Synthetic
ttgcgggtgaattatgcttct

SEQ ID NO: 23470 - DNA, 21 bp, Artificial Sequence
  Synthetic
aggtttattgctgagtctgct

SEQ ID NO: 23471 - DNA, 21 bp, Artificial Sequence
  Synthetic
tttgagcttcttaaggggtat

SEQ ID NO: 23472 - DNA, 21 bp, Artificial Sequence
  Synthetic
tctaggagtgggtggtcggcg

SEQ ID NO: 23473 - DNA, 21 bp, Artificial Sequence
  Synthetic
cattatgtgggttctgctagt

SEQ ID NO: 23474 - DNA, 21 bp, Artificial Sequence
  Synthetic
gggtttgctaatcctaatagg

SEQ ID NO: 23475 - DNA, 21 bp, Artificial Sequence
  Synthetic
tcgaatacttttgatctgcgg

SEQ ID NO: 23476 - DNA, 21 bp, Artificial Sequence
  Synthetic
ggtttggcggctcggtgggat

SEQ ID NO: 23477 - DNA, 21 bp, Artificial Sequence
  Synthetic
gagcgttatatgggggcggct

SEQ ID NO: 23478 - DNA, 21 bp, Artificial Sequence
  Synthetic
tggcattcgttgggtacggct

SEQ ID NO: 23479 - DNA, 21 bp, Artificial Sequence
  Synthetic
catcgtccggaggggcgtagt

SEQ ID NO: 23480 - DNA, 21 bp, Artificial Sequence
  Synthetic
tcgccggtgtatggttataat

SEQ ID NO: 23481 - DNA, 21 bp, Artificial Sequence
  Synthetic
agtagggaggggtatagtact

SEQ ID NO: 23482 - DNA, 21 bp, Artificial Sequence
  Synthetic
gttgcgactgaggtgcggtgg

SEQ ID NO: 23483 - DNA, 21 bp, Artificial Sequence
  Synthetic
agtccggggctggatctgttt

SEQ ID NO: 23484 - DNA, 21 bp, Artificial Sequence
  Synthetic
aaggaggtgggtcatatttat

SEQ ID NO: 23485 - DNA, 21 bp, Artificial Sequence
  Synthetic
tattcggagtggcgttatgcg

SEQ ID NO: 23486 - DNA, 21 bp, Artificial Sequence
  Synthetic
aataggatgcatggttcgtcg

SEQ ID NO: 23487 - DNA, 21 bp, Artificial Sequence
  Synthetic
tatggtgcgctttcttcttgg

SEQ ID NO: 23488 - DNA, 21 bp, Artificial Sequence
  Synthetic
agtggtcctaattggtctcat

SEQ ID NO: 23489 - DNA, 21 bp, Artificial Sequence
  Synthetic
ctgaggattgggttgtcgtcg

SEQ ID NO: 23490 - DNA, 21 bp, Artificial Sequence
  Synthetic
tggcgtttgaatggttctact

SEQ ID NO: 23491 - DNA, 21 bp, Artificial Sequence
  Synthetic
ggtgctactatggcgcattat

SEQ ID NO: 23492 - DNA, 21 bp, Artificial Sequence
  Synthetic
ttggagatgggttgggcttcg

SEQ ID NO: 23493 - DNA, 21 bp, Artificial Sequence
  Synthetic
aagtatcctggttatgctgcg

SEQ ID NO: 23494 - DNA, 21 bp, Artificial Sequence
  Synthetic
actgttgtgtatgggtctagt

SEQ ID NO: 23495 - DNA, 21 bp, Artificial Sequence
  Synthetic
tggggtgctgggggttcgcag

SEQ ID NO: 23496 - DNA, 21 bp, Artificial Sequence
  Synthetic
acggttcagtatatggcgtcg

SEQ ID NO: 23497 - DNA, 21 bp, Artificial Sequence
  Synthetic
tggagtgctgggtataatctt

SEQ ID NO: 23498 - DNA, 21 bp, Artificial Sequence
  Synthetic
tttcagcatttggggtcgagt

SEQ ID NO: 23499 - DNA, 21 bp, Artificial Sequence
  Synthetic
tctcagcgttgggaggctggt

SEQ ID NO: 23500 - DNA, 21 bp, Artificial Sequence
  Synthetic
cctaggatgagtttttcggct

SEQ ID NO: 23501 - DNA, 21 bp, Artificial Sequence
  Synthetic
cagatttctttgacgccgatt

SEQ ID NO: 23502 - DNA, 21 bp, Artificial Sequence
  Synthetic
ctgaagtataatggtagtctg

SEQ ID NO: 23503 - DNA, 21 bp, Artificial Sequence
  Synthetic
ttgtggcatgctggtagtcag

SEQ ID NO: 23504 - DNA, 21 bp, Artificial Sequence
  Synthetic
tcgccgcttaagggttggagt

SEQ ID NO: 23505 - DNA, 21 bp, Artificial Sequence
  Synthetic
gggattgatcggggggtgtgg

SEQ ID NO: 23506 - DNA, 21 bp, Artificial Sequence
  Synthetic
cctagtaattttgcgattcat

SEQ ID NO: 23507 - DNA, 21 bp, Artificial Sequence
  Synthetic
atggatcatcctggtgtgtgg

SEQ ID NO: 23508 - DNA, 21 bp, Artificial Sequence
  Synthetic
tttaagccttgggtgtttgag

SEQ ID NO: 23509 - DNA, 21 bp, Artificial Sequence
  Synthetic
cagcgggatactgattattgg

SEQ ID NO: 23510 - DNA, 21 bp, Artificial Sequence
  Synthetic
aatgatcgtcctgttgcgcgg

SEQ ID NO: 23511 - DNA, 21 bp, Artificial Sequence
  Synthetic
tcgacgtatcatgggtatgct

SEQ ID NO: 23512 - DNA, 21 bp, Artificial Sequence
  Synthetic
atggttgtgcatggttcggcg

SEQ ID NO: 23513 - DNA, 21 bp, Artificial Sequence
  Synthetic
cggccgtttgagattggtttg

SEQ ID NO: 23514 - DNA, 21 bp, Artificial Sequence
  Synthetic
caggtggttgggagtctttgg

SEQ ID NO: 23515 - DNA, 21 bp, Artificial Sequence
  Synthetic
catagtactttgggttatagt

SEQ ID NO: 23516 - DNA, 21 bp, Artificial Sequence
  Synthetic
tggagtccgtattctgtgaat

SEQ ID NO: 23517 - DNA, 21 bp, Artificial Sequence
  Synthetic
tggtttatttctggttctgcg

SEQ ID NO: 23518 - DNA, 21 bp, Artificial Sequence
  Synthetic
gatcggacggcgagtcgggct

SEQ ID NO: 23519 - DNA, 21 bp, Artificial Sequence
  Synthetic
tcgtatccggggggggcggcg

SEQ ID NO: 23520 - DNA, 21 bp, Artificial Sequence
  Synthetic
ggtgagtttaatgattatagg

SEQ ID NO: 23521 - DNA, 21 bp, Artificial Sequence
  Synthetic
ggtgagccgttgggtcgttgg

SEQ ID NO: 23522 - DNA, 21 bp, Artificial Sequence
  Synthetic
gagtatcggggggcggcgtct

SEQ ID NO: 23523 - DNA, 21 bp, Artificial Sequence
  Synthetic
cgggatcgtggtactgtgtat

SEQ ID NO: 23524 - DNA, 21 bp, Artificial Sequence
  Synthetic
cgttatactggtatgtctagt

SEQ ID NO: 23525 - DNA, 21 bp, Artificial Sequence
  Synthetic
gcgcagccggggtggagtagt

SEQ ID NO: 23526 - DNA, 21 bp, Artificial Sequence
  Synthetic
ggtcagcatgggggtgtgagg

SEQ ID NO: 23527 - DNA, 21 bp, Artificial Sequence
  Synthetic
gcttcttggggtaatgcgcag

SEQ ID NO: 23528 - DNA, 21 bp, Artificial Sequence
  Synthetic
atttgggtggggggtgctgcg

SEQ ID NO: 23529 - DNA, 21 bp, Artificial Sequence
  Synthetic
atgtttgtgcatggttctact

SEQ ID NO: 23530 - DNA, 21 bp, Artificial Sequence
  Synthetic
gagcgtttgttggggtcgtcg

SEQ ID NO: 23531 - DNA, 21 bp, Artificial Sequence
  Synthetic
gctgtttgggctggttctagt

SEQ ID NO: 23532 - DNA, 21 bp, Artificial Sequence
  Synthetic
ccgtttcctagtggttcttgg

SEQ ID NO: 23533 - DNA, 21 bp, Artificial Sequence
  Synthetic
tattatttgcctgagggtggt

SEQ ID NO: 23534 - DNA, 21 bp, Artificial Sequence
  Synthetic
cctgcttgggggactactggg

SEQ ID NO: 23535 - DNA, 21 bp, Artificial Sequence
  Synthetic
ctgagttttggtatgagtcag

SEQ ID NO: 23536 - DNA, 21 bp, Artificial Sequence
  Synthetic
cgtcctgttgggacgatttat

SEQ ID NO: 23537 - DNA, 21 bp, Artificial Sequence
  Synthetic
cagagttgggggtctgcttcg

SEQ ID NO: 23538 - DNA, 21 bp, Artificial Sequence
  Synthetic
gattgggctcggggtgcttct

SEQ ID NO: 23539 - DNA, 21 bp, Artificial Sequence
  Synthetic
tttgggacggggcttgctcag

SEQ ID NO: 23540 - DNA, 21 bp, Artificial Sequence
  Synthetic
cctgagaagagtcatgggtgg

SEQ ID NO: 23541 - DNA, 21 bp, Artificial Sequence
  Synthetic
agtaagccgggtaattgggcg

SEQ ID NO: 23542 - DNA, 21 bp, Artificial Sequence
  Synthetic
tcgcgtcaggggtatgcggtt

SEQ ID NO: 23543 - DNA, 21 bp, Artificial Sequence
  Synthetic
cagatgtatatgggttctctt

SEQ ID NO: 23544 - DNA, 21 bp, Artificial Sequence
  Synthetic
gcgaatgatttttctcattgg

SEQ ID NO: 23545 - DNA, 21 bp, Artificial Sequence
  Synthetic
gtgggttatagtggttatcat

SEQ ID NO: 23546 - DNA, 21 bp, Artificial Sequence
  Synthetic
gagagggcgcttgggtctagt

SEQ ID NO: 23547 - DNA, 21 bp, Artificial Sequence
  Synthetic
gctcctttgaggcttgtgaat

SEQ ID NO: 23548 - DNA, 21 bp, Artificial Sequence
  Synthetic
cgggagtatgatttgcgtgtg

SEQ ID NO: 23549 - DNA, 21 bp, Artificial Sequence
  Synthetic
attgttaagggttattcggcg

SEQ ID NO: 23550 - DNA, 21 bp, Artificial Sequence
  Synthetic
agtgagacttatcgtgggtgg

SEQ ID NO: 23551 - DNA, 21 bp, Artificial Sequence
  Synthetic
gataggtggattgggagtgct

SEQ ID NO: 23552 - DNA, 21 bp, Artificial Sequence
  Synthetic
gatgagatgactaataggtgg

SEQ ID NO: 23553 - DNA, 21 bp, Artificial Sequence
  Synthetic
cgttctcatgggcaggcgcag

SEQ ID NO: 23554 - DNA, 21 bp, Artificial Sequence
  Synthetic
atgaaggaggggtgggctcag

SEQ ID NO: 23555 - DNA, 21 bp, Artificial Sequence
  Synthetic
gatacttatgatggtcggtgg

SEQ ID NO: 23556 - DNA, 21 bp, Artificial Sequence
  Synthetic
aatgattcgcgttttgcttat

SEQ ID NO: 23557 - DNA, 21 bp, Artificial Sequence
  Synthetic
cttcattataatggtgcgtct

SEQ ID NO: 23558 - DNA, 21 bp, Artificial Sequence
  Synthetic
gagagggcgtatgatcgggcg

SEQ ID NO: 23559 - DNA, 21 bp, Artificial Sequence
  Synthetic
ggtccgattcgtcttgtgaat

SEQ ID NO: 23560 - DNA, 21 bp, Artificial Sequence
  Synthetic
ctggtttatgggggttctgtg

SEQ ID NO: 23561 - DNA, 21 bp, Artificial Sequence
  Synthetic
ggtcttgagatttcgaggtgg

SEQ ID NO: 23562 - DNA, 21 bp, Artificial Sequence
  Synthetic
ggtttgaggatgtggtcggag

SEQ ID NO: 23563 - DNA, 21 bp, Artificial Sequence
  Synthetic
tggaagtctgggggttcgagt

SEQ ID NO: 23564 - DNA, 21 bp, Artificial Sequence
  Synthetic
tatgttagtcttgatcgtttt

SEQ ID NO: 23565 - DNA, 21 bp, Artificial Sequence
  Synthetic
ccgagggttacgggtgcttgg

SEQ ID NO: 23566 - DNA, 21 bp, Artificial Sequence
  Synthetic
cagtatcttttggggagtgct

SEQ ID NO: 23567 - DNA, 21 bp, Artificial Sequence
  Synthetic
tggggttcgcttgagtcgctg

SEQ ID NO: 23568 - DNA, 21 bp, Artificial Sequence
  Synthetic
cctatggctggggggtattat

SEQ ID NO: 23569 - DNA, 21 bp, Artificial Sequence
  Synthetic
ccgaatgatagggggccgtgg

SEQ ID NO: 23570 - DNA, 21 bp, Artificial Sequence
  Synthetic
ttgagggagcagcaggttagg

SEQ ID NO: 23571 - DNA, 21 bp, Artificial Sequence
  Synthetic
gcgtggcctggtctgtcttcg

SEQ ID NO: 23572 - DNA, 21 bp, Artificial Sequence
  Synthetic
ttgagttattctatgggtctg

SEQ ID NO: 23573 - DNA, 21 bp, Artificial Sequence
  Synthetic
gtgtctacttggagggctgat

SEQ ID NO: 23574 - DNA, 21 bp, Artificial Sequence
  Synthetic
aaggcgtatgatttgcgtgtg

SEQ ID NO: 23575 - DNA, 21 bp, Artificial Sequence
  Synthetic
gagttgattgggaatggttgg

SEQ ID NO: 23576 - DNA, 21 bp, Artificial Sequence
  Synthetic
ttttcgaggtatccggagctg

SEQ ID NO: 23577 - DNA, 21 bp, Artificial Sequence
  Synthetic
gtggctgcgggttggagtcag

SEQ ID NO: 23578 - DNA, 21 bp, Artificial Sequence
  Synthetic
gagaggtatactgagcattgg

SEQ ID NO: 23579 - DNA, 21 bp, Artificial Sequence
  Synthetic
ttgtttcctggtgctgcgcag

SEQ ID NO: 23580 - DNA, 21 bp, Artificial Sequence
  Synthetic
ccgtatcctggtggtacttgg

SEQ ID NO: 23581 - DNA, 21 bp, Artificial Sequence
  Synthetic
tgggagcctctgcctcgtatt

SEQ ID NO: 23582 - DNA, 21 bp, Artificial Sequence
  Synthetic
gtgatgaaggggtattctgct

SEQ ID NO: 23583 - DNA, 21 bp, Artificial Sequence
  Synthetic
gaggtgcatgcgtcgcgttgg

SEQ ID NO: 23584 - DNA, 21 bp, Artificial Sequence
  Synthetic
cttcagcctgggatgtcgcag

SEQ ID NO: 23585 - DNA, 21 bp, Artificial Sequence
  Synthetic
aagccttatgatctgcggggt

SEQ ID NO: 23586 - DNA, 21 bp, Artificial Sequence
  Synthetic
tgggtgctgccgcatatgggt

SEQ ID NO: 23587 - DNA, 21 bp, Artificial Sequence
  Synthetic
agtcgttctgggatgtctcag

SEQ ID NO: 23588 - DNA, 21 bp, Artificial Sequence
  Synthetic
ggggaggatcgggcgcgttat

SEQ ID NO: 23589 - DNA, 21 bp, Artificial Sequence
  Synthetic
gtggtttcgggttggtcttct

SEQ ID NO: 23590 - DNA, 21 bp, Artificial Sequence
  Synthetic
tatgtgagtttgccggtgatt

SEQ ID NO: 23591 - DNA, 21 bp, Artificial Sequence
  Synthetic
ttggttcttcatagggatatt

SEQ ID NO: 23592 - DNA, 21 bp, Artificial Sequence
  Synthetic
aagccgttttctttggagagg

SEQ ID NO: 23593 - DNA, 21 bp, Artificial Sequence
  Synthetic
acggattggggtcatgcgcag

SEQ ID NO: 23594 - DNA, 21 bp, Artificial Sequence
  Synthetic
gcgtatagtggtcagtcttcg

SEQ ID NO: 23595 - DNA, 21 bp, Artificial Sequence
  Synthetic
gttatttggcagggtagtgtt

SEQ ID NO: 23596 - DNA, 21 bp, Artificial Sequence
  Synthetic
aagagtatgggtactgtttat

SEQ ID NO: 23597 - DNA, 21 bp, Artificial Sequence
  Synthetic
gtgtcttattcgtattctacg

SEQ ID NO: 23598 - DNA, 21 bp, Artificial Sequence
  Synthetic
cctagtctgggttggagttct

SEQ ID NO: 23599 - DNA, 21 bp, Artificial Sequence
  Synthetic
gttgtgtgggggggtgggccg

SEQ ID NO: 23600 - DNA, 21 bp, Artificial Sequence
  Synthetic
gcggtgaggttgggttcggct

SEQ ID NO: 23601 - DNA, 21 bp, Artificial Sequence
  Synthetic
aagccgatgtcgggggcgtgg

SEQ ID NO: 23602 - DNA, 21 bp, Artificial Sequence
  Synthetic
tggccggagcttaagcggaat

SEQ ID NO: 23603 - DNA, 21 bp, Artificial Sequence
  Synthetic
ttgaagtatggtctgtcgagt

SEQ ID NO: 23604 - DNA, 21 bp, Artificial Sequence
  Synthetic
tttcgtctgaatggtcatagt

SEQ ID NO: 23605 - DNA, 21 bp, Artificial Sequence
  Synthetic
ttgcattttggtggtgctatg

SEQ ID NO: 23606 - DNA, 21 bp, Artificial Sequence
  Synthetic
gagaataataattttcggtgg

SEQ ID NO: 23607 - DNA, 21 bp, Artificial Sequence
  Synthetic
gctcatgcggcgggtactagg

SEQ ID NO: 23608 - DNA, 21 bp, Artificial Sequence
  Synthetic
tgggggtctcttgctgctgtg

SEQ ID NO: 23609 - DNA, 21 bp, Artificial Sequence
  Synthetic
ttggattctatgttttcgtcg

SEQ ID NO: 23610 - DNA, 21 bp, Artificial Sequence
  Synthetic
cgtgagcatgtgggtcattgg

SEQ ID NO: 23611 - DNA, 21 bp, Artificial Sequence
  Synthetic
gggtggggtctggggctgtcg

SEQ ID NO: 23612 - DNA, 21 bp, Artificial Sequence
  Synthetic
ttggttaattcgggtttttgg

SEQ ID NO: 23613 - DNA, 21 bp, Artificial Sequence
  Synthetic
tggagtcatggggaggggagg

SEQ ID NO: 23614 - DNA, 21 bp, Artificial Sequence
  Synthetic
aagcatccggcggctatttat

SEQ ID NO: 23615 - DNA, 21 bp, Artificial Sequence
  Synthetic
ttgtatcatgcgcagtcgacg

SEQ ID NO: 23616 - DNA, 21 bp, Artificial Sequence
  Synthetic
gcgggggttacgcgttgggat

SEQ ID NO: 23617 - DNA, 21 bp, Artificial Sequence
  Synthetic
tatgcgagttgggttagtcct

SEQ ID NO: 23618 - DNA, 21 bp, Artificial Sequence
  Synthetic
gtgcctagttggtcgattaat

SEQ ID NO: 23619 - DNA, 21 bp, Artificial Sequence
  Synthetic
atgctgggtgatgcgaggtgg

SEQ ID NO: 23620 - DNA, 21 bp, Artificial Sequence
  Synthetic
catgtgtggggtgagattgcg

SEQ ID NO: 23621 - DNA, 21 bp, Artificial Sequence
  Synthetic
gttatggcgtgggatagggtt

SEQ ID NO: 23622 - DNA, 21 bp, Artificial Sequence
  Synthetic
tatcatgtgggttggtctgcg

SEQ ID NO: 23623 - DNA, 21 bp, Artificial Sequence
  Synthetic
gataggtatcttggtgctagt

SEQ ID NO: 23624 - DNA, 21 bp, Artificial Sequence
  Synthetic
gtggagtggcgggggtctgct

SEQ ID NO: 23625 - DNA, 21 bp, Artificial Sequence
  Synthetic
ttgcgtcagctgacttttggt

SEQ ID NO: 23626 - DNA, 21 bp, Artificial Sequence
  Synthetic
aatcagtatctgggttctagt

SEQ ID NO: 23627 - DNA, 21 bp, Artificial Sequence
  Synthetic
ctgggtagtcttttttcttct

SEQ ID NO: 23628 - DNA, 21 bp, Artificial Sequence
  Synthetic
gatgcgaagtatatggctagt

SEQ ID NO: 23629 - DNA, 21 bp, Artificial Sequence
  Synthetic
actggggagattggtcggtgg

SEQ ID NO: 23630 - DNA, 21 bp, Artificial Sequence
  Synthetic
aatgagccgtatagggggtat

SEQ ID NO: 23631 - DNA, 21 bp, Artificial Sequence
  Synthetic
cttcagtctggttggagtgtg

SEQ ID NO: 23632 - DNA, 21 bp, Artificial Sequence
  Synthetic
tttgagaatgctggtcggtgg

SEQ ID NO: 23633 - DNA, 21 bp, Artificial Sequence
  Synthetic
aagagtgcgggtagtatttat

SEQ ID NO: 23634 - DNA, 21 bp, Artificial Sequence
  Synthetic
ggtgcttatgagggtatgtgg

SEQ ID NO: 23635 - DNA, 21 bp, Artificial Sequence
  Synthetic
ctgagggcgtatgctcatgat

SEQ ID NO: 23636 - DNA, 21 bp, Artificial Sequence
  Synthetic
gctttttatggtgcggcggct

SEQ ID NO: 23637 - DNA, 21 bp, Artificial Sequence
  Synthetic
gctagtaaggggagtatttat

SEQ ID NO: 23638 - DNA, 21 bp, Artificial Sequence
  Synthetic
gtttttgcgcttcgtgggttg

SEQ ID NO: 23639 - DNA, 21 bp, Artificial Sequence
  Synthetic
acgtatgagtggatggcgagt

SEQ ID NO: 23640 - DNA, 21 bp, Artificial Sequence
  Synthetic
ggtttgcttgagggttttcgg

SEQ ID NO: 23641 - DNA, 21 bp, Artificial Sequence
  Synthetic
aggatgggggggtcgcatggt

SEQ ID NO: 23642 - DNA, 21 bp, Artificial Sequence
  Synthetic
aagacgttttatcctgctggg

SEQ ID NO: 23643 - DNA, 21 bp, Artificial Sequence
  Synthetic
ctgagggtttttgagtcgagt

SEQ ID NO: 23644 - DNA, 21 bp, Artificial Sequence
  Synthetic
gcgaggagtccggggccttgg

SEQ ID NO: 23645 - DNA, 21 bp, Artificial Sequence
  Synthetic
atgactgggcatgattattgg

SEQ ID NO: 23646 - DNA, 21 bp, Artificial Sequence
  Synthetic
ccggcgggttcggcgatttgg

SEQ ID NO: 23647 - DNA, 21 bp, Artificial Sequence
  Synthetic
tttcatgttactaatacgtat

SEQ ID NO: 23648 - DNA, 21 bp, Artificial Sequence
  Synthetic
gggatttatgctgggtcgtgg

SEQ ID NO: 23649 - DNA, 21 bp, Artificial Sequence
  Synthetic
ttgcaggagggttggagtcat

SEQ ID NO: 23650 - DNA, 21 bp, Artificial Sequence
  Synthetic
ggtatgacgccgggtaagtgg

SEQ ID NO: 23651 - DNA, 21 bp, Artificial Sequence
  Synthetic
gttgctgctaattggtcgtcg

SEQ ID NO: 23652 - DNA, 21 bp, Artificial Sequence
  Synthetic
aaggctattgggatgagtcag

SEQ ID NO: 23653 - DNA, 21 bp, Artificial Sequence
  Synthetic
cctgatcgtctggggccttgg

SEQ ID NO: 23654 - DNA, 21 bp, Artificial Sequence
  Synthetic
agggatgtggggactgtgtat

SEQ ID NO: 23655 - DNA, 21 bp, Artificial Sequence
  Synthetic
aatgaggttactgctaggtat

SEQ ID NO: 23656 - DNA, 21 bp, Artificial Sequence
  Synthetic
gagatgtttaagaggctgcct

SEQ ID NO: 23657 - DNA, 21 bp, Artificial Sequence
  Synthetic
ttgccgggggaggtgcggtgg

SEQ ID NO: 23658 - DNA, 21 bp, Artificial Sequence
  Synthetic
tggggtagtctttcgtcgatt

SEQ ID NO: 23659 - DNA, 21 bp, Artificial Sequence
  Synthetic
aaggatgggccgcctcatagg

SEQ ID NO: 23660 - DNA, 21 bp, Artificial Sequence
  Synthetic
atgcagcctggttgggctagt

SEQ ID NO: 23661 - DNA, 21 bp, Artificial Sequence
  Synthetic
gtttttcatggtggtgcggcg

SEQ ID NO: 23662 - DNA, 21 bp, Artificial Sequence
  Synthetic
ggtagtgatcatgctcgttat

SEQ ID NO: 23663 - DNA, 21 bp, Artificial Sequence
  Synthetic
atgcaggtgggttggtcttcg

SEQ ID NO: 23664 - DNA, 21 bp, Artificial Sequence
  Synthetic
gatcggagtggttttagttgg

SEQ ID NO: 23665 - DNA, 21 bp, Artificial Sequence
  Synthetic
tggagtgttgagtctggttgg

SEQ ID NO: 23666 - DNA, 21 bp, Artificial Sequence
  Synthetic
cagtatactcttgggagtgcg

SEQ ID NO: 23667 - DNA, 21 bp, Artificial Sequence
  Synthetic
ggggggagtgagggtaggtgg

SEQ ID NO: 23668 - DNA, 21 bp, Artificial Sequence
  Synthetic
ctttgggataataagctggct

SEQ ID NO: 23669 - DNA, 21 bp, Artificial Sequence
  Synthetic
gtggctgcggggtggtcgagt

SEQ ID NO: 23670 - DNA, 21 bp, Artificial Sequence
  Synthetic
gggggtctgtttatggctagt

SEQ ID NO: 23671 - DNA, 21 bp, Artificial Sequence
  Synthetic
tttattgagtatgctaggacg

SEQ ID NO: 23672 - DNA, 21 bp, Artificial Sequence
  Synthetic
gagcgtagttatggttctgct

SEQ ID NO: 23673 - DNA, 21 bp, Artificial Sequence
  Synthetic
cggtatgtgggtagttctagt

SEQ ID NO: 23674 - DNA, 21 bp, Artificial Sequence
  Synthetic
attattcgtgcgtcttgggat

SEQ ID NO: 23675 - DNA, 21 bp, Artificial Sequence
  Synthetic
cctgagggtgtgattcgttgg

SEQ ID NO: 23676 - DNA, 21 bp, Artificial Sequence
  Synthetic
ggtgttcctcgtgagctgtgg

SEQ ID NO: 23677 - DNA, 21 bp, Artificial Sequence
  Synthetic
gatgtgacgtggatggcgagt

SEQ ID NO: 23678 - DNA, 21 bp, Artificial Sequence
  Synthetic
ctttataggggttatgagctg

SEQ ID NO: 23679 - DNA, 21 bp, Artificial Sequence
  Synthetic
gagcgttattctgggtctcag

SEQ ID NO: 23680 - DNA, 21 bp, Artificial Sequence
  Synthetic
atgactacggggtggagttct

SEQ ID NO: 23681 - DNA, 21 bp, Artificial Sequence
  Synthetic
gcgatttttatgggtagtgct

SEQ ID NO: 23682 - DNA, 21 bp, Artificial Sequence
  Synthetic
gagattcctttttttagtgcg

SEQ ID NO: 23683 - DNA, 21 bp, Artificial Sequence
  Synthetic
atgaatgagaggccgattagg

SEQ ID NO: 23684 - DNA, 21 bp, Artificial Sequence
  Synthetic
actggttctcctgggaagtgg

SEQ ID NO: 23685 - DNA, 21 bp, Artificial Sequence
  Synthetic
tcgcggcttctgatgagttcg

SEQ ID NO: 23686 - DNA, 21 bp, Artificial Sequence
  Synthetic
acgtcggtgggttgggcttcg

SEQ ID NO: 23687 - DNA, 21 bp, Artificial Sequence
  Synthetic
aagtatcctggggatcgggct

SEQ ID NO: 23688 - DNA, 21 bp, Artificial Sequence
  Synthetic
tatgatcgtccgccgtatggg

SEQ ID NO: 23689 - DNA, 21 bp, Artificial Sequence
  Synthetic
atttcgtggcaggggagtagt

SEQ ID NO: 23690 - DNA, 21 bp, Artificial Sequence
  Synthetic
gattgggggcgtgggagttcg

SEQ ID NO: 23691 - DNA, 21 bp, Artificial Sequence
  Synthetic
ggtgtgtggggtattgtggag

SEQ ID NO: 23692 - DNA, 21 bp, Artificial Sequence
  Synthetic
tggggtatgcctagtcatggg

SEQ ID NO: 23693 - DNA, 21 bp, Artificial Sequence
  Synthetic
ggtgattggcgtggtcctggt

SEQ ID NO: 23694 - DNA, 21 bp, Artificial Sequence
  Synthetic
ttgtttcctggtctgagtact

SEQ ID NO: 23695 - DNA, 21 bp, Artificial Sequence
  Synthetic
attactcggttgagtgctcct

SEQ ID NO: 23696 - DNA, 21 bp, Artificial Sequence
  Synthetic
ggtactgatacggggcggtgg

SEQ ID NO: 23697 - DNA, 21 bp, Artificial Sequence
  Synthetic
gagcctcctgggtggagtcat

SEQ ID NO: 23698 - DNA, 21 bp, Artificial Sequence
  Synthetic
ggttatttgcctcgtcctggt

SEQ ID NO: 23699 - DNA, 21 bp, Artificial Sequence
  Synthetic
acgattaagacgcagtattat

SEQ ID NO: 23700 - DNA, 21 bp, Artificial Sequence
  Synthetic
gagaagacgcattttagtgcg

SEQ ID NO: 23701 - DNA, 21 bp, Artificial Sequence
  Synthetic
ttgctggggcggggttttagt

SEQ ID NO: 23702 - DNA, 21 bp, Artificial Sequence
  Synthetic
cttgctgggtctggggtgtgg

SEQ ID NO: 23703 - DNA, 21 bp, Artificial Sequence
  Synthetic
ccgccgagttctcatttgtgg

SEQ ID NO: 23704 - DNA, 21 bp, Artificial Sequence
  Synthetic
gagcggattctgggggctgcg

SEQ ID NO: 23705 - DNA, 21 bp, Artificial Sequence
  Synthetic
gaggtgcgtttggggtcggct

SEQ ID NO: 23706 - DNA, 21 bp, Artificial Sequence
  Synthetic
tggggtcagccggcgcatgag

SEQ ID NO: 23707 - DNA, 21 bp, Artificial Sequence
  Synthetic
ttgaggtcgatggggagtacg

SEQ ID NO: 23708 - DNA, 21 bp, Artificial Sequence
  Synthetic
ggtgttggtgtttggggggcg

SEQ ID NO: 23709 - DNA, 21 bp, Artificial Sequence
  Synthetic
gtgcatgagtgggcgattgtt

SEQ ID NO: 23710 - DNA, 21 bp, Artificial Sequence
  Synthetic
gtggtggggtcgggtatttgg

SEQ ID NO: 23711 - DNA, 21 bp, Artificial Sequence
  Synthetic
gttcggtgggagggtgcgtcg

SEQ ID NO: 23712 - DNA, 21 bp, Artificial Sequence
  Synthetic
cttccttttagggattttcat

SEQ ID NO: 23713 - DNA, 21 bp, Artificial Sequence
  Synthetic
gagcctgctagggggtattgg

SEQ ID NO: 23714 - DNA, 21 bp, Artificial Sequence
  Synthetic
actgggccgtttctgtcgtct

SEQ ID NO: 23715 - DNA, 21 bp, Artificial Sequence
  Synthetic
gcttggccgtctgggagtact

SEQ ID NO: 23716 - DNA, 21 bp, Artificial Sequence
  Synthetic
gagcatcgttatttgtcgtcg

SEQ ID NO: 23717 - DNA, 21 bp, Artificial Sequence
  Synthetic
cgttttgctgggagtagttcg

SEQ ID NO: 23718 - DNA, 21 bp, Artificial Sequence
  Synthetic
tatggtgttttggctcctcat

SEQ ID NO: 23719 - DNA, 21 bp, Artificial Sequence
  Synthetic
ttgcgtgttttgggtagttct

SEQ ID NO: 23720 - DNA, 21 bp, Artificial Sequence
  Synthetic
ccggttatgacgtcttcgtgg

SEQ ID NO: 23721 - DNA, 21 bp, Artificial Sequence
  Synthetic
attcgtgcgcttggttcggct

SEQ ID NO: 23722 - DNA, 21 bp, Artificial Sequence
  Synthetic
ggttcttatgatactcgttgg

SEQ ID NO: 23723 - DNA, 21 bp, Artificial Sequence
  Synthetic
gcgactagtagttcgtattgg

SEQ ID NO: 23724 - DNA, 21 bp, Artificial Sequence
  Synthetic
tgggtgacgcatgggtttaat

SEQ ID NO: 23725 - DNA, 21 bp, Artificial Sequence
  Synthetic
ggtgatagtaggtttagttat

SEQ ID NO: 23726 - DNA, 21 bp, Artificial Sequence
  Synthetic
gttgagaatgatcatcggtgg

SEQ ID NO: 23727 - DNA, 21 bp, Artificial Sequence
  Synthetic
catgattatggttttagtcag

SEQ ID NO: 23728 - DNA, 21 bp, Artificial Sequence
  Synthetic
ttgatgaattctggtatttgg

SEQ ID NO: 23729 - DNA, 21 bp, Artificial Sequence
  Synthetic
gttttggttggtaggagtggg

SEQ ID NO: 23730 - DNA, 21 bp, Artificial Sequence
  Synthetic
acgagggttggtttttcgcat

SEQ ID NO: 23731 - DNA, 21 bp, Artificial Sequence
  Synthetic
ggtgcgtttagggatttgctg

SEQ ID NO: 23732 - DNA, 21 bp, Artificial Sequence
  Synthetic
atgggtcgtggtctgagtacg

SEQ ID NO: 23733 - DNA, 21 bp, Artificial Sequence
  Synthetic
ttgtataatgttgttcataat

SEQ ID NO: 23734 - DNA, 21 bp, Artificial Sequence
  Synthetic
cggtttcatggtgatgcgagt

SEQ ID NO: 23735 - DNA, 21 bp, Artificial Sequence
  Synthetic
gttgttcctgctagttggtcg

SEQ ID NO: 23736 - DNA, 21 bp, Artificial Sequence
  Synthetic
gtggggagtttgcagaggttt

SEQ ID NO: 23737 - DNA, 21 bp, Artificial Sequence
  Synthetic
cctgagtataatgcttatagg

SEQ ID NO: 23738 - DNA, 21 bp, Artificial Sequence
  Synthetic
tggcatggtctgttggggggt

SEQ ID NO: 23739 - DNA, 21 bp, Artificial Sequence
  Synthetic
gtgaagtggaatctgaatccg

SEQ ID NO: 23740 - DNA, 21 bp, Artificial Sequence
  Synthetic
tggcctgttttgaagcctgat

SEQ ID NO: 23741 - DNA, 21 bp, Artificial Sequence
  Synthetic
catggggatagtggtcggtgg

SEQ ID NO: 23742 - DNA, 21 bp, Artificial Sequence
  Synthetic
gagcgttttaagttggatgtg

SEQ ID NO: 23743 - DNA, 21 bp, Artificial Sequence
  Synthetic
cttaatgttgggtggagttct

SEQ ID NO: 23744 - DNA, 21 bp, Artificial Sequence
  Synthetic
cctgggactgcgatgatttat

SEQ ID NO: 23745 - DNA, 21 bp, Artificial Sequence
  Synthetic
atgcataagaatagtggtggg

SEQ ID NO: 23746 - DNA, 21 bp, Artificial Sequence
  Synthetic
gctgagtatacgggttcttgg

SEQ ID NO: 23747 - DNA, 21 bp, Artificial Sequence
  Synthetic
cagatggataattggcatacg

SEQ ID NO: 23748 - DNA, 21 bp, Artificial Sequence
  Synthetic
ctgcgtcctggtcttgcgcag

SEQ ID NO: 23749 - DNA, 21 bp, Artificial Sequence
  Synthetic
gttgatagggggtattctcag

SEQ ID NO: 23750 - DNA, 21 bp, Artificial Sequence
  Synthetic
cctgggttgcatttgtcttct

SEQ ID NO: 23751 - DNA, 21 bp, Artificial Sequence
  Synthetic
tgggtttcgtatggttctgcg

SEQ ID NO: 23752 - DNA, 21 bp, Artificial Sequence
  Synthetic
acgtctgagtatgcgcattgg

SEQ ID NO: 23753 - DNA, 21 bp, Artificial Sequence
  Synthetic
gagagtgagtataattttcat

SEQ ID NO: 23754 - DNA, 21 bp, Artificial Sequence
  Synthetic
ccgcagcatgattcgaggtgg

SEQ ID NO: 23755 - DNA, 21 bp, Artificial Sequence
  Synthetic
tttgcgattcatgggagtgct

SEQ ID NO: 23756 - DNA, 21 bp, Artificial Sequence
  Synthetic
tctcagttgcatggttctagt

SEQ ID NO: 23757 - DNA, 21 bp, Artificial Sequence
  Synthetic
gagatgaagtgggctgcgagt

SEQ ID NO: 23758 - DNA, 21 bp, Artificial Sequence
  Synthetic
cagtatgggagtggttcgtgg

SEQ ID NO: 23759 - DNA, 21 bp, Artificial Sequence
  Synthetic
gaggcgcatactgtgaggtgg

SEQ ID NO: 23760 - DNA, 21 bp, Artificial Sequence
  Synthetic
gattattatggtgctgctagt

SEQ ID NO: 23761 - DNA, 21 bp, Artificial Sequence
  Synthetic
gtttatgcggggtatacgatg

SEQ ID NO: 23762 - DNA, 21 bp, Artificial Sequence
  Synthetic
tggaatacgcttactggttat

SEQ ID NO: 23763 - DNA, 21 bp, Artificial Sequence
  Synthetic
ggggtttggggttcggttccg

SEQ ID NO: 23764 - DNA, 21 bp, Artificial Sequence
  Synthetic
aggactgttgattgttgtctt

SEQ ID NO: 23765 - DNA, 21 bp, Artificial Sequence
  Synthetic
gttgcgtgggcgggttcgagt

SEQ ID NO: 23766 - DNA, 21 bp, Artificial Sequence
  Synthetic
gcgccggagtttgtgggttgg

SEQ ID NO: 23767 - DNA, 21 bp, Artificial Sequence
  Synthetic
ttgttggctggtttttcgact

SEQ ID NO: 23768 - DNA, 21 bp, Artificial Sequence
  Synthetic
gggaattggaatctggcgatg

SEQ ID NO: 23769 - DNA, 21 bp, Artificial Sequence
  Synthetic
acgtgggttggtggggcgact

SEQ ID NO: 23770 - DNA, 21 bp, Artificial Sequence
  Synthetic
ggggcgcctggtagtcggttt

SEQ ID NO: 23771 - DNA, 21 bp, Artificial Sequence
  Synthetic
aagactgattatacgtattat

SEQ ID NO: 23772 - DNA, 21 bp, Artificial Sequence
  Synthetic
cttaataggtggagtagtgat

SEQ ID NO: 23773 - DNA, 21 bp, Artificial Sequence
  Synthetic
cctgcgatgcattcgacgtgg

SEQ ID NO: 23774 - DNA, 21 bp, Artificial Sequence
  Synthetic
cagagggtgatgggtagtact

SEQ ID NO: 23775 - DNA, 21 bp, Artificial Sequence
  Synthetic
agtcgggaggcttggagttct

SEQ ID NO: 23776 - DNA, 21 bp, Artificial Sequence
  Synthetic
tctaggattgtgcttcttaat

SEQ ID NO: 23777 - DNA, 21 bp, Artificial Sequence
  Synthetic
tcgacgtgggggggtagttcg

SEQ ID NO: 23778 - DNA, 21 bp, Artificial Sequence
  Synthetic
cagcgtccgggttatagtgct

SEQ ID NO: 23779 - DNA, 21 bp, Artificial Sequence
  Synthetic
aatgctaatcggagtcgggat

SEQ ID NO: 23780 - DNA, 21 bp, Artificial Sequence
  Synthetic
ggggcgcagtttgcggggtgg

SEQ ID NO: 23781 - DNA, 21 bp, Artificial Sequence
  Synthetic
ctgaagtctcctggtgcgtgg

SEQ ID NO: 23782 - DNA, 21 bp, Artificial Sequence
  Synthetic
ggttggctgggggggtcggtg

SEQ ID NO: 23783 - DNA, 21 bp, Artificial Sequence
  Synthetic
ggggcttttaattgggcggcg

SEQ ID NO: 23784 - DNA, 21 bp, Artificial Sequence
  Synthetic
agttatgttccggcgaagcat

SEQ ID NO: 23785 - DNA, 21 bp, Artificial Sequence
  Synthetic
tatgtgcagcttcctctggtt

SEQ ID NO: 23786 - DNA, 21 bp, Artificial Sequence
  Synthetic
gcgtatgtgggtttgagtagt

SEQ ID NO: 23787 - DNA, 21 bp, Artificial Sequence
  Synthetic
aggcctgttggttctatttat

SEQ ID NO: 23788 - DNA, 21 bp, Artificial Sequence
  Synthetic
gagttgagggggtattcgatt

SEQ ID NO: 23789 - DNA, 21 bp, Artificial Sequence
  Synthetic
tggggggtgatgaatagtctg

SEQ ID NO: 23790 - DNA, 21 bp, Artificial Sequence
  Synthetic
gattggcgggggggggctagt

SEQ ID NO: 23791 - DNA, 21 bp, Artificial Sequence
  Synthetic
tctgctcagggttatagtact

SEQ ID NO: 23792 - DNA, 21 bp, Artificial Sequence
  Synthetic
attctgcgggggtatgatgtt

SEQ ID NO: 23793 - DNA, 21 bp, Artificial Sequence
  Synthetic
cgggtttatgatggttttcat

SEQ ID NO: 23794 - DNA, 21 bp, Artificial Sequence
  Synthetic
cgttatcctggggagaatagt

SEQ ID NO: 23795 - DNA, 21 bp, Artificial Sequence
  Synthetic
ttgtggtctagtgggagtacg

SEQ ID NO: 23796 - DNA, 21 bp, Artificial Sequence
  Synthetic
aatgtttataataagacttgg

SEQ ID NO: 23797 - DNA, 21 bp, Artificial Sequence
  Synthetic
tgtgctaggtggccgtctgag

SEQ ID NO: 23798 - DNA, 21 bp, Artificial Sequence
  Synthetic
cttattgcgcagttttcgagt

SEQ ID NO: 23799 - DNA, 21 bp, Artificial Sequence
  Synthetic
aatgcgaggaatacgtgggag

SEQ ID NO: 23800 - DNA, 21 bp, Artificial Sequence
  Synthetic
gctggttgggttgggtcttct

SEQ ID NO: 23801 - DNA, 21 bp, Artificial Sequence
  Synthetic
attcgtgttgggggttggacg

SEQ ID NO: 23802 - DNA, 21 bp, Artificial Sequence
  Synthetic
cctgcgattgggagtgtgtat

SEQ ID NO: 23803 - DNA, 21 bp, Artificial Sequence
  Synthetic
ttgaaggggggttggagttct

SEQ ID NO: 23804 - DNA, 21 bp, Artificial Sequence
  Synthetic
ctgaagcttgggttttcgacg

SEQ ID NO: 23805 - DNA, 21 bp, Artificial Sequence
  Synthetic
ccttatgttcatttggcgtcg

SEQ ID NO: 23806 - DNA, 21 bp, Artificial Sequence
  Synthetic
acttatattggtagtgcttct

SEQ ID NO: 23807 - DNA, 21 bp, Artificial Sequence
  Synthetic
ggtgaggatctggggcggtgg

SEQ ID NO: 23808 - DNA, 21 bp, Artificial Sequence
  Synthetic
gggtcggatgttgctaggtat

SEQ ID NO: 23809 - DNA, 21 bp, Artificial Sequence
  Synthetic
aagccttttgatctgcggagt

SEQ ID NO: 23810 - DNA, 21 bp, Artificial Sequence
  Synthetic
gaggggccgtttatgtctact

SEQ ID NO: 23811 - DNA, 21 bp, Artificial Sequence
  Synthetic
gggttggcggatggtaggtgg

SEQ ID NO: 23812 - DNA, 21 bp, Artificial Sequence
  Synthetic
tgggggtcgccgattcatgtt

SEQ ID NO: 23813 - DNA, 21 bp, Artificial Sequence
  Synthetic
ccttcgggttatgggtcgtat

SEQ ID NO: 23814 - DNA, 21 bp, Artificial Sequence
  Synthetic
atgaagcaggataatcctaag

SEQ ID NO: 23815 - DNA, 21 bp, Artificial Sequence
  Synthetic
ttgaggcatgctggttctact

SEQ ID NO: 23816 - DNA, 21 bp, Artificial Sequence
  Synthetic
gatcataggtatattgctggg

SEQ ID NO: 23817 - DNA, 21 bp, Artificial Sequence
  Synthetic
ggtaggttgatgctggttgcg

SEQ ID NO: 23818 - DNA, 21 bp, Artificial Sequence
  Synthetic
cggtttcatgctgatgcggct

SEQ ID NO: 23819 - DNA, 21 bp, Artificial Sequence
  Synthetic
gctattggtagtggttttagg

SEQ ID NO: 23820 - DNA, 21 bp, Artificial Sequence
  Synthetic
gagtcgggtactgctcgttgg

SEQ ID NO: 23821 - DNA, 21 bp, Artificial Sequence
  Synthetic
atgttggagaggccgcagcgg

SEQ ID NO: 23822 - DNA, 21 bp, Artificial Sequence
  Synthetic
gagacgtttcggggtgctgcg

SEQ ID NO: 23823 - DNA, 21 bp, Artificial Sequence
  Synthetic
ccttatgctgagtgggcgggg

SEQ ID NO: 23824 - DNA, 21 bp, Artificial Sequence
  Synthetic
actacttatgtgcggtgggag

SEQ ID NO: 23825 - DNA, 21 bp, Artificial Sequence
  Synthetic
tatggtgctgtgggtccttgg

SEQ ID NO: 23826 - DNA, 21 bp, Artificial Sequence
  Synthetic
gagcagcgttatacgacgtat

SEQ ID NO: 23827 - DNA, 21 bp, Artificial Sequence
  Synthetic
ttggattgggggtctgctcag

SEQ ID NO: 23828 - DNA, 21 bp, Artificial Sequence
  Synthetic
gatgcgcatccgggtccgtgg

SEQ ID NO: 23829 - DNA, 21 bp, Artificial Sequence
  Synthetic
tcgtatctgcctgcttcgcat

SEQ ID NO: 23830 - DNA, 21 bp, Artificial Sequence
  Synthetic
gatcgttggacggattatact

SEQ ID NO: 23831 - DNA, 21 bp, Artificial Sequence
  Synthetic
atgcatagtggtttttcggtg

SEQ ID NO: 23832 - DNA, 21 bp, Artificial Sequence
  Synthetic
tcggttgtggggtggtcggcg

SEQ ID NO: 23833 - DNA, 21 bp, Artificial Sequence
  Synthetic
ttttcgctggattcgcggccg

SEQ ID NO: 23834 - DNA, 21 bp, Artificial Sequence
  Synthetic
tcttatctgggggatcttcgg

SEQ ID NO: 23835 - DNA, 21 bp, Artificial Sequence
  Synthetic
acggagcgtaatcagtggacg

SEQ ID NO: 23836 - DNA, 21 bp, Artificial Sequence
  Synthetic
gagattccggttcatcgttgg

SEQ ID NO: 23837 - DNA, 21 bp, Artificial Sequence
  Synthetic
tggcggttgtcggggagttcg

SEQ ID NO: 23838 - DNA, 21 bp, Artificial Sequence
  Synthetic
ggtggtgttgcgcctcggtat

SEQ ID NO: 23839 - DNA, 21 bp, Artificial Sequence
  Synthetic
gttgatggggtggttcggtgg

SEQ ID NO: 23840 - DNA, 21 bp, Artificial Sequence
  Synthetic
atgcgtgttgggtctgtgtat

SEQ ID NO: 23841 - DNA, 21 bp, Artificial Sequence
  Synthetic
aagatggctggggatcgttgg

SEQ ID NO: 23842 - DNA, 21 bp, Artificial Sequence
  Synthetic
ccttttatgccgatgagtagt

SEQ ID NO: 23843 - DNA, 21 bp, Artificial Sequence
  Synthetic
ctttatgtgccttcgtctcag

SEQ ID NO: 23844 - DNA, 21 bp, Artificial Sequence
  Synthetic
aaggagccgtgggatcggagt

SEQ ID NO: 23845 - DNA, 21 bp, Artificial Sequence
  Synthetic
ctgcctggtactcataattgg

SEQ ID NO: 23846 - DNA, 21 bp, Artificial Sequence
  Synthetic
tggagtccgtttgcgtcgggt

SEQ ID NO: 23847 - DNA, 21 bp, Artificial Sequence
  Synthetic
gttggtacgaagtcgctgtgg

SEQ ID NO: 23848 - DNA, 21 bp, Artificial Sequence
  Synthetic
agtatgactcttggttcggct

SEQ ID NO: 23849 - DNA, 21 bp, Artificial Sequence
  Synthetic
ttgtggagtggtgcgagtact

SEQ ID NO: 23850 - DNA, 21 bp, Artificial Sequence
  Synthetic
cctgcggatggtgctaggtgg

SEQ ID NO: 23851 - DNA, 21 bp, Artificial Sequence
  Synthetic
tggagtttgaatattgggtat

SEQ ID NO: 23852 - DNA, 21 bp, Artificial Sequence
  Synthetic
gctgcttatcggtttgatggg

SEQ ID NO: 23853 - DNA, 21 bp, Artificial Sequence
  Synthetic
acggagccgtttggtagtact

SEQ ID NO: 23854 - DNA, 21 bp, Artificial Sequence
  Synthetic
acttttcctaggggtgcgtcg

SEQ ID NO: 23855 - DNA, 21 bp, Artificial Sequence
  Synthetic
cctgcttatactaatgggtgg

SEQ ID NO: 23856 - DNA, 21 bp, Artificial Sequence
  Synthetic
actaggaatctgggttcgtcg

SEQ ID NO: 23857 - DNA, 21 bp, Artificial Sequence
  Synthetic
gttgctgttggttggagtgcg

SEQ ID NO: 23858 - DNA, 21 bp, Artificial Sequence
  Synthetic
ctgactcattatggttcgtcg

SEQ ID NO: 23859 - DNA, 21 bp, Artificial Sequence
  Synthetic
gtggatcggggttttgctcag

SEQ ID NO: 23860 - DNA, 21 bp, Artificial Sequence
  Synthetic
gttgggagtttgtctgggtgg

SEQ ID NO: 23861 - DNA, 21 bp, Artificial Sequence
  Synthetic
tggagtccttattcggttaat

SEQ ID NO: 23862 - DNA, 21 bp, Artificial Sequence
  Synthetic
ggtgatcagcctgggaggtgg

SEQ ID NO: 23863 - DNA, 21 bp, Artificial Sequence
  Synthetic
gagcggcatgggtttagttat

SEQ ID NO: 23864 - DNA, 21 bp, Artificial Sequence
  Synthetic
cggttgtatgagttgcctagt

SEQ ID NO: 23865 - DNA, 21 bp, Artificial Sequence
  Synthetic
tttggtgtgggttttagtact

SEQ ID NO: 23866 - DNA, 21 bp, Artificial Sequence
  Synthetic
aaggcggctgggatgtcgtgg

SEQ ID NO: 23867 - DNA, 21 bp, Artificial Sequence
  Synthetic
gagcttttgcggtcgtttgcg

SEQ ID NO: 23868 - DNA, 21 bp, Artificial Sequence
  Synthetic
cttgctccgggttggtctgtg

SEQ ID NO: 23869 - DNA, 21 bp, Artificial Sequence
  Synthetic
tatttgcatggttggaatgat

SEQ ID NO: 23870 - DNA, 21 bp, Artificial Sequence
  Synthetic
ctggtgacttatggtagtact

SEQ ID NO: 23871 - DNA, 21 bp, Artificial Sequence
  Synthetic
tgtggttatagtttgagttgt

SEQ ID NO: 23872 - DNA, 21 bp, Artificial Sequence
  Synthetic
aaggcgcctgggattcagtgg

SEQ ID NO: 23873 - DNA, 21 bp, Artificial Sequence
  Synthetic
gatcttattggggttcgttgg

SEQ ID NO: 23874 - DNA, 21 bp, Artificial Sequence
  Synthetic
tttatgaaggatgcgtatccg

SEQ ID NO: 23875 - DNA, 21 bp, Artificial Sequence
  Synthetic
gcgtcgctgggtagtgtgtat

SEQ ID NO: 23876 - DNA, 21 bp, Artificial Sequence
  Synthetic
cgtactactgagcagtggtgg

SEQ ID NO: 23877 - DNA, 21 bp, Artificial Sequence
  Synthetic
tcgtggatggaggattttcgg

SEQ ID NO: 23878 - DNA, 21 bp, Artificial Sequence
  Synthetic
ttggttccgcggatgtcgagt

SEQ ID NO: 23879 - DNA, 21 bp, Artificial Sequence
  Synthetic
gagcattggggggcggctagg

SEQ ID NO: 23880 - DNA, 21 bp, Artificial Sequence
  Synthetic
tttgctgtgaatctgaggcct

SEQ ID NO: 23881 - DNA, 21 bp, Artificial Sequence
  Synthetic
ttgaggattatgctgtctccg

SEQ ID NO: 23882 - DNA, 21 bp, Artificial Sequence
  Synthetic
cctgcgattagggtggttaat

SEQ ID NO: 23883 - DNA, 21 bp, Artificial Sequence
  Synthetic
actagggtgtatgagagtagt

SEQ ID NO: 23884 - DNA, 21 bp, Artificial Sequence
  Synthetic
ggggtttctttggggaagtgg

SEQ ID NO: 23885 - DNA, 21 bp, Artificial Sequence
  Synthetic
tttattgcggggtggtcgtcg

SEQ ID NO: 23886 - DNA, 21 bp, Artificial Sequence
  Synthetic
tgggtgattgggcatgttccg

SEQ ID NO: 23887 - DNA, 21 bp, Artificial Sequence
  Synthetic
ccgttggtgaggtcttatggt

SEQ ID NO: 23888 - DNA, 21 bp, Artificial Sequence
  Synthetic
ggggagcatcgtgggtcttgg

SEQ ID NO: 23889 - DNA, 21 bp, Artificial Sequence
  Synthetic
gagcataattcggcgcgttgg

SEQ ID NO: 23890 - DNA, 21 bp, Artificial Sequence
  Synthetic
gtgaggcttgggtcggtgtat

SEQ ID NO: 23891 - DNA, 21 bp, Artificial Sequence
  Synthetic
ccgtatccgggtgcttcggcg

SEQ ID NO: 23892 - DNA, 21 bp, Artificial Sequence
  Synthetic
gaggctagtggggcgcggtgg

SEQ ID NO: 23893 - DNA, 21 bp, Artificial Sequence
  Synthetic
gagatgtatcgggggtctacg

SEQ ID NO: 23894 - DNA, 21 bp, Artificial Sequence
  Synthetic
agtggtggtaattgggcttat

SEQ ID NO: 23895 - DNA, 21 bp, Artificial Sequence
  Synthetic
gctctgcctgtgtatgggcgt

SEQ ID NO: 23896 - DNA, 21 bp, Artificial Sequence
  Synthetic
aagacggattatggtcagtgg

SEQ ID NO: 23897 - DNA, 21 bp, Artificial Sequence
  Synthetic
acgaggcctatgggtagttct

SEQ ID NO: 23898 - DNA, 21 bp, Artificial Sequence
  Synthetic
gttagggtgcagctggtggcg

SEQ ID NO: 23899 - DNA, 21 bp, Artificial Sequence
  Synthetic
ttgatgactcatgggagtact

SEQ ID NO: 23900 - DNA, 21 bp, Artificial Sequence
  Synthetic
gaggtgaatcagtcgcgttgg

SEQ ID NO: 23901 - DNA, 21 bp, Artificial Sequence
  Synthetic
aattggccggcggatagttct

SEQ ID NO: 23902 - DNA, 21 bp, Artificial Sequence
  Synthetic
gataattataagttgccgatt

SEQ ID NO: 23903 - DNA, 21 bp, Artificial Sequence
  Synthetic
cctcatcagaattggtcgagt

SEQ ID NO: 23904 - DNA, 21 bp, Artificial Sequence
  Synthetic
tcgtatcttccggcgacgcat

SEQ ID NO: 23905 - DNA, 21 bp, Artificial Sequence
  Synthetic
ttgcattatggtgcggcgtcg

SEQ ID NO: 23906 - DNA, 21 bp, Artificial Sequence
  Synthetic
ttgcagattgggcgtgctcag

SEQ ID NO: 23907 - DNA, 21 bp, Artificial Sequence
  Synthetic
gttcattttcggctggatcat

SEQ ID NO: 23908 - DNA, 21 bp, Artificial Sequence
  Synthetic
tataggggtattctgattggt

SEQ ID NO: 23909 - DNA, 21 bp, Artificial Sequence
  Synthetic
ggggagtcggttggtcggtgg

SEQ ID NO: 23910 - DNA, 21 bp, Artificial Sequence
  Synthetic
cgtgctgagtcgtcttattgg

SEQ ID NO: 23911 - DNA, 21 bp, Artificial Sequence
  Synthetic
cattggaagtcggagggtcat

SEQ ID NO: 23912 - DNA, 21 bp, Artificial Sequence
  Synthetic
atgaatgctgggtttagttct

SEQ ID NO: 23913 - DNA, 21 bp, Artificial Sequence
  Synthetic
cagtatactgcttcgcattgg

SEQ ID NO: 23914 - DNA, 21 bp, Artificial Sequence
  Synthetic
gagcgtacgggtggttattgg

SEQ ID NO: 23915 - DNA, 21 bp, Artificial Sequence
  Synthetic
aataataggtgggaggctagt

SEQ ID NO: 23916 - DNA, 21 bp, Artificial Sequence
  Synthetic
tatcagtcttatgggtctagt

SEQ ID NO: 23917 - DNA, 21 bp, Artificial Sequence
  Synthetic
gtttgtcgtgctatgctgggg

SEQ ID NO: 23918 - DNA, 21 bp, Artificial Sequence
  Synthetic
gagtatattgggcatgcgcag

SEQ ID NO: 23919 - DNA, 21 bp, Artificial Sequence
  Synthetic
gggattgataggtcgcgttgg

SEQ ID NO: 23920 - DNA, 21 bp, Artificial Sequence
  Synthetic
tatcgtgtgatggggtcggct

SEQ ID NO: 23921 - DNA, 21 bp, Artificial Sequence
  Synthetic
gagcagtggggtaggtctcag

SEQ ID NO: 23922 - DNA, 21 bp, Artificial Sequence
  Synthetic
cagtggaagggtgatgcgact

SEQ ID NO: 23923 - DNA, 21 bp, Artificial Sequence
  Synthetic
aagctggatcatgcttattat

SEQ ID NO: 23924 - DNA, 21 bp, Artificial Sequence
  Synthetic
gctgttgggagtggggtttgg

SEQ ID NO: 23925 - DNA, 21 bp, Artificial Sequence
  Synthetic
ctgtttgttcatgggtcgtcg

SEQ ID NO: 23926 - DNA, 21 bp, Artificial Sequence
  Synthetic
aagcagggtcaggctgagagg

SEQ ID NO: 23927 - DNA, 21 bp, Artificial Sequence
  Synthetic
aagcatgtttcggattttagt

SEQ ID NO: 23928 - DNA, 21 bp, Artificial Sequence
  Synthetic
aagcctgagtggggttataat

SEQ ID NO: 23929 - DNA, 21 bp, Artificial Sequence
  Synthetic
gataggattggttattcgtat

SEQ ID NO: 23930 - DNA, 21 bp, Artificial Sequence
  Synthetic
aggtttactttggggccggcg

SEQ ID NO: 23931 - DNA, 21 bp, Artificial Sequence
  Synthetic
cggtggagtttgggtaatgag

SEQ ID NO: 23932 - DNA, 21 bp, Artificial Sequence
  Synthetic
aagttggagacgtcgtattgg

SEQ ID NO: 23933 - DNA, 21 bp, Artificial Sequence
  Synthetic
cgtgctagtcttgctggtgct

SEQ ID NO: 23934 - DNA, 21 bp, Artificial Sequence
  Synthetic
agtagtggttatgttggttgg

SEQ ID NO: 23935 - DNA, 21 bp, Artificial Sequence
  Synthetic
attaggcctggttgggcgatg

SEQ ID NO: 23936 - DNA, 21 bp, Artificial Sequence
  Synthetic
ggtcaggatgttagtcgttgg

SEQ ID NO: 23937 - DNA, 21 bp, Artificial Sequence
  Synthetic
gtgtggggggctattgggcct

SEQ ID NO: 23938 - DNA, 21 bp, Artificial Sequence
  Synthetic
cagaagtataatgggagtacg

SEQ ID NO: 23939 - DNA, 21 bp, Artificial Sequence
  Synthetic
cttatgctgcgtcctgatatt

SEQ ID NO: 23940 - DNA, 21 bp, Artificial Sequence
  Synthetic
tcgaggaatctggggagtgct

SEQ ID NO: 23941 - DNA, 21 bp, Artificial Sequence
  Synthetic
cggtgggcggcggatagttct

SEQ ID NO: 23942 - DNA, 21 bp, Artificial Sequence
  Synthetic
cagcgggttgtgctgagtcct

SEQ ID NO: 23943 - DNA, 21 bp, Artificial Sequence
  Synthetic
catgctcatatgggtagtatg

SEQ ID NO: 23944 - DNA, 21 bp, Artificial Sequence
  Synthetic
ctttttgggtatgggaatgtt

SEQ ID NO: 23945 - DNA, 21 bp, Artificial Sequence
  Synthetic
tttggtacgtatagtattttg

SEQ ID NO: 23946 - DNA, 21 bp, Artificial Sequence
  Synthetic
gagcctcgttggcagagttct

SEQ ID NO: 23947 - DNA, 21 bp, Artificial Sequence
  Synthetic
tcggtgcggatgggttcttcg

SEQ ID NO: 23948 - DNA, 21 bp, Artificial Sequence
  Synthetic
tataagattgagactgggtgg

SEQ ID NO: 23949 - DNA, 21 bp, Artificial Sequence
  Synthetic
gttaaggctgggtattcgtcg

SEQ ID NO: 23950 - DNA, 21 bp, Artificial Sequence
  Synthetic
gattggtctcggggggcgagt

SEQ ID NO: 23951 - DNA, 21 bp, Artificial Sequence
  Synthetic
gataagttgggttggagtgct

SEQ ID NO: 23952 - DNA, 21 bp, Artificial Sequence
  Synthetic
tctccgacggaggctcggtgg

SEQ ID NO: 23953 - DNA, 21 bp, Artificial Sequence
  Synthetic
gttgatcctgtgcgttggtcg

SEQ ID NO: 23954 - DNA, 21 bp, Artificial Sequence
  Synthetic
acgtataagattgggtatatt

SEQ ID NO: 23955 - DNA, 21 bp, Artificial Sequence
  Synthetic
gatgctgtggcggggcgttgg

SEQ ID NO: 23956 - DNA, 21 bp, Artificial Sequence
  Synthetic
ccgacgccggggtgggctagt

SEQ ID NO: 23957 - DNA, 21 bp, Artificial Sequence
  Synthetic
ggtgttgagaggggtccgtgg

SEQ ID NO: 23958 - DNA, 21 bp, Artificial Sequence
  Synthetic
ggttctgatgttgcgaggttt

SEQ ID NO: 23959 - DNA, 21 bp, Artificial Sequence
  Synthetic
ttgtctaagggtacgatttat

SEQ ID NO: 23960 - DNA, 21 bp, Artificial Sequence
  Synthetic
ggtccgaatacgtataattgg

SEQ ID NO: 23961 - DNA, 21 bp, Artificial Sequence
  Synthetic
attgttattgggttttcgtcg

SEQ ID NO: 23962 - DNA, 21 bp, Artificial Sequence
  Synthetic
tcgcggtatggggattttatg

SEQ ID NO: 23963 - DNA, 21 bp, Artificial Sequence
  Synthetic
ccttatgttggttcgtcggct

SEQ ID NO: 23964 - DNA, 21 bp, Artificial Sequence
  Synthetic
gagcggttgattcttcatccg

SEQ ID NO: 23965 - DNA, 21 bp, Artificial Sequence
  Synthetic
agttttcatggtagtgctcag

SEQ ID NO: 23966 - DNA, 21 bp, Artificial Sequence
  Synthetic
ggggaggatatgggtcgttgg

SEQ ID NO: 23967 - DNA, 21 bp, Artificial Sequence
  Synthetic
tcggctggtacttttcgtact

SEQ ID NO: 23968 - DNA, 21 bp, Artificial Sequence
  Synthetic
acggtgagttatggttcttcg

SEQ ID NO: 23969 - DNA, 21 bp, Artificial Sequence
  Synthetic
agttggcatgcgggggcgtcg

SEQ ID NO: 23970 - DNA, 21 bp, Artificial Sequence
  Synthetic
tgggcttctcttgggagtgct

SEQ ID NO: 23971 - DNA, 21 bp, Artificial Sequence
  Synthetic
ggtggtgtgtcgcggtgggat

SEQ ID NO: 23972 - DNA, 21 bp, Artificial Sequence
  Synthetic
catgagtatcttggttcttct

SEQ ID NO: 23973 - DNA, 21 bp, Artificial Sequence
  Synthetic
ggttattctaattttcatacg

SEQ ID NO: 23974 - DNA, 21 bp, Artificial Sequence
  Synthetic
cggtttgttgttgatagtgct

SEQ ID NO: 23975 - DNA, 21 bp, Artificial Sequence
  Synthetic
aagatttatagtgggagtagt

SEQ ID NO: 23976 - DNA, 21 bp, Artificial Sequence
  Synthetic
gggtggcggctggatacgcct

SEQ ID NO: 23977 - DNA, 21 bp, Artificial Sequence
  Synthetic
aagatgccgggttggtcttct

SEQ ID NO: 23978 - DNA, 21 bp, Artificial Sequence
  Synthetic
cctcttacgagtactcattgg

SEQ ID NO: 23979 - DNA, 21 bp, Artificial Sequence
  Synthetic
aagcatctggggatggctcag

SEQ ID NO: 23980 - DNA, 21 bp, Artificial Sequence
  Synthetic
aaggcggattattcttttcat

SEQ ID NO: 23981 - DNA, 21 bp, Artificial Sequence
  Synthetic
aggtttgctaatgattcgagt

SEQ ID NO: 23982 - DNA, 21 bp, Artificial Sequence
  Synthetic
ggtggggatactggtcggtgg

SEQ ID NO: 23983 - DNA, 21 bp, Artificial Sequence
  Synthetic
actacttgggctggttcgagt

SEQ ID NO: 23984 - DNA, 21 bp, Artificial Sequence
  Synthetic
agtgtgctgagggggtttaat

SEQ ID NO: 23985 - DNA, 21 bp, Artificial Sequence
  Synthetic
gggagttctagttcgatgtgg

SEQ ID NO: 23986 - DNA, 21 bp, Artificial Sequence
  Synthetic
attcgtaatggtagtatttat

SEQ ID NO: 23987 - DNA, 21 bp, Artificial Sequence
  Synthetic
acgcatgatggggtgtggtat

SEQ ID NO: 23988 - DNA, 21 bp, Artificial Sequence
  Synthetic
ccttggccgggtgcttctgcg

SEQ ID NO: 23989 - DNA, 21 bp, Artificial Sequence
  Synthetic
tggattagtttgcctgatagt

SEQ ID NO: 23990 - DNA, 21 bp, Artificial Sequence
  Synthetic
acggtgaggtatgcgatttcg

SEQ ID NO: 23991 - DNA, 21 bp, Artificial Sequence
  Synthetic
tctggtccgtatatggctagt

SEQ ID NO: 23992 - DNA, 21 bp, Artificial Sequence
  Synthetic
aggtattctcctgatgcggcg

SEQ ID NO: 23993 - DNA, 21 bp, Artificial Sequence
  Synthetic
gcgcggccgaattttagttct

SEQ ID NO: 23994 - DNA, 21 bp, Artificial Sequence
  Synthetic
tggtctgcgtatagtgagggg

SEQ ID NO: 23995 - DNA, 21 bp, Artificial Sequence
  Synthetic
aatcagtgggaggattatagg

SEQ ID NO: 23996 - DNA, 21 bp, Artificial Sequence
  Synthetic
agtccgagttggacgtatggt

SEQ ID NO: 23997 - DNA, 21 bp, Artificial Sequence
  Synthetic
actagggcggggatttatggt

SEQ ID NO: 23998 - DNA, 21 bp, Artificial Sequence
  Synthetic
aggtggtcgctgggtgatgcg

SEQ ID NO: 23999 - DNA, 21 bp, Artificial Sequence
  Synthetic
gctgttcagatgcatggttgg

SEQ ID NO: 24000 - DNA, 21 bp, Artificial Sequence
  Synthetic
tatgcgtcgtggggggcggcg

SEQ ID NO: 24001 - DNA, 21 bp, Artificial Sequence
  Synthetic
gggcgtattattctgaagaat

SEQ ID NO: 24002 - DNA, 21 bp, Artificial Sequence
  Synthetic
cttgctagggggtattcgtct

SEQ ID NO: 24003 - DNA, 21 bp, Artificial Sequence
  Synthetic
tggtctgagtggagtccgggg

SEQ ID NO: 24004 - DNA, 21 bp, Artificial Sequence
  Synthetic
ttttatagtctgggtgatgcg

SEQ ID NO: 24005 - DNA, 21 bp, Artificial Sequence
  Synthetic
gagtattataattcgtcgagt

SEQ ID NO: 24006 - DNA, 21 bp, Artificial Sequence
  Synthetic
tttgtgtttggtgagagggtt

SEQ ID NO: 24007 - DNA, 21 bp, Artificial Sequence
  Synthetic
aagtatgctatgcagagttgt

SEQ ID NO: 24008 - DNA, 21 bp, Artificial Sequence
  Synthetic
gagcctgggagtaatcgttgg

SEQ ID NO: 24009 - DNA, 21 bp, Artificial Sequence
  Synthetic
catgcgtggggtgcgattccg

SEQ ID NO: 24010 - DNA, 21 bp, Artificial Sequence
  Synthetic
tatatgtattctggttcgatg

SEQ ID NO: 24011 - DNA, 21 bp, Artificial Sequence
  Synthetic
gctcagtatacgttgccgacg

SEQ ID NO: 24012 - DNA, 21 bp, Artificial Sequence
  Synthetic
ttgatttctcatgggagttct

SEQ ID NO: 24013 - DNA, 21 bp, Artificial Sequence
  Synthetic
gtgttttctggttttagtagt

SEQ ID NO: 24014 - DNA, 21 bp, Artificial Sequence
  Synthetic
ccgtcttatggggcgatttat

SEQ ID NO: 24015 - DNA, 21 bp, Artificial Sequence
  Synthetic
atgcttgagacgtatgggcgg

SEQ ID NO: 24016 - DNA, 21 bp, Artificial Sequence
  Synthetic
tatgggtcgctttctttggtt

SEQ ID NO: 24017 - DNA, 21 bp, Artificial Sequence
  Synthetic
gattggtctcgtggtgcggcg

SEQ ID NO: 24018 - DNA, 21 bp, Artificial Sequence
  Synthetic
gagcgtattattttgagtaat

SEQ ID NO: 24019 - DNA, 21 bp, Artificial Sequence
  Synthetic
gaggagaatcgggttcggtgg

SEQ ID NO: 24020 - DNA, 21 bp, Artificial Sequence
  Synthetic
cctcgtattatgctgtcgccg

SEQ ID NO: 24021 - DNA, 21 bp, Artificial Sequence
  Synthetic
ctgtttgttggtgggagtacg

SEQ ID NO: 24022 - DNA, 21 bp, Artificial Sequence
  Synthetic
ggtgtgtgggggcatcttcct

SEQ ID NO: 24023 - DNA, 21 bp, Artificial Sequence
  Synthetic
ggttctcggtttgatctgtct

SEQ ID NO: 24024 - DNA, 21 bp, Artificial Sequence
  Synthetic
ggtctggtgcataattggagt

SEQ ID NO: 24025 - DNA, 21 bp, Artificial Sequence
  Synthetic
tggcttcctggttttagtcag

SEQ ID NO: 24026 - DNA, 21 bp, Artificial Sequence
  Synthetic
gagcgttggggtgctgctagt

SEQ ID NO: 24027 - DNA, 21 bp, Artificial Sequence
  Synthetic
tttaatcctctgtttagttcg

SEQ ID NO: 24028 - DNA, 21 bp, Artificial Sequence
  Synthetic
ctgtatgttgggtttagtagt

SEQ ID NO: 24029 - DNA, 21 bp, Artificial Sequence
  Synthetic
tctaggtttgggatgagtact

SEQ ID NO: 24030 - DNA, 21 bp, Artificial Sequence
  Synthetic
cctgctaatagtgggttgtgg

SEQ ID NO: 24031 - DNA, 21 bp, Artificial Sequence
  Synthetic
ggtcagtggcagggttcgtcg

SEQ ID NO: 24032 - DNA, 21 bp, Artificial Sequence
  Synthetic
agttatttggcgggttttagt

SEQ ID NO: 24033 - DNA, 21 bp, Artificial Sequence
  Synthetic
atgcatgtgggtggggctagt

SEQ ID NO: 24034 - DNA, 21 bp, Artificial Sequence
  Synthetic
gagcgtcatgcgggtccgtgg

SEQ ID NO: 24035 - DNA, 21 bp, Artificial Sequence
  Synthetic
atgattcggcaggggtctgct

SEQ ID NO: 24036 - DNA, 21 bp, Artificial Sequence
  Synthetic
atgagggagtggggttctagt

SEQ ID NO: 24037 - DNA, 21 bp, Artificial Sequence
  Synthetic
gagcgtctgatgggtagttcg

SEQ ID NO: 24038 - DNA, 21 bp, Artificial Sequence
  Synthetic
aggagtaatgctagtgtttat

SEQ ID NO: 24039 - DNA, 21 bp, Artificial Sequence
  Synthetic
ttgtcttatggtctggcgagt

SEQ ID NO: 24040 - DNA, 21 bp, Artificial Sequence
  Synthetic
tgtattggttatgttactgcg

SEQ ID NO: 24041 - DNA, 21 bp, Artificial Sequence
  Synthetic
cctatggggtctgctcattgg

SEQ ID NO: 24042 - DNA, 21 bp, Artificial Sequence
  Synthetic
ggtaatgattcggctcggtgg

SEQ ID NO: 24043 - DNA, 21 bp, Artificial Sequence
  Synthetic
gcgcttcatgggtatagtatt

SEQ ID NO: 24044 - DNA, 21 bp, Artificial Sequence
  Synthetic
acgactcatgatgggaggtgg

SEQ ID NO: 24045 - DNA, 21 bp, Artificial Sequence
  Synthetic
cggagtctggcggagcattgg

SEQ ID NO: 24046 - DNA, 21 bp, Artificial Sequence
  Synthetic
gagcggccttttcaggcttcg

SEQ ID NO: 24047 - DNA, 21 bp, Artificial Sequence
  Synthetic
ccgcggttttctcttgatgcg

SEQ ID NO: 24048 - DNA, 21 bp, Artificial Sequence
  Synthetic
attgcgaagttttttagttcg

SEQ ID NO: 24049 - DNA, 21 bp, Artificial Sequence
  Synthetic
cttcatgtggcttggtcttct

SEQ ID NO: 24050 - DNA, 21 bp, Artificial Sequence
  Synthetic
ggtgtgtctcagtctatgtgg

SEQ ID NO: 24051 - DNA, 21 bp, Artificial Sequence
  Synthetic
ggggagccgagtgggcgttgg

SEQ ID NO: 24052 - DNA, 21 bp, Artificial Sequence
  Synthetic
ttgacgtattctagtgcgctg

SEQ ID NO: 24053 - DNA, 21 bp, Artificial Sequence
  Synthetic
gatcgtgggtcggggatttgg

SEQ ID NO: 24054 - DNA, 21 bp, Artificial Sequence
  Synthetic
tataagtatgagggtagtacg

SEQ ID NO: 24055 - DNA, 21 bp, Artificial Sequence
  Synthetic
gcgcatcagtttgcttatgct

SEQ ID NO: 24056 - DNA, 21 bp, Artificial Sequence
  Synthetic
gcggcgtggggggggtcgtcg

SEQ ID NO: 24057 - DNA, 21 bp, Artificial Sequence
  Synthetic
cttgggtattcgttttcggcg

SEQ ID NO: 24058 - DNA, 21 bp, Artificial Sequence
  Synthetic
catattactttgaagtattcg

SEQ ID NO: 24059 - DNA, 21 bp, Artificial Sequence
  Synthetic
cgttatgtgggggatccttcg

SEQ ID NO: 24060 - DNA, 21 bp, Artificial Sequence
  Synthetic
actttgcatggttggagtgcg

SEQ ID NO: 24061 - DNA, 21 bp, Artificial Sequence
  Synthetic
tatctgatgccttttggtgat

SEQ ID NO: 24062 - DNA, 21 bp, Artificial Sequence
  Synthetic
cctgcgacgggggcttattgg

SEQ ID NO: 24063 - DNA, 21 bp, Artificial Sequence
  Synthetic
tgttttcctattgcggattgt

SEQ ID NO: 24064 - DNA, 21 bp, Artificial Sequence
  Synthetic
tatggggctcttgctgcgatg

SEQ ID NO: 24065 - DNA, 21 bp, Artificial Sequence
  Synthetic
gtttttcttggttcgagtact

SEQ ID NO: 24066 - DNA, 21 bp, Artificial Sequence
  Synthetic
ctggtgattaggcatgcttcg

SEQ ID NO: 24067 - DNA, 21 bp, Artificial Sequence
  Synthetic
agttggcatggtgcttcgagt

SEQ ID NO: 24068 - DNA, 21 bp, Artificial Sequence
  Synthetic
atgctggctggttataatgtt

SEQ ID NO: 24069 - DNA, 21 bp, Artificial Sequence
  Synthetic
acgccgtttactgagcattgg

SEQ ID NO: 24070 - DNA, 21 bp, Artificial Sequence
  Synthetic
tttcgtctgggttatcctgct

SEQ ID NO: 24071 - DNA, 21 bp, Artificial Sequence
  Synthetic
catcatatgcattttgagaag

SEQ ID NO: 24072 - DNA, 21 bp, Artificial Sequence
  Synthetic
tggagtaattttgggagtgct

SEQ ID NO: 24073 - DNA, 21 bp, Artificial Sequence
  Synthetic
cggtatagtatggatagtagt

SEQ ID NO: 24074 - DNA, 21 bp, Artificial Sequence
  Synthetic
gcgttggcgcggtatgggacg

SEQ ID NO: 24075 - DNA, 21 bp, Artificial Sequence
  Synthetic
cattggaagcatgatggtcct

SEQ ID NO: 24076 - DNA, 21 bp, Artificial Sequence
  Synthetic
cttgataaggggtcggtttat

SEQ ID NO: 24077 - DNA, 21 bp, Artificial Sequence
  Synthetic
attctggcgggttatcgtgat

SEQ ID NO: 24078 - DNA, 21 bp, Artificial Sequence
  Synthetic
tgttttattggtggggctcag

SEQ ID NO: 24079 - DNA, 21 bp, Artificial Sequence
  Synthetic
gggcttccttatcttagttcg

SEQ ID NO: 24080 - DNA, 21 bp, Artificial Sequence
  Synthetic
tggaagtcgttgcctacgctg

SEQ ID NO: 24081 - DNA, 21 bp, Artificial Sequence
  Synthetic
cttactgatcggcctgcgagg

SEQ ID NO: 24082 - DNA, 21 bp, Artificial Sequence
  Synthetic
tctaggattatggggagtgtt

SEQ ID NO: 24083 - DNA, 21 bp, Artificial Sequence
  Synthetic
catttgggggggtatggtttt

SEQ ID NO: 24084 - DNA, 21 bp, Artificial Sequence
  Synthetic
attattctggggtatagtact

SEQ ID NO: 24085 - DNA, 21 bp, Artificial Sequence
  Synthetic
agggagcatgatgggaggtgg

SEQ ID NO: 24086 - DNA, 21 bp, Artificial Sequence
  Synthetic
gcgcgttgtggggtggggtgt

SEQ ID NO: 24087 - DNA, 21 bp, Artificial Sequence
  Synthetic
cctccgcatatgctgccgatt

SEQ ID NO: 24088 - DNA, 21 bp, Artificial Sequence
  Synthetic
gataatacgtcgaatcgttgg

SEQ ID NO: 24089 - DNA, 21 bp, Artificial Sequence
  Synthetic
ggtatggtggagggtcgttgg

SEQ ID NO: 24090 - DNA, 21 bp, Artificial Sequence
  Synthetic
gatcggtttcaggggtatgcg

SEQ ID NO: 24091 - DNA, 21 bp, Artificial Sequence
  Synthetic
agtaagactatggggagtgtt

SEQ ID NO: 24092 - DNA, 21 bp, Artificial Sequence
  Synthetic
aatttggagacggcgtattgg

SEQ ID NO: 24093 - DNA, 21 bp, Artificial Sequence
  Synthetic
ctgctgcctaattggtctcat

SEQ ID NO: 24094 - DNA, 21 bp, Artificial Sequence
  Synthetic
tggggtatttcggaggggtat

SEQ ID NO: 24095 - DNA, 21 bp, Artificial Sequence
  Synthetic
ggggttgatcttgggcggtat

SEQ ID NO: 24096 - DNA, 21 bp, Artificial Sequence
  Synthetic
tttcttcgtggttataatgat

SEQ ID NO: 24097 - DNA, 21 bp, Artificial Sequence
  Synthetic
tcgcatcatagtggtatttgg

SEQ ID NO: 24098 - DNA, 21 bp, Artificial Sequence
  Synthetic
tggagtcttcctgatcatggg

SEQ ID NO: 24099 - DNA, 21 bp, Artificial Sequence
  Synthetic
atgggtgcgcctggtcagtgg

SEQ ID NO: 24100 - DNA, 21 bp, Artificial Sequence
  Synthetic
gggaggtttgctggggagtgg

SEQ ID NO: 24101 - DNA, 21 bp, Artificial Sequence
  Synthetic
gatggtcgttttcttgctcag

SEQ ID NO: 24102 - DNA, 21 bp, Artificial Sequence
  Synthetic
gcgggggtgagtaggtgggat

SEQ ID NO: 24103 - DNA, 21 bp, Artificial Sequence
  Synthetic
aagcagttttcttttcctgtt

SEQ ID NO: 24104 - DNA, 21 bp, Artificial Sequence
  Synthetic
tttatgatgcgggggtcggct

SEQ ID NO: 24105 - DNA, 21 bp, Artificial Sequence
  Synthetic
gatcagccttataggggtttt

SEQ ID NO: 24106 - DNA, 21 bp, Artificial Sequence
  Synthetic
tatgatacgattcgtgggtgg

SEQ ID NO: 24107 - DNA, 21 bp, Artificial Sequence
  Synthetic
ggtgaggtgccgcgttgggct

SEQ ID NO: 24108 - DNA, 21 bp, Artificial Sequence
  Synthetic
cttatgtatcttgggtcgcag

SEQ ID NO: 24109 - DNA, 21 bp, Artificial Sequence
  Synthetic
attgcggcttttggttctgcg

SEQ ID NO: 24110 - DNA, 21 bp, Artificial Sequence
  Synthetic
ccttatcatcagtatagtgct

SEQ ID NO: 24111 - DNA, 21 bp, Artificial Sequence
  Synthetic
tttgaggatcgtgctaggtat

SEQ ID NO: 24112 - DNA, 21 bp, Artificial Sequence
  Synthetic
ttgtgggatcatgggagttcg

SEQ ID NO: 24113 - DNA, 21 bp, Artificial Sequence
  Synthetic
cctgtggcgcttgggccttgg

SEQ ID NO: 24114 - DNA, 21 bp, Artificial Sequence
  Synthetic
cagtttgttggtcatgctgcg

SEQ ID NO: 24115 - DNA, 21 bp, Artificial Sequence
  Synthetic
gctgtgtggatggggagttcg

SEQ ID NO: 24116 - DNA, 21 bp, Artificial Sequence
  Synthetic
gaggggactgtgggtcggtgg

SEQ ID NO: 24117 - DNA, 21 bp, Artificial Sequence
  Synthetic
cctgtgggtagtgctctttgg

SEQ ID NO: 24118 - DNA, 21 bp, Artificial Sequence
  Synthetic
ccgttgttgcatctgagttcg

SEQ ID NO: 24119 - DNA, 21 bp, Artificial Sequence
  Synthetic
acttttactcatggtgcttct

SEQ ID NO: 24120 - DNA, 21 bp, Artificial Sequence
  Synthetic
tatgggagtttgaattcgttt

SEQ ID NO: 24121 - DNA, 21 bp, Artificial Sequence
  Synthetic
tggccttatgggcgtgcggag

SEQ ID NO: 24122 - DNA, 21 bp, Artificial Sequence
  Synthetic
tgggggagtttggcgggtgtt

SEQ ID NO: 24123 - DNA, 21 bp, Artificial Sequence
  Synthetic
attgatggtgttgttcggtgg

SEQ ID NO: 24124 - DNA, 21 bp, Artificial Sequence
  Synthetic
tttcatgttgcgtattcgagt

SEQ ID NO: 24125 - DNA, 21 bp, Artificial Sequence
  Synthetic
atgtggccggggactgctcag

SEQ ID NO: 24126 - DNA, 21 bp, Artificial Sequence
  Synthetic
aattgggagcatagtgggtgg

SEQ ID NO: 24127 - DNA, 21 bp, Artificial Sequence
  Synthetic
tgggtttcgcatggttcttcg

SEQ ID NO: 24128 - DNA, 21 bp, Artificial Sequence
  Synthetic
aggtatagtctggatgcggcg

SEQ ID NO: 24129 - DNA, 21 bp, Artificial Sequence
  Synthetic
aagactgcgtgggataatacg

SEQ ID NO: 24130 - DNA, 21 bp, Artificial Sequence
  Synthetic
ttgcctccgaggcatcttttt

SEQ ID NO: 24131 - DNA, 21 bp, Artificial Sequence
  Synthetic
tttggggtgcagtggagtagt

SEQ ID NO: 24132 - DNA, 21 bp, Artificial Sequence
  Synthetic
gggtggaagggtgattcgtcg

SEQ ID NO: 24133 - DNA, 21 bp, Artificial Sequence
  Synthetic
ggggctacgtcgagtatgtgg

SEQ ID NO: 24134 - DNA, 21 bp, Artificial Sequence
  Synthetic
ctgtatgttggggatgcttcg

SEQ ID NO: 24135 - DNA, 21 bp, Artificial Sequence
  Synthetic
tgttatcctagggcggagtgt

SEQ ID NO: 24136 - DNA, 21 bp, Artificial Sequence
  Synthetic
tcgcgggttggtttttcgacg

SEQ ID NO: 24137 - DNA, 21 bp, Artificial Sequence
  Synthetic
gcgatgtggggtggtgcttct

SEQ ID NO: 24138 - DNA, 21 bp, Artificial Sequence
  Synthetic
acgccttataagatgccgacg

SEQ ID NO: 24139 - DNA, 21 bp, Artificial Sequence
  Synthetic
actcctcattttgggttggcg

SEQ ID NO: 24140 - DNA, 21 bp, Artificial Sequence
  Synthetic
cggttttcgggtgatgcgagt

SEQ ID NO: 24141 - DNA, 21 bp, Artificial Sequence
  Synthetic
gagatgctggggtgggcgagt

SEQ ID NO: 24142 - DNA, 21 bp, Artificial Sequence
  Synthetic
gttgcgactgggtggtcgtcg

SEQ ID NO: 24143 - DNA, 21 bp, Artificial Sequence
  Synthetic
agggcgttgggtctgtcgtcg

SEQ ID NO: 24144 - DNA, 21 bp, Artificial Sequence
  Synthetic
agttatcctggtgcggcttgg

SEQ ID NO: 24145 - DNA, 21 bp, Artificial Sequence
  Synthetic
acgctgcatacttatcatacg

SEQ ID NO: 24146 - DNA, 21 bp, Artificial Sequence
  Synthetic
tgtggtgtgcggacttgtggt

SEQ ID NO: 24147 - DNA, 21 bp, Artificial Sequence
  Synthetic
gatgctgctacgtctcggtgg

SEQ ID NO: 24148 - DNA, 21 bp, Artificial Sequence
  Synthetic
gatatgtatgtgcttccgcat

SEQ ID NO: 24149 - DNA, 21 bp, Artificial Sequence
  Synthetic
ttggcgctgaattgggctagt

SEQ ID NO: 24150 - DNA, 21 bp, Artificial Sequence
  Synthetic
ccttctgatattgcgcgttat

SEQ ID NO: 24151 - DNA, 21 bp, Artificial Sequence
  Synthetic
aggcatgttggggagtcttgg

SEQ ID NO: 24152 - DNA, 21 bp, Artificial Sequence
  Synthetic
gataattggcgtggggctcag

SEQ ID NO: 24153 - DNA, 21 bp, Artificial Sequence
  Synthetic
gctgctagtacgtcttattgg

SEQ ID NO: 24154 - DNA, 21 bp, Artificial Sequence
  Synthetic
ccggagcctgtgtggaatagt

SEQ ID NO: 24155 - DNA, 21 bp, Artificial Sequence
  Synthetic
gatgtgaggtttggggctagt

SEQ ID NO: 24156 - DNA, 21 bp, Artificial Sequence
  Synthetic
gaggcgcatctggggcggtgg

SEQ ID NO: 24157 - DNA, 21 bp, Artificial Sequence
  Synthetic
agtcctgggtttggggtggct

SEQ ID NO: 24158 - DNA, 21 bp, Artificial Sequence
  Synthetic
tggagtcttgctggtagtact

SEQ ID NO: 24159 - DNA, 21 bp, Artificial Sequence
  Synthetic
gcttttcctggtgggtcggcg

SEQ ID NO: 24160 - DNA, 21 bp, Artificial Sequence
  Synthetic
aataatgagaggtcgggtaag

SEQ ID NO: 24161 - DNA, 21 bp, Artificial Sequence
  Synthetic
aatacttttgaggggaggtgg

SEQ ID NO: 24162 - DNA, 21 bp, Artificial Sequence
  Synthetic
gatcgggggcggacggttaat

SEQ ID NO: 24163 - DNA, 21 bp, Artificial Sequence
  Synthetic
ttgcatgtgcctggggctagg

SEQ ID NO: 24164 - DNA, 21 bp, Artificial Sequence
  Synthetic
tggcggttgtctggtctgcct

SEQ ID NO: 24165 - DNA, 21 bp, Artificial Sequence
  Synthetic
ccgtatactagttattctgcg

SEQ ID NO: 24166 - DNA, 21 bp, Artificial Sequence
  Synthetic
tattcgtatcttctttctccg

SEQ ID NO: 24167 - DNA, 21 bp, Artificial Sequence
  Synthetic
atggttgagtttggtagtgcg

SEQ ID NO: 24168 - DNA, 21 bp, Artificial Sequence
  Synthetic
gatgattttagtgcgaggtat

SEQ ID NO: 24169 - DNA, 21 bp, Artificial Sequence
  Synthetic
aatagggctctggggagttct

SEQ ID NO: 24170 - DNA, 21 bp, Artificial Sequence
  Synthetic
tggccggggcttggtagttct

SEQ ID NO: 24171 - DNA, 21 bp, Artificial Sequence
  Synthetic
ggtgttcatgctgggtattat

SEQ ID NO: 24172 - DNA, 21 bp, Artificial Sequence
  Synthetic
tggagggttgcgggtgctgct

SEQ ID NO: 24173 - DNA, 21 bp, Artificial Sequence
  Synthetic
cgttttcttggtagtagtact

SEQ ID NO: 24174 - DNA, 21 bp, Artificial Sequence
  Synthetic
tgggcttatgagggtagtgcg

SEQ ID NO: 24175 - DNA, 21 bp, Artificial Sequence
  Synthetic
gatcgtcagcatgggtcgtcg

SEQ ID NO: 24176 - DNA, 21 bp, Artificial Sequence
  Synthetic
cttgtggctaattatagttcg

SEQ ID NO: 24177 - DNA, 21 bp, Artificial Sequence
  Synthetic
ttgagggtggggtttagtgct

SEQ ID NO: 24178 - DNA, 21 bp, Artificial Sequence
  Synthetic
gggcatccgaattgggctgct

SEQ ID NO: 24179 - DNA, 21 bp, Artificial Sequence
  Synthetic
atgtttgttggttttagtgcg

SEQ ID NO: 24180 - DNA, 21 bp, Artificial Sequence
  Synthetic
tatactcttgcgggtggtttt

SEQ ID NO: 24181 - DNA, 21 bp, Artificial Sequence
  Synthetic
gatttttctcgtggggctagt

SEQ ID NO: 24182 - DNA, 21 bp, Artificial Sequence
  Synthetic
attcctggggaggctaagtgg

SEQ ID NO: 24183 - DNA, 21 bp, Artificial Sequence
  Synthetic
cttaggtatgggggtagtgtg

SEQ ID NO: 24184 - DNA, 21 bp, Artificial Sequence
  Synthetic
ttggagtggcagggtagttcg

SEQ ID NO: 24185 - DNA, 21 bp, Artificial Sequence
  Synthetic
agtccggtttggattagtagt

SEQ ID NO: 24186 - DNA, 21 bp, Artificial Sequence
  Synthetic
gtgttttcgcttactccgatt

SEQ ID NO: 24187 - DNA, 21 bp, Artificial Sequence
  Synthetic
gttagtgtgggtcatatttat

SEQ ID NO: 24188 - DNA, 21 bp, Artificial Sequence
  Synthetic
gggattgatctttctcggtgg

SEQ ID NO: 24189 - DNA, 21 bp, Artificial Sequence
  Synthetic
atgtggcctgctagtgcgact

SEQ ID NO: 24190 - DNA, 21 bp, Artificial Sequence
  Synthetic
cgggaggattatcgtggttgg

SEQ ID NO: 24191 - DNA, 21 bp, Artificial Sequence
  Synthetic
tggacgttgcctctggggggt

SEQ ID NO: 24192 - DNA, 21 bp, Artificial Sequence
  Synthetic
gcggctccttgggcttcgagt

SEQ ID NO: 24193 - DNA, 21 bp, Artificial Sequence
  Synthetic
acgagtgatcgggcgatttgg

SEQ ID NO: 24194 - DNA, 21 bp, Artificial Sequence
  Synthetic
gagattttgccttataggact

SEQ ID NO: 24195 - DNA, 21 bp, Artificial Sequence
  Synthetic
acgcggtctgagtggagttct

SEQ ID NO: 24196 - DNA, 21 bp, Artificial Sequence
  Synthetic
caggttacgcatggtagttcg

SEQ ID NO: 24197 - DNA, 21 bp, Artificial Sequence
  Synthetic
acgtttgttgggtattcgtct

SEQ ID NO: 24198 - DNA, 21 bp, Artificial Sequence
  Synthetic
attatgtttcatggttctgct

SEQ ID NO: 24199 - DNA, 21 bp, Artificial Sequence
  Synthetic
ggggtgggtgaggtgcggtgg

SEQ ID NO: 24200 - DNA, 21 bp, Artificial Sequence
  Synthetic
actaattttgggtatgctcag

SEQ ID NO: 24201 - DNA, 21 bp, Artificial Sequence
  Synthetic
gttcataggtatgagattagt

SEQ ID NO: 24202 - DNA, 21 bp, Artificial Sequence
  Synthetic
ggtatgtggggtgctgttgtt

SEQ ID NO: 24203 - DNA, 21 bp, Artificial Sequence
  Synthetic
aggtatcctcatgattctgcg

SEQ ID NO: 24204 - DNA, 21 bp, Artificial Sequence
  Synthetic
agttggccgggtggtgctacg

SEQ ID NO: 24205 - DNA, 21 bp, Artificial Sequence
  Synthetic
tttgatattgggccgcgtcct

SEQ ID NO: 24206 - DNA, 21 bp, Artificial Sequence
  Synthetic
gatgctgttgggaatcggtgg

SEQ ID NO: 24207 - DNA, 21 bp, Artificial Sequence
  Synthetic
gttatttggaatggtgcggcg

SEQ ID NO: 24208 - DNA, 21 bp, Artificial Sequence
  Synthetic
gagtttattgggggttcgagt

SEQ ID NO: 24209 - DNA, 21 bp, Artificial Sequence
  Synthetic
tgggtgcctatgggttctagt

SEQ ID NO: 24210 - DNA, 21 bp, Artificial Sequence
  Synthetic
tggaattatggtggttctgcg

SEQ ID NO: 24211 - DNA, 21 bp, Artificial Sequence
  Synthetic
gttcgtctgaatccggatcgg

SEQ ID NO: 24212 - DNA, 21 bp, Artificial Sequence
  Synthetic
tggagtaggtttacggagggg

SEQ ID NO: 24213 - DNA, 21 bp, Artificial Sequence
  Synthetic
gagtttagtatgaaggggtat

SEQ ID NO: 24214 - DNA, 21 bp, Artificial Sequence
  Synthetic
gagtattatccgcagggttcg

SEQ ID NO: 24215 - DNA, 21 bp, Artificial Sequence
  Synthetic
ttgtgggcggggtcttcgcag

SEQ ID NO: 24216 - DNA, 21 bp, Artificial Sequence
  Synthetic
atgcagcatatggggtcgact

SEQ ID NO: 24217 - DNA, 21 bp, Artificial Sequence
  Synthetic
agtacgtatgatggtcgttgg

SEQ ID NO: 24218 - DNA, 21 bp, Artificial Sequence
  Synthetic
gtgtttgcgcagggggcgagg

SEQ ID NO: 24219 - DNA, 21 bp, Artificial Sequence
  Synthetic
agggagaggattgggccgtgg

SEQ ID NO: 24220 - DNA, 21 bp, Artificial Sequence
  Synthetic
tctgttcgtctgggttctact

SEQ ID NO: 24221 - DNA, 21 bp, Artificial Sequence
  Synthetic
attgttcatggtatggctcag

SEQ ID NO: 24222 - DNA, 21 bp, Artificial Sequence
  Synthetic
aagtttgcggagaatcgtcat

SEQ ID NO: 24223 - DNA, 21 bp, Artificial Sequence
  Synthetic
gcgcatgcgacgggttattgg

SEQ ID NO: 24224 - DNA, 21 bp, Artificial Sequence
  Synthetic
gggacggatattagtaggtgg

SEQ ID NO: 24225 - DNA, 21 bp, Artificial Sequence
  Synthetic
cagacgcataatccgttgaag

SEQ ID NO: 24226 - DNA, 21 bp, Artificial Sequence
  Synthetic
agggcttatgatctgtctctg

SEQ ID NO: 24227 - DNA, 21 bp, Artificial Sequence
  Synthetic
aggtcggttgggcagatttat

SEQ ID NO: 24228 - DNA, 21 bp, Artificial Sequence
  Synthetic
tatttgcgtttgggttcgagt

SEQ ID NO: 24229 - DNA, 21 bp, Artificial Sequence
  Synthetic
actgagcagagtcgttgggcg

SEQ ID NO: 24230 - DNA, 21 bp, Artificial Sequence
  Synthetic
tggagtatttataaggagtcg

SEQ ID NO: 24231 - DNA, 21 bp, Artificial Sequence
  Synthetic
agtgagaatcctgggcgttgg

SEQ ID NO: 24232 - DNA, 21 bp, Artificial Sequence
  Synthetic
tgggcgacttggcatgaggcg

SEQ ID NO: 24233 - DNA, 21 bp, Artificial Sequence
  Synthetic
cctccgggtgggtggtctagt

SEQ ID NO: 24234 - DNA, 21 bp, Artificial Sequence
  Synthetic
cctcctgatagtgcgttgtgg

SEQ ID NO: 24235 - DNA, 21 bp, Artificial Sequence
  Synthetic
ggtgatcctgctgctcgttat

SEQ ID NO: 24236 - DNA, 21 bp, Artificial Sequence
  Synthetic
cttcatagtcatggttctagt

SEQ ID NO: 24237 - DNA, 21 bp, Artificial Sequence
  Synthetic
gcggttccgctgcaggcgtgg

SEQ ID NO: 24238 - DNA, 21 bp, Artificial Sequence
  Synthetic
gttattaggatggggtctgct

SEQ ID NO: 24239 - DNA, 21 bp, Artificial Sequence
  Synthetic
gatgggcatgatggtcggtgg

SEQ ID NO: 24240 - DNA, 21 bp, Artificial Sequence
  Synthetic
tttcatatgtcggtggggttg

SEQ ID NO: 24241 - DNA, 21 bp, Artificial Sequence
  Synthetic
ccgtatcctggtgctagtcat

SEQ ID NO: 24242 - DNA, 21 bp, Artificial Sequence
  Synthetic
gcggcgcatgagggtcgttgg

SEQ ID NO: 24243 - DNA, 21 bp, Artificial Sequence
  Synthetic
gatcatgggtgggggtcgtct

SEQ ID NO: 24244 - DNA, 21 bp, Artificial Sequence
  Synthetic
gatcttgattctggtcgttgg

SEQ ID NO: 24245 - DNA, 21 bp, Artificial Sequence
  Synthetic
gatgctaatagtggtaggtgg

SEQ ID NO: 24246 - DNA, 21 bp, Artificial Sequence
  Synthetic
aatcgtgctttggggagttcg

SEQ ID NO: 24247 - DNA, 21 bp, Artificial Sequence
  Synthetic
ttgtttcctggggagtctcgt

SEQ ID NO: 24248 - DNA, 21 bp, Artificial Sequence
  Synthetic
ggggctgatactgctcgttgg

SEQ ID NO: 24249 - DNA, 21 bp, Artificial Sequence
  Synthetic
gttaattatagtgcgtctatt

SEQ ID NO: 24250 - DNA, 21 bp, Artificial Sequence
  Synthetic
ttgtggacggggctgtcttcg

SEQ ID NO: 24251 - DNA, 21 bp, Artificial Sequence
  Synthetic
cataatatttatgatcgggcg

SEQ ID NO: 24252 - DNA, 21 bp, Artificial Sequence
  Synthetic
tggacttatgggggttctgct

SEQ ID NO: 24253 - DNA, 21 bp, Artificial Sequence
  Synthetic
actgctgatcttgctcgttgg

SEQ ID NO: 24254 - DNA, 21 bp, Artificial Sequence
  Synthetic
cctgcgtgggataataggcct

SEQ ID NO: 24255 - DNA, 21 bp, Artificial Sequence
  Synthetic
tggcagattcatgggtcgtct

SEQ ID NO: 24256 - DNA, 21 bp, Artificial Sequence
  Synthetic
gagaataatagtggtaggtgg

SEQ ID NO: 24257 - DNA, 21 bp, Artificial Sequence
  Synthetic
gtgtatttttctggttctctg

SEQ ID NO: 24258 - DNA, 21 bp, Artificial Sequence
  Synthetic
ccgaggtttggtcttagtagt

SEQ ID NO: 24259 - DNA, 21 bp, Artificial Sequence
  Synthetic
cagatgtatcagcttcctaat

SEQ ID NO: 24260 - DNA, 21 bp, Artificial Sequence
  Synthetic
acgcgggctccggggatttgg

SEQ ID NO: 24261 - DNA, 21 bp, Artificial Sequence
  Synthetic
cctgggaagggttattcgtcg

SEQ ID NO: 24262 - DNA, 21 bp, Artificial Sequence
  Synthetic
tggaagacggctggggctcag

SEQ ID NO: 24263 - DNA, 21 bp, Artificial Sequence
  Synthetic
tgggctgggttggggagttcg

SEQ ID NO: 24264 - DNA, 21 bp, Artificial Sequence
  Synthetic
agtcatattgggtttagtgcg

SEQ ID NO: 24265 - DNA, 21 bp, Artificial Sequence
  Synthetic
cagactagtcatcagtcgtgg

SEQ ID NO: 24266 - DNA, 21 bp, Artificial Sequence
  Synthetic
cggacgtctcatgatttttat

SEQ ID NO: 24267 - DNA, 21 bp, Artificial Sequence
  Synthetic
ttggtttatgggagggatctt

SEQ ID NO: 24268 - DNA, 21 bp, Artificial Sequence
  Synthetic
catgctcctgggtgggctagt

SEQ ID NO: 24269 - DNA, 21 bp, Artificial Sequence
  Synthetic
tttaagccttgggttaatgag

SEQ ID NO: 24270 - DNA, 21 bp, Artificial Sequence
  Synthetic
gcgcgtgctttggggtcttct

SEQ ID NO: 24271 - DNA, 21 bp, Artificial Sequence
  Synthetic
gagtggccgggggggagtgct

SEQ ID NO: 24272 - DNA, 21 bp, Artificial Sequence
  Synthetic
aattggactcaggctattggt

SEQ ID NO: 24273 - DNA, 21 bp, Artificial Sequence
  Synthetic
ttggtttatatgggttctacg

SEQ ID NO: 24274 - DNA, 21 bp, Artificial Sequence
  Synthetic
atggcttatcatggttcgact

SEQ ID NO: 24275 - DNA, 21 bp, Artificial Sequence
  Synthetic
agtgcttatcatggtagtact

SEQ ID NO: 24276 - DNA, 21 bp, Artificial Sequence
  Synthetic
gggccggatattgcgcgttat

SEQ ID NO: 24277 - DNA, 21 bp, Artificial Sequence
  Synthetic
cctagggctgggttttcgatg

SEQ ID NO: 24278 - DNA, 21 bp, Artificial Sequence
  Synthetic
gatagggtgcggggttcgact

SEQ ID NO: 24279 - DNA, 21 bp, Artificial Sequence
  Synthetic
ggtgttaatgctggtgcttgg

SEQ ID NO: 24280 - DNA, 21 bp, Artificial Sequence
  Synthetic
tctttttctcatggtagtcag

SEQ ID NO: 24281 - DNA, 21 bp, Artificial Sequence
  Synthetic
gatcggcagattccggggagg

SEQ ID NO: 24282 - DNA, 21 bp, Artificial Sequence
  Synthetic
cgggtttctcctggtgatcgt

SEQ ID NO: 24283 - DNA, 21 bp, Artificial Sequence
  Synthetic
tatgggacgttggcttttatg

SEQ ID NO: 24284 - DNA, 21 bp, Artificial Sequence
  Synthetic
acgaggtcgggtatggctcag

SEQ ID NO: 24285 - DNA, 21 bp, Artificial Sequence
  Synthetic
cggtttggtggtgatagtact

SEQ ID NO: 24286 - DNA, 21 bp, Artificial Sequence
  Synthetic
ggtggggtgaatcatgtgagg

SEQ ID NO: 24287 - DNA, 21 bp, Artificial Sequence
  Synthetic
tttgagtatggtggttcgcag

SEQ ID NO: 24288 - DNA, 21 bp, Artificial Sequence
  Synthetic
tgggatcatgcgcgtggttat

SEQ ID NO: 24289 - DNA, 21 bp, Artificial Sequence
  Synthetic
atggatcatgttgcgcggtgg

SEQ ID NO: 24290 - DNA, 21 bp, Artificial Sequence
  Synthetic
aagattggtgagggttttcgg

SEQ ID NO: 24291 - DNA, 21 bp, Artificial Sequence
  Synthetic
ggttatgtggattttggttat

SEQ ID NO: 24292 - DNA, 21 bp, Artificial Sequence
  Synthetic
ctgatgtattctactgggctt

SEQ ID NO: 24293 - DNA, 21 bp, Artificial Sequence
  Synthetic
ccttatcctgcttatagtagt

SEQ ID NO: 24294 - DNA, 21 bp, Artificial Sequence
  Synthetic
gcgttttatggtgggtctgcg

SEQ ID NO: 24295 - DNA, 21 bp, Artificial Sequence
  Synthetic
gggtatgcggagtttaagttt

SEQ ID NO: 24296 - DNA, 21 bp, Artificial Sequence
  Synthetic
ccgaatgattatgggaggtat

SEQ ID NO: 24297 - DNA, 21 bp, Artificial Sequence
  Synthetic
cggtttcctgggacttcgtcg

SEQ ID NO: 24298 - DNA, 21 bp, Artificial Sequence
  Synthetic
tttacgatggtggatcggccg

SEQ ID NO: 24299 - DNA, 21 bp, Artificial Sequence
  Synthetic
gaggctcatcaggttaggtgg

SEQ ID NO: 24300 - DNA, 21 bp, Artificial Sequence
  Synthetic
tatggtgttttggataaggtt

SEQ ID NO: 24301 - DNA, 21 bp, Artificial Sequence
  Synthetic
actattagtgggtattcgacg

SEQ ID NO: 24302 - DNA, 21 bp, Artificial Sequence
  Synthetic
tgtgtgtatctggggtcggct

SEQ ID NO: 24303 - DNA, 21 bp, Artificial Sequence
  Synthetic
ctgcgtgtggggtcggtttat

SEQ ID NO: 24304 - DNA, 21 bp, Artificial Sequence
  Synthetic
ccggtgcctttttatggggcg

SEQ ID NO: 24305 - DNA, 21 bp, Artificial Sequence
  Synthetic
gatagtctgtctgtgaggtgg

SEQ ID NO: 24306 - DNA, 21 bp, Artificial Sequence
  Synthetic
tgggagcgggagcatccgaag

SEQ ID NO: 24307 - DNA, 21 bp, Artificial Sequence
  Synthetic
cggggtttggggatgagtagt

SEQ ID NO: 24308 - DNA, 21 bp, Artificial Sequence
  Synthetic
gggattactacttcgatgtgg

SEQ ID NO: 24309 - DNA, 21 bp, Artificial Sequence
  Synthetic
agtatgcagaggacgtgggat

SEQ ID NO: 24310 - DNA, 21 bp, Artificial Sequence
  Synthetic
gcttataaggggtatgcgacg

SEQ ID NO: 24311 - DNA, 21 bp, Artificial Sequence
  Synthetic
gttctggttgggcggtctggg

SEQ ID NO: 24312 - DNA, 21 bp, Artificial Sequence
  Synthetic
catgtgaggttgatgtcggct

SEQ ID NO: 24313 - DNA, 21 bp, Artificial Sequence
  Synthetic
tttcggctgggtggtagtcag

SEQ ID NO: 24314 - DNA, 21 bp, Artificial Sequence
  Synthetic
gagcggtgggggagtgcgatg

SEQ ID NO: 24315 - DNA, 21 bp, Artificial Sequence
  Synthetic
aagtgggctggtagtagtacg

SEQ ID NO: 24316 - DNA, 21 bp, Artificial Sequence
  Synthetic
gcgtatgctgggtatagtctt

SEQ ID NO: 24317 - DNA, 21 bp, Artificial Sequence
  Synthetic
ggtcctgatgtggggaggtgg

SEQ ID NO: 24318 - DNA, 21 bp, Artificial Sequence
  Synthetic
ctttggattagtggttcgtcg

SEQ ID NO: 24319 - DNA, 21 bp, Artificial Sequence
  Synthetic
ccggtttatatgacgtataat

SEQ ID NO: 24320 - DNA, 21 bp, Artificial Sequence
  Synthetic
gttaataagggttatagtact

SEQ ID NO: 24321 - DNA, 21 bp, Artificial Sequence
  Synthetic
tggggtctgaatagtggttat

SEQ ID NO: 24322 - DNA, 21 bp, Artificial Sequence
  Synthetic
cttgcttatcatatgtcgtcg

SEQ ID NO: 24323 - DNA, 21 bp, Artificial Sequence
  Synthetic
tatggtcggcttgatccgttg

SEQ ID NO: 24324 - DNA, 21 bp, Artificial Sequence
  Synthetic
ttgcgtgtggggctttcgcag

SEQ ID NO: 24325 - DNA, 21 bp, Artificial Sequence
  Synthetic
acgattgctacgtatcatatt

SEQ ID NO: 24326 - DNA, 21 bp, Artificial Sequence
  Synthetic
gaggcgccgtttttgtctagt

SEQ ID NO: 24327 - DNA, 21 bp, Artificial Sequence
  Synthetic
tgggcggttgagaatgggtat

SEQ ID NO: 24328 - DNA, 21 bp, Artificial Sequence
  Synthetic
tggtctacgtttggtagtggg

SEQ ID NO: 24329 - DNA, 21 bp, Artificial Sequence
  Synthetic
gttcatcattcttatgcgctg

SEQ ID NO: 24330 - DNA, 21 bp, Artificial Sequence
  Synthetic
tggaggccgctgggtgcgagt

SEQ ID NO: 24331 - DNA, 21 bp, Artificial Sequence
  Synthetic
gggtttggtgattctaggtgg

SEQ ID NO: 24332 - DNA, 21 bp, Artificial Sequence
  Synthetic
gttcgggttgcgcagtgggag

SEQ ID NO: 24333 - DNA, 21 bp, Artificial Sequence
  Synthetic
ggtgatgtgagtggtaggtgg

SEQ ID NO: 24334 - DNA, 21 bp, Artificial Sequence
  Synthetic
atggggtggcagggttcgagt

SEQ ID NO: 24335 - DNA, 21 bp, Artificial Sequence
  Synthetic
ctttatcctggttttagtgct

SEQ ID NO: 24336 - DNA, 21 bp, Artificial Sequence
  Synthetic
tcggtgccgtatggtgcttct

SEQ ID NO: 24337 - DNA, 21 bp, Artificial Sequence
  Synthetic
ggtgatgctcctggggcgtgg

SEQ ID NO: 24338 - DNA, 21 bp, Artificial Sequence
  Synthetic
gggaatgatcctggggtttgg

SEQ ID NO: 24339 - DNA, 21 bp, Artificial Sequence
  Synthetic
tcgtcgtctaattggcatgtg

SEQ ID NO: 24340 - DNA, 21 bp, Artificial Sequence
  Synthetic
gagtggcgtaagggggagtgg

SEQ ID NO: 24341 - DNA, 21 bp, Artificial Sequence
  Synthetic
gtttctatgggttattcgtct

SEQ ID NO: 24342 - DNA, 21 bp, Artificial Sequence
  Synthetic
ttgtggcctagtgcgagttct

SEQ ID NO: 24343 - DNA, 21 bp, Artificial Sequence
  Synthetic
cttaggttgggggggtcgacg

SEQ ID NO: 24344 - DNA, 21 bp, Artificial Sequence
  Synthetic
gggagttcgacttcgatgtgg

SEQ ID NO: 24345 - DNA, 21 bp, Artificial Sequence
  Synthetic
ctgtttcctgcgtcttctacg

SEQ ID NO: 24346 - DNA, 21 bp, Artificial Sequence
  Synthetic
cctgcggggggttttagtgtt

SEQ ID NO: 24347 - DNA, 21 bp, Artificial Sequence
  Synthetic
ggtatttcgcctggggtttgg

SEQ ID NO: 24348 - DNA, 21 bp, Artificial Sequence
  Synthetic
acttttgctcatggggctgct

SEQ ID NO: 24349 - DNA, 21 bp, Artificial Sequence
  Synthetic
gttgttaggggttattcggcg

SEQ ID NO: 24350 - DNA, 21 bp, Artificial Sequence
  Synthetic
ccgggtcctgggtttagttct

SEQ ID NO: 24351 - DNA, 21 bp, Artificial Sequence
  Synthetic
atgtggactaatggtgcgcag

SEQ ID NO: 24352 - DNA, 21 bp, Artificial Sequence
  Synthetic
aattctagtccggggccgtgg

SEQ ID NO: 24353 - DNA, 21 bp, Artificial Sequence
  Synthetic
tggtctccgagtggtggtttt

SEQ ID NO: 24354 - DNA, 21 bp, Artificial Sequence
  Synthetic
atgaggcttaatggtcatacg

SEQ ID NO: 24355 - DNA, 21 bp, Artificial Sequence
  Synthetic
ggtgtgtgggggtttgctcag

SEQ ID NO: 24356 - DNA, 21 bp, Artificial Sequence
  Synthetic
tgggagttgggttcggggttt

SEQ ID NO: 24357 - DNA, 21 bp, Artificial Sequence
  Synthetic
cggtgggaggggagttctacg

SEQ ID NO: 24358 - DNA, 21 bp, Artificial Sequence
  Synthetic
gggcggttggatgctcatagg

SEQ ID NO: 24359 - DNA, 21 bp, Artificial Sequence
  Synthetic
gattggagtcagggttcgagt

SEQ ID NO: 24360 - DNA, 21 bp, Artificial Sequence
  Synthetic
cgtgatgttggttgggcgcag

SEQ ID NO: 24361 - DNA, 21 bp, Artificial Sequence
  Synthetic
gtgattcatcggtggcatgag

SEQ ID NO: 24362 - DNA, 21 bp, Artificial Sequence
  Synthetic
cctcctatgcatgctgcgtgg

SEQ ID NO: 24363 - DNA, 21 bp, Artificial Sequence
  Synthetic
gtttatgatggttttgcttat

SEQ ID NO: 24364 - DNA, 21 bp, Artificial Sequence
  Synthetic
gttttgttgagggaggcgctt

SEQ ID NO: 24365 - DNA, 21 bp, Artificial Sequence
  Synthetic
atgacgtggggttctagtcag

SEQ ID NO: 24366 - DNA, 21 bp, Artificial Sequence
  Synthetic
gctagttatgggtattcgagt

SEQ ID NO: 24367 - DNA, 21 bp, Artificial Sequence
  Synthetic
aataagcaggctaatccgtgg

SEQ ID NO: 24368 - DNA, 21 bp, Artificial Sequence
  Synthetic
tggaagacgattgggagtgcg

SEQ ID NO: 24369 - DNA, 21 bp, Artificial Sequence
  Synthetic
agtcagccgtattcgtatgcg

SEQ ID NO: 24370 - DNA, 21 bp, Artificial Sequence
  Synthetic
ttgtatcatgcgagtgcttcg

SEQ ID NO: 24371 - DNA, 21 bp, Artificial Sequence
  Synthetic
gagtggaatgagactcgttgg

SEQ ID NO: 24372 - DNA, 21 bp, Artificial Sequence
  Synthetic
attgctattggttatagtacg

SEQ ID NO: 24373 - DNA, 21 bp, Artificial Sequence
  Synthetic
gcggttatttatggttctagt

SEQ ID NO: 24374 - DNA, 21 bp, Artificial Sequence
  Synthetic
tggggtgtttctaatggttat

SEQ ID NO: 24375 - DNA, 21 bp, Artificial Sequence
  Synthetic
gatggtggttcgcgttggtcg

SEQ ID NO: 24376 - DNA, 21 bp, Artificial Sequence
  Synthetic
tttaagtttgagggtagtgcg

SEQ ID NO: 24377 - DNA, 21 bp, Artificial Sequence
  Synthetic
gattttagggggtattcggtt

SEQ ID NO: 24378 - DNA, 21 bp, Artificial Sequence
  Synthetic
actgattataaggggtgggtt

SEQ ID NO: 24379 - DNA, 21 bp, Artificial Sequence
  Synthetic
cgtaataatccggggcctcat

SEQ ID NO: 24380 - DNA, 21 bp, Artificial Sequence
  Synthetic
tgggtgcatccgactggtgag

SEQ ID NO: 24381 - DNA, 21 bp, Artificial Sequence
  Synthetic
catattactgggggttttcgg

SEQ ID NO: 24382 - DNA, 21 bp, Artificial Sequence
  Synthetic
ctgtggcatgggggggcgagt

SEQ ID NO: 24383 - DNA, 21 bp, Artificial Sequence
  Synthetic
gtggggcatatggggccttgg

SEQ ID NO: 24384 - DNA, 21 bp, Artificial Sequence
  Synthetic
ggtcctacgtggggtgttatg

SEQ ID NO: 24385 - DNA, 21 bp, Artificial Sequence
  Synthetic
ctgtggattggtggtgcttcg

SEQ ID NO: 24386 - DNA, 21 bp, Artificial Sequence
  Synthetic
cttttttttgctggttcgatt

SEQ ID NO: 24387 - DNA, 21 bp, Artificial Sequence
  Synthetic
gatcgttcttggggtgcggcg

SEQ ID NO: 24388 - DNA, 21 bp, Artificial Sequence
  Synthetic
tggatggcggggtttacgaat

SEQ ID NO: 24389 - DNA, 21 bp, Artificial Sequence
  Synthetic
attggtatgtggtataaggat

SEQ ID NO: 24390 - DNA, 21 bp, Artificial Sequence
  Synthetic
ggtctttggcatgggagttct

SEQ ID NO: 24391 - DNA, 21 bp, Artificial Sequence
  Synthetic
acgacgattggttatggttat

SEQ ID NO: 24392 - DNA, 21 bp, Artificial Sequence
  Synthetic
cagaagattggttatagtgcg

SEQ ID NO: 24393 - DNA, 21 bp, Artificial Sequence
  Synthetic
acgagttttccgggtccgtgg

SEQ ID NO: 24394 - DNA, 21 bp, Artificial Sequence
  Synthetic
agtctggttgggtattcgtat

SEQ ID NO: 24395 - DNA, 21 bp, Artificial Sequence
  Synthetic
tggagtgatggggcgcggccg

SEQ ID NO: 24396 - DNA, 21 bp, Artificial Sequence
  Synthetic
ggtattggtgattctaggtgg

SEQ ID NO: 24397 - DNA, 21 bp, Artificial Sequence
  Synthetic
ctggtttctctgggtagttct

SEQ ID NO: 24398 - DNA, 21 bp, Artificial Sequence
  Synthetic
caggcttatactcgttttgat

SEQ ID NO: 24399 - DNA, 21 bp, Artificial Sequence
  Synthetic
agtcattttcatggtagtacg

SEQ ID NO: 24400 - DNA, 21 bp, Artificial Sequence
  Synthetic
tatgagaggtcttcgtggtcg

SEQ ID NO: 24401 - DNA, 21 bp, Artificial Sequence
  Synthetic
actatgtttaagggtagtgcg

SEQ ID NO: 24402 - DNA, 21 bp, Artificial Sequence
  Synthetic
gttcatcggcttgggagtgct

SEQ ID NO: 24403 - DNA, 21 bp, Artificial Sequence
  Synthetic
gagaggaagtatgaggcgagt

SEQ ID NO: 24404 - DNA, 21 bp, Artificial Sequence
  Synthetic
attccttcttggagttatgat

SEQ ID NO: 24405 - DNA, 21 bp, Artificial Sequence
  Synthetic
agtagtcgtgatactttttgg

SEQ ID NO: 24406 - DNA, 21 bp, Artificial Sequence
  Synthetic
ccttttgagtatgctattgcg

SEQ ID NO: 24407 - DNA, 21 bp, Artificial Sequence
  Synthetic
tttggtacgcttgagatgtat

SEQ ID NO: 24408 - DNA, 21 bp, Artificial Sequence
  Synthetic
agtactttgccgtatagtttt

SEQ ID NO: 24409 - DNA, 21 bp, Artificial Sequence
  Synthetic
ccgtggcctgggactagtact

SEQ ID NO: 24410 - DNA, 21 bp, Artificial Sequence
  Synthetic
ctgacttatggtactgcgcag

SEQ ID NO: 24411 - DNA, 21 bp, Artificial Sequence
  Synthetic
ttgtttattcgggatgcgagt

SEQ ID NO: 24412 - DNA, 21 bp, Artificial Sequence
  Synthetic
cctagggtggtgttgaaggag

SEQ ID NO: 24413 - DNA, 21 bp, Artificial Sequence
  Synthetic
gataatagttctgctcgttgg

SEQ ID NO: 24414 - DNA, 21 bp, Artificial Sequence
  Synthetic
gataggcatggttatagttcg

SEQ ID NO: 24415 - DNA, 21 bp, Artificial Sequence
  Synthetic
cagccttcggattctaggtgg

SEQ ID NO: 24416 - DNA, 21 bp, Artificial Sequence
  Synthetic
gggcctagtgtggtgtggaat

SEQ ID NO: 24417 - DNA, 21 bp, Artificial Sequence
  Synthetic
gggtatccgatgtattctgct

SEQ ID NO: 24418 - DNA, 21 bp, Artificial Sequence
  Synthetic
caggttcctggtatgagtcag

SEQ ID NO: 24419 - DNA, 21 bp, Artificial Sequence
  Synthetic
tggagtgttgatcgtgggttt

SEQ ID NO: 24420 - DNA, 21 bp, Artificial Sequence
  Synthetic
tggggtagtgttgcgtttgtg

SEQ ID NO: 24421 - DNA, 21 bp, Artificial Sequence
  Synthetic
cctgagattatgctgaggccg

SEQ ID NO: 24422 - DNA, 21 bp, Artificial Sequence
  Synthetic
agtgtttctcttcggtatgtg

SEQ ID NO: 24423 - DNA, 21 bp, Artificial Sequence
  Synthetic
gaggtgcatgctgtttggaat

SEQ ID NO: 24424 - DNA, 21 bp, Artificial Sequence
  Synthetic
cgtcctgattgggatcgtgtt

SEQ ID NO: 24425 - DNA, 21 bp, Artificial Sequence
  Synthetic
attcgggagcatggtagttcg

SEQ ID NO: 24426 - DNA, 21 bp, Artificial Sequence
  Synthetic
gggatgaaggtgcatcagcat

SEQ ID NO: 24427 - DNA, 21 bp, Artificial Sequence
  Synthetic
cctgcgtgggcgcattctgct

SEQ ID NO: 24428 - DNA, 21 bp, Artificial Sequence
  Synthetic
acgattcatactgggcagtgg

SEQ ID NO: 24429 - DNA, 21 bp, Artificial Sequence
  Synthetic
gatcagaggtggcctggggct

SEQ ID NO: 24430 - DNA, 21 bp, Artificial Sequence
  Synthetic
gggatgccgcgggctcctttt

SEQ ID NO: 24431 - DNA, 21 bp, Artificial Sequence
  Synthetic
caggcttatcatggttctacg

SEQ ID NO: 24432 - DNA, 21 bp, Artificial Sequence
  Synthetic
agttctgatatggcgcgtttt

SEQ ID NO: 24433 - DNA, 21 bp, Artificial Sequence
  Synthetic
tggggtgcgagtactgggtat

SEQ ID NO: 24434 - DNA, 21 bp, Artificial Sequence
  Synthetic
gttctgattgggcgtgttggt

SEQ ID NO: 24435 - DNA, 21 bp, Artificial Sequence
  Synthetic
agttatttgcatggtgcgagt

SEQ ID NO: 24436 - DNA, 21 bp, Artificial Sequence
  Synthetic
gggattactcggtcgattttt

SEQ ID NO: 24437 - DNA, 21 bp, Artificial Sequence
  Synthetic
gcgtataggctggggtcggcg

SEQ ID NO: 24438 - DNA, 21 bp, Artificial Sequence
  Synthetic
ggtgctgcttgggatcgggcg

SEQ ID NO: 24439 - DNA, 21 bp, Artificial Sequence
  Synthetic
cctcatactcaggcttatggt

SEQ ID NO: 24440 - DNA, 21 bp, Artificial Sequence
  Synthetic
atgccgtttttggtgtctggt

SEQ ID NO: 24441 - DNA, 21 bp, Artificial Sequence
  Synthetic
gatagggaggcttgggcgtct

SEQ ID NO: 24442 - DNA, 21 bp, Artificial Sequence
  Synthetic
cttgcgacttggctgcctgag

SEQ ID NO: 24443 - DNA, 21 bp, Artificial Sequence
  Synthetic
gttaaggcgaattggtcgcat

SEQ ID NO: 24444 - DNA, 21 bp, Artificial Sequence
  Synthetic
acggagaggtgggcttattcg

SEQ ID NO: 24445 - DNA, 21 bp, Artificial Sequence
  Synthetic
tatcttaatgggtatagtatt

SEQ ID NO: 24446 - DNA, 21 bp, Artificial Sequence
  Synthetic
aagtatgtgggtggttctact

SEQ ID NO: 24447 - DNA, 21 bp, Artificial Sequence
  Synthetic
actcatgctgggtattcggtt

SEQ ID NO: 24448 - DNA, 21 bp, Artificial Sequence
  Synthetic
gaggtttctggttataggtgg

SEQ ID NO: 24449 - DNA, 21 bp, Artificial Sequence
  Synthetic
ccgtgggagcatatgagttct

SEQ ID NO: 24450 - DNA, 21 bp, Artificial Sequence
  Synthetic
cattggtcggtgggttctagt

SEQ ID NO: 24451 - DNA, 21 bp, Artificial Sequence
  Synthetic
gtgagtcctgcggagtattgg

SEQ ID NO: 24452 - DNA, 21 bp, Artificial Sequence
  Synthetic
ttgtatgtggcgggttcgact

SEQ ID NO: 24453 - DNA, 21 bp, Artificial Sequence
  Synthetic
gagcggtataatacttctcag

SEQ ID NO: 24454 - DNA, 21 bp, Artificial Sequence
  Synthetic
caggagaggcctaagccgcat

SEQ ID NO: 24455 - DNA, 21 bp, Artificial Sequence
  Synthetic
gagattactcatggtgctgct

SEQ ID NO: 24456 - DNA, 21 bp, Artificial Sequence
  Synthetic
ttttcgagtctgtttagtgcg

SEQ ID NO: 24457 - DNA, 21 bp, Artificial Sequence
  Synthetic
tctcatcctggttatagtatg

SEQ ID NO: 24458 - DNA, 21 bp, Artificial Sequence
  Synthetic
catgttctgtatggtgctagt

SEQ ID NO: 24459 - DNA, 21 bp, Artificial Sequence
  Synthetic
gcttggattcctgcggcttct

SEQ ID NO: 24460 - DNA, 21 bp, Artificial Sequence
  Synthetic
tgggatcggaatatttatatg

SEQ ID NO: 24461 - DNA, 21 bp, Artificial Sequence
  Synthetic
gagaggccttttgggtctagt

SEQ ID NO: 24462 - DNA, 21 bp, Artificial Sequence
  Synthetic
tatgggtctttgggtctgtat

SEQ ID NO: 24463 - DNA, 21 bp, Artificial Sequence
  Synthetic
gctccggtgcataatggttgg

SEQ ID NO: 24464 - DNA, 21 bp, Artificial Sequence
  Synthetic
attgtgcatgggtttagtact

SEQ ID NO: 24465 - DNA, 21 bp, Artificial Sequence
  Synthetic
ttggttgagcggtcgtattgg

SEQ ID NO: 24466 - DNA, 21 bp, Artificial Sequence
  Synthetic
ggtccgaagtgggcgttggat

SEQ ID NO: 24467 - DNA, 21 bp, Artificial Sequence
  Synthetic
ttgctttatggtcatgctcag

SEQ ID NO: 24468 - DNA, 21 bp, Artificial Sequence
  Synthetic
ccgcttcatgggcggtgggag

SEQ ID NO: 24469 - DNA, 21 bp, Artificial Sequence
  Synthetic
aagcagaattatgagcattgg

SEQ ID NO: 24470 - DNA, 21 bp, Artificial Sequence
  Synthetic
atgtgggagggtggtcatagg

SEQ ID NO: 24471 - DNA, 21 bp, Artificial Sequence
  Synthetic
gcgccggagtggcggtcggat

SEQ ID NO: 24472 - DNA, 21 bp, Artificial Sequence
  Synthetic
tggaagcatgggggtgcgtcg

SEQ ID NO: 24473 - DNA, 21 bp, Artificial Sequence
  Synthetic
agttatgatcttcggtttatt

SEQ ID NO: 24474 - DNA, 21 bp, Artificial Sequence
  Synthetic
ttgggtccgacgaggggttgg

SEQ ID NO: 24475 - DNA, 21 bp, Artificial Sequence
  Synthetic
cttcattatgggagttcttcg

SEQ ID NO: 24476 - DNA, 21 bp, Artificial Sequence
  Synthetic
ctgcctcatgcgcagcgtctt

SEQ ID NO: 24477 - DNA, 21 bp, Artificial Sequence
  Synthetic
cagaagtgggagttgccgagt

SEQ ID NO: 24478 - DNA, 21 bp, Artificial Sequence
  Synthetic
gatttgcgttttttggctagt

SEQ ID NO: 24479 - DNA, 21 bp, Artificial Sequence
  Synthetic
gatgataatactcatcggtgg

SEQ ID NO: 24480 - DNA, 21 bp, Artificial Sequence
  Synthetic
tgtcaggtggggttttcttct

SEQ ID NO: 24481 - DNA, 21 bp, Artificial Sequence
  Synthetic
tggaagctgaatgaggggtat

SEQ ID NO: 24482 - DNA, 21 bp, Artificial Sequence
  Synthetic
atttggtatgatggtgctacg

SEQ ID NO: 24483 - DNA, 21 bp, Artificial Sequence
  Synthetic
gagcagtggcagcggctgcct

SEQ ID NO: 24484 - DNA, 21 bp, Artificial Sequence
  Synthetic
atttcgcagtggcatacgcat

SEQ ID NO: 24485 - DNA, 21 bp, Artificial Sequence
  Synthetic
cggtgggcgtcggatgcgagt

SEQ ID NO: 24486 - DNA, 21 bp, Artificial Sequence
  Synthetic
acttttccggcgcagagtagt

SEQ ID NO: 24487 - DNA, 21 bp, Artificial Sequence
  Synthetic
gaggctcctgggaggtggtcg

SEQ ID NO: 24488 - DNA, 21 bp, Artificial Sequence
  Synthetic
ggtcattgggcggaggtgcgg

SEQ ID NO: 24489 - DNA, 21 bp, Artificial Sequence
  Synthetic
tcttttcatgggggtagtact

SEQ ID NO: 24490 - DNA, 21 bp, Artificial Sequence
  Synthetic
tttgggtcgcttcagcatctg

SEQ ID NO: 24491 - DNA, 21 bp, Artificial Sequence
  Synthetic
cgtgaggtgaattggtctact

SEQ ID NO: 24492 - DNA, 21 bp, Artificial Sequence
  Synthetic
ccggagtatcgggtgaattat

SEQ ID NO: 24493 - DNA, 21 bp, Artificial Sequence
  Synthetic
gagatgccggctgcgaggtat

SEQ ID NO: 24494 - DNA, 21 bp, Artificial Sequence
  Synthetic
tgttatcctcttggtcagtgt

SEQ ID NO: 24495 - DNA, 21 bp, Artificial Sequence
  Synthetic
tggggtatgctttcggagttt

SEQ ID NO: 24496 - DNA, 21 bp, Artificial Sequence
  Synthetic
agtggggttggttggagttcg

SEQ ID NO: 24497 - DNA, 21 bp, Artificial Sequence
  Synthetic
catgtgcataatggtaatcgg

SEQ ID NO: 24498 - DNA, 21 bp, Artificial Sequence
  Synthetic
ggtgagcataaggggagttgg

SEQ ID NO: 24499 - DNA, 21 bp, Artificial Sequence
  Synthetic
cttaatgctgggttggcgatg

SEQ ID NO: 24500 - DNA, 21 bp, Artificial Sequence
  Synthetic
actccgctgtatgattcttgg

SEQ ID NO: 24501 - DNA, 21 bp, Artificial Sequence
  Synthetic
cgtgagtttgatttgcgtgtt

SEQ ID NO: 24502 - DNA, 21 bp, Artificial Sequence
  Synthetic
tatggtagtttgtcggtggtt

SEQ ID NO: 24503 - DNA, 21 bp, Artificial Sequence
  Synthetic
cgtcttcattctggtcctaat

SEQ ID NO: 24504 - DNA, 21 bp, Artificial Sequence
  Synthetic
tttgctcagggttttagttcg

SEQ ID NO: 24505 - DNA, 21 bp, Artificial Sequence
  Synthetic
ggggtggttgctggggcgtgg

SEQ ID NO: 24506 - DNA, 21 bp, Artificial Sequence
  Synthetic
tggaagacgaatggttcgcag

SEQ ID NO: 24507 - DNA, 21 bp, Artificial Sequence
  Synthetic
aatcttactggtagtctttgg

SEQ ID NO: 24508 - DNA, 21 bp, Artificial Sequence
  Synthetic
aggtatgttgctgagcttact

SEQ ID NO: 24509 - DNA, 21 bp, Artificial Sequence
  Synthetic
aggtggggggatgatcttttt

SEQ ID NO: 24510 - DNA, 21 bp, Artificial Sequence
  Synthetic
catcagcagcttgctcataag

SEQ ID NO: 24511 - DNA, 21 bp, Artificial Sequence
  Synthetic
tcgcctgggtggcgttcggat

SEQ ID NO: 24512 - DNA, 21 bp, Artificial Sequence
  Synthetic
gaggagcctaatagttggaag

SEQ ID NO: 24513 - DNA, 21 bp, Artificial Sequence
  Synthetic
ggttctaagtgggatatggcg

SEQ ID NO: 24514 - DNA, 21 bp, Artificial Sequence
  Synthetic
cgttatctgggggagactagt

SEQ ID NO: 24515 - DNA, 21 bp, Artificial Sequence
  Synthetic
tggaagaatcttggttcggtt

SEQ ID NO: 24516 - DNA, 21 bp, Artificial Sequence
  Synthetic
gagcttcatagtccgcgttgg

SEQ ID NO: 24517 - DNA, 21 bp, Artificial Sequence
  Synthetic
gagtatgagggttggagttcg

SEQ ID NO: 24518 - DNA, 21 bp, Artificial Sequence
  Synthetic
aatactgatcatcagcattgg

SEQ ID NO: 24519 - DNA, 21 bp, Artificial Sequence
  Synthetic
ttgcggacgatggggtctacg

SEQ ID NO: 24520 - DNA, 21 bp, Artificial Sequence
  Synthetic
tgggatactcggagttgggtt

SEQ ID NO: 24521 - DNA, 21 bp, Artificial Sequence
  Synthetic
gtgagttataatgggacttgg

SEQ ID NO: 24522 - DNA, 21 bp, Artificial Sequence
  Synthetic
tcggatctgagtgctcgttat

SEQ ID NO: 24523 - DNA, 21 bp, Artificial Sequence
  Synthetic
ccttggagtctggggagtgcg

SEQ ID NO: 24524 - DNA, 21 bp, Artificial Sequence
  Synthetic
gtgcctaggtgggcgttggag

SEQ ID NO: 24525 - DNA, 21 bp, Artificial Sequence
  Synthetic
gggcatccgctgagtacttat

SEQ ID NO: 24526 - DNA, 21 bp, Artificial Sequence
  Synthetic
tcgcattgggagggggcggcg

SEQ ID NO: 24527 - DNA, 21 bp, Artificial Sequence
  Synthetic
tctgggccttggatggcgact

SEQ ID NO: 24528 - DNA, 21 bp, Artificial Sequence
  Synthetic
ccgtggcctggtaatagtgct

SEQ ID NO: 24529 - DNA, 21 bp, Artificial Sequence
  Synthetic
tatgttgcttggccggatgcg

SEQ ID NO: 24530 - DNA, 21 bp, Artificial Sequence
  Synthetic
tttgtgtcgcttcctgaggtg

SEQ ID NO: 24531 - DNA, 21 bp, Artificial Sequence
  Synthetic
acgtggagtctttctactcct

SEQ ID NO: 24532 - DNA, 21 bp, Artificial Sequence
  Synthetic
gtgggggagtatggtcggtgg

SEQ ID NO: 24533 - DNA, 21 bp, Artificial Sequence
  Synthetic
ttgtgggctggttcgtctatg

SEQ ID NO: 24534 - DNA, 21 bp, Artificial Sequence
  Synthetic
gatttgcatacgggtaggtgg

SEQ ID NO: 24535 - DNA, 21 bp, Artificial Sequence
  Synthetic
cgtgagggttcgtatgtttgg

SEQ ID NO: 24536 - DNA, 21 bp, Artificial Sequence
  Synthetic
ctggcgtatcagcttggtcat

SEQ ID NO: 24537 - DNA, 21 bp, Artificial Sequence
  Synthetic
gggtataatgggaatctgcgg

SEQ ID NO: 24538 - DNA, 21 bp, Artificial Sequence
  Synthetic
aatcggctgggttattcgtcg

SEQ ID NO: 24539 - DNA, 21 bp, Artificial Sequence
  Synthetic
cttattcctggttcgagtatg

SEQ ID NO: 24540 - DNA, 21 bp, Artificial Sequence
  Synthetic
agtgtgtatagggggtcgact

SEQ ID NO: 24541 - DNA, 21 bp, Artificial Sequence
  Synthetic
gttagtaaggggtatagtagt

SEQ ID NO: 24542 - DNA, 21 bp, Artificial Sequence
  Synthetic
ggtgatcttcctggtaggtgg

SEQ ID NO: 24543 - DNA, 21 bp, Artificial Sequence
  Synthetic
attttgccgggttggagtact

SEQ ID NO: 24544 - DNA, 21 bp, Artificial Sequence
  Synthetic
tatgttgagctgccgggtgtg

SEQ ID NO: 24545 - DNA, 21 bp, Artificial Sequence
  Synthetic
ttgtatattgggtcggcgtct

SEQ ID NO: 24546 - DNA, 21 bp, Artificial Sequence
  Synthetic
tgggtgacgcttcctagtctt

SEQ ID NO: 24547 - DNA, 21 bp, Artificial Sequence
  Synthetic
gataagtggaatttgaatatt

SEQ ID NO: 24548 - DNA, 21 bp, Artificial Sequence
  Synthetic
ggttcttctctgggtgtttgg

SEQ ID NO: 24549 - DNA, 21 bp, Artificial Sequence
  Synthetic
tgggttgctggggtgccgcgg

SEQ ID NO: 24550 - DNA, 21 bp, Artificial Sequence
  Synthetic
aatgtgggtagggagtggact

SEQ ID NO: 24551 - DNA, 21 bp, Artificial Sequence
  Synthetic
gaggctgggtttgctctggag

SEQ ID NO: 24552 - DNA, 21 bp, Artificial Sequence
  Synthetic
acttttgttcatggtgctgcg

SEQ ID NO: 24553 - DNA, 21 bp, Artificial Sequence
  Synthetic
gagcattcgggggcgcggtgg

SEQ ID NO: 24554 - DNA, 21 bp, Artificial Sequence
  Synthetic
actcatgcgggttgggctacg

SEQ ID NO: 24555 - DNA, 21 bp, Artificial Sequence
  Synthetic
gtggctcggggttatgcgcag

SEQ ID NO: 24556 - DNA, 21 bp, Artificial Sequence
  Synthetic
gatggttatccggggaagtgg

SEQ ID NO: 24557 - DNA, 21 bp, Artificial Sequence
  Synthetic
gtggatcctacgcttcggtat

SEQ ID NO: 24558 - DNA, 21 bp, Artificial Sequence
  Synthetic
ggtcaggtgtgggagcgtgtg

SEQ ID NO: 24559 - DNA, 21 bp, Artificial Sequence
  Synthetic
tcggttgagaattcttggaag

SEQ ID NO: 24560 - DNA, 21 bp, Artificial Sequence
  Synthetic
catccgcctactacttcgcgt

SEQ ID NO: 24561 - DNA, 21 bp, Artificial Sequence
  Synthetic
atgagtgctactcagcattgg

SEQ ID NO: 24562 - DNA, 21 bp, Artificial Sequence
  Synthetic
gggattgatgcggctcgttgg

SEQ ID NO: 24563 - DNA, 21 bp, Artificial Sequence
  Synthetic
attgagcatagtggtaggtgg

SEQ ID NO: 24564 - DNA, 21 bp, Artificial Sequence
  Synthetic
atgcataggtttgctattgat

SEQ ID NO: 24565 - DNA, 21 bp, Artificial Sequence
  Synthetic
ccgcagtatgtgacggggtgg

SEQ ID NO: 24566 - DNA, 21 bp, Artificial Sequence
  Synthetic
tggattggggggggttttaat

SEQ ID NO: 24567 - DNA, 21 bp, Artificial Sequence
  Synthetic
cgtggggcgggtatggcgcag

SEQ ID NO: 24568 - DNA, 21 bp, Artificial Sequence
  Synthetic
cggatgcaggctcttcataat

SEQ ID NO: 24569 - DNA, 21 bp, Artificial Sequence
  Synthetic
tgggttcatgggtattcgagt

SEQ ID NO: 24570 - DNA, 21 bp, Artificial Sequence
  Synthetic
ggtattggggaggggcggtgg

SEQ ID NO: 24571 - DNA, 21 bp, Artificial Sequence
  Synthetic
tggatgattggtggtagtgtt

SEQ ID NO: 24572 - DNA, 21 bp, Artificial Sequence
  Synthetic
tggagtgtggtggaggggttt

SEQ ID NO: 24573 - DNA, 21 bp, Artificial Sequence
  Synthetic
aatcattcttctcagcattgg

SEQ ID NO: 24574 - DNA, 21 bp, Artificial Sequence
  Synthetic
ttgctgctgagggaggttttg

SEQ ID NO: 24575 - DNA, 21 bp, Artificial Sequence
  Synthetic
tatgctagttattcgtatggg

SEQ ID NO: 24576 - DNA, 21 bp, Artificial Sequence
  Synthetic
atttcgtctcattctcattgg

SEQ ID NO: 24577 - DNA, 21 bp, Artificial Sequence
  Synthetic
cctgagatgtcgaataggtgg

SEQ ID NO: 24578 - DNA, 21 bp, Artificial Sequence
  Synthetic
gatcggaatagtgggatttgg

SEQ ID NO: 24579 - DNA, 21 bp, Artificial Sequence
  Synthetic
ccgagggttgcgtatgcggct

SEQ ID NO: 24580 - DNA, 21 bp, Artificial Sequence
  Synthetic
ggggtttatgagaatcgttgg

SEQ ID NO: 24581 - DNA, 21 bp, Artificial Sequence
  Synthetic
gatcggacggcttgggctgcg

SEQ ID NO: 24582 - DNA, 21 bp, Artificial Sequence
  Synthetic
gtggcgcatgaggctaggtgg

SEQ ID NO: 24583 - DNA, 21 bp, Artificial Sequence
  Synthetic
ggggatagtccgggtccttgg

SEQ ID NO: 24584 - DNA, 21 bp, Artificial Sequence
  Synthetic
gggcatgtggcgacgcctcgg

SEQ ID NO: 24585 - DNA, 21 bp, Artificial Sequence
  Synthetic
aagtatgagtttggtagttcg

SEQ ID NO: 24586 - DNA, 21 bp, Artificial Sequence
  Synthetic
tatgggctgttggttactagg

SEQ ID NO: 24587 - DNA, 21 bp, Artificial Sequence
  Synthetic
gagttgccggggtgggctact

SEQ ID NO: 24588 - DNA, 21 bp, Artificial Sequence
  Synthetic
cgtaatgctgagctgatgcgg

SEQ ID NO: 24589 - DNA, 21 bp, Artificial Sequence
  Synthetic
agttatcagggttttagttct

SEQ ID NO: 24590 - DNA, 21 bp, Artificial Sequence
  Synthetic
tcgcggcctggttattctgct

SEQ ID NO: 24591 - DNA, 21 bp, Artificial Sequence
  Synthetic
atgtttgtgggtatgtctagt

SEQ ID NO: 24592 - DNA, 21 bp, Artificial Sequence
  Synthetic
catagttctccgggtgcttgg

SEQ ID NO: 24593 - DNA, 21 bp, Artificial Sequence
  Synthetic
ttgctgaatactggtcattgg

SEQ ID NO: 24594 - DNA, 21 bp, Artificial Sequence
  Synthetic
tctgcgtatttggggtctgct

SEQ ID NO: 24595 - DNA, 21 bp, Artificial Sequence
  Synthetic
ggtgatgataaggctaggttt

SEQ ID NO: 24596 - DNA, 21 bp, Artificial Sequence
  Synthetic
tgggggactttggagcgttat

SEQ ID NO: 24597 - DNA, 21 bp, Artificial Sequence
  Synthetic
ggtacggatggtgctaggtgg

SEQ ID NO: 24598 - DNA, 21 bp, Artificial Sequence
  Synthetic
ctgaatcagcagatgcatcgt

SEQ ID NO: 24599 - DNA, 21 bp, Artificial Sequence
  Synthetic
cctagtggggctgcttattgg

SEQ ID NO: 24600 - DNA, 21 bp, Artificial Sequence
  Synthetic
tatggtagtcttcagtctttg

SEQ ID NO: 24601 - DNA, 21 bp, Artificial Sequence
  Synthetic
actgcggcttggacggcttct

SEQ ID NO: 24602 - DNA, 21 bp, Artificial Sequence
  Synthetic
tatgaggattggtatcggccg

SEQ ID NO: 24603 - DNA, 21 bp, Artificial Sequence
  Synthetic
gatggtcggccgggtgtgtgg

SEQ ID NO: 24604 - DNA, 21 bp, Artificial Sequence
  Synthetic
tggatgctgatggggagtgcg

SEQ ID NO: 24605 - DNA, 21 bp, Artificial Sequence
  Synthetic
tatccgtcgtatctgagttct

SEQ ID NO: 24606 - DNA, 21 bp, Artificial Sequence
  Synthetic
gcttatccgggtcatgcgagt

SEQ ID NO: 24607 - DNA, 21 bp, Artificial Sequence
  Synthetic
cctccggctttgctgcatatg

SEQ ID NO: 24608 - DNA, 21 bp, Artificial Sequence
  Synthetic
cttcgtgttgctgagtcgtct

SEQ ID NO: 24609 - DNA, 21 bp, Artificial Sequence
  Synthetic
tgggggtggccgggtcgggag

SEQ ID NO: 24610 - DNA, 21 bp, Artificial Sequence
  Synthetic
tcgaagaattggccgggttcg

SEQ ID NO: 24611 - DNA, 21 bp, Artificial Sequence
  Synthetic
atgcatcatccgtggcgggag

SEQ ID NO: 24612 - DNA, 21 bp, Artificial Sequence
  Synthetic
cttctttctcatggttcgagt

SEQ ID NO: 24613 - DNA, 21 bp, Artificial Sequence
  Synthetic
ggtgctgcgaagaatgcgtgg

SEQ ID NO: 24614 - DNA, 21 bp, Artificial Sequence
  Synthetic
ttgaagggtattcctattgtg

SEQ ID NO: 24615 - DNA, 21 bp, Artificial Sequence
  Synthetic
acgtttcttcatggttctgtt

SEQ ID NO: 24616 - DNA, 21 bp, Artificial Sequence
  Synthetic
gaggctaggtatggttctacg

SEQ ID NO: 24617 - DNA, 21 bp, Artificial Sequence
  Synthetic
aatcttgcttgggatagggcg

SEQ ID NO: 24618 - DNA, 21 bp, Artificial Sequence
  Synthetic
gagacttggggtggtagtagt

SEQ ID NO: 24619 - DNA, 21 bp, Artificial Sequence
  Synthetic
gctccgctgtggaaggctggg

SEQ ID NO: 24620 - DNA, 21 bp, Artificial Sequence
  Synthetic
tggcggtcggggggtgctcag

SEQ ID NO: 24621 - DNA, 21 bp, Artificial Sequence
  Synthetic
gatgggactactgggcggtgg

SEQ ID NO: 24622 - DNA, 21 bp, Artificial Sequence
  Synthetic
atgctgcctatgggtagttcg

SEQ ID NO: 24623 - DNA, 21 bp, Artificial Sequence
  Synthetic
aatcgtgtgggttatagtagt

SEQ ID NO: 24624 - DNA, 21 bp, Artificial Sequence
  Synthetic
tggggtgtgttggagactttg

SEQ ID NO: 24625 - DNA, 21 bp, Artificial Sequence
  Synthetic
tggaagcagccgtctggggtg

SEQ ID NO: 24626 - DNA, 21 bp, Artificial Sequence
  Synthetic
gatcatcgtgttctgaattat

SEQ ID NO: 24627 - DNA, 21 bp, Artificial Sequence
  Synthetic
cctacggctgttgggatttgg

SEQ ID NO: 24628 - DNA, 21 bp, Artificial Sequence
  Synthetic
gagcagaagtgggcttctagt

SEQ ID NO: 24629 - DNA, 21 bp, Artificial Sequence
  Synthetic
gggcatgagattactcgttgg

SEQ ID NO: 24630 - DNA, 21 bp, Artificial Sequence
  Synthetic
atgcctcattcgggggtttgg

SEQ ID NO: 24631 - DNA, 21 bp, Artificial Sequence
  Synthetic
aatcatcctcgtgagctttgg

SEQ ID NO: 24632 - DNA, 21 bp, Artificial Sequence
  Synthetic
aggtttgtgtctgattttgcg

SEQ ID NO: 24633 - DNA, 21 bp, Artificial Sequence
  Synthetic
cctcggtcgctttatagtgct

SEQ ID NO: 24634 - DNA, 21 bp, Artificial Sequence
  Synthetic
agttatgatttgcgttttgtg

SEQ ID NO: 24635 - DNA, 21 bp, Artificial Sequence
  Synthetic
ggtgagccgaatgggaggtgg

SEQ ID NO: 24636 - DNA, 21 bp, Artificial Sequence
  Synthetic
atgaggcttggggctgctcag

SEQ ID NO: 24637 - DNA, 21 bp, Artificial Sequence
  Synthetic
atgattcgtttgggggctagt

SEQ ID NO: 24638 - DNA, 21 bp, Artificial Sequence
  Synthetic
acgagtgggacggcttattgg

SEQ ID NO: 24639 - DNA, 21 bp, Artificial Sequence
  Synthetic
gtgccgtcgattaggagtatt

SEQ ID NO: 24640 - DNA, 21 bp, Artificial Sequence
  Synthetic
gttctgacggggtggtctgct

SEQ ID NO: 24641 - DNA, 21 bp, Artificial Sequence
  Synthetic
tggcgtccggggggttctatg

SEQ ID NO: 24642 - DNA, 21 bp, Artificial Sequence
  Synthetic
catggtgaggtggggcgttgg

SEQ ID NO: 24643 - DNA, 21 bp, Artificial Sequence
  Synthetic
ggggtggattctgcgcggtat

SEQ ID NO: 24644 - DNA, 21 bp, Artificial Sequence
  Synthetic
acgatttatcatctgccgact

SEQ ID NO: 24645 - DNA, 21 bp, Artificial Sequence
  Synthetic
gagaagtgggggatggctgcg

SEQ ID NO: 24646 - DNA, 21 bp, Artificial Sequence
  Synthetic
tttgggtcgcttaatgcttgg

SEQ ID NO: 24647 - DNA, 21 bp, Artificial Sequence
  Synthetic
aatgagacgacgaggtggtct

SEQ ID NO: 24648 - DNA, 21 bp, Artificial Sequence
  Synthetic
gcgaatcctgggtggtctact

SEQ ID NO: 24649 - DNA, 21 bp, Artificial Sequence
  Synthetic
ccttatgttcctgcggcgcag

SEQ ID NO: 24650 - DNA, 21 bp, Artificial Sequence
  Synthetic
gctctgaggcttatgagtgct

SEQ ID NO: 24651 - DNA, 21 bp, Artificial Sequence
  Synthetic
tgggttcttgatggttctaag

SEQ ID NO: 24652 - DNA, 21 bp, Artificial Sequence
  Synthetic
gattttcgtcatggggcttcg

SEQ ID NO: 24653 - DNA, 21 bp, Artificial Sequence
  Synthetic
ttttggcagcatggttcgtcg

SEQ ID NO: 24654 - DNA, 21 bp, Artificial Sequence
  Synthetic
gagaggcatctttattcgagt

SEQ ID NO: 24655 - DNA, 21 bp, Artificial Sequence
  Synthetic
ttgtatgttgggcttgctcag

SEQ ID NO: 24656 - DNA, 21 bp, Artificial Sequence
  Synthetic
gcgcggacgtatggtgctgct

SEQ ID NO: 24657 - DNA, 21 bp, Artificial Sequence
  Synthetic
tggccggaggcgagttggaag

SEQ ID NO: 24658 - DNA, 21 bp, Artificial Sequence
  Synthetic
cttcggctgggtctgtctagt

SEQ ID NO: 24659 - DNA, 21 bp, Artificial Sequence
  Synthetic
cctaagtttgatttgcgttcg

SEQ ID NO: 24660 - DNA, 21 bp, Artificial Sequence
  Synthetic
tggccgatgctttctaaggat

SEQ ID NO: 24661 - DNA, 21 bp, Artificial Sequence
  Synthetic
atgacggctagtcggtgggat

SEQ ID NO: 24662 - DNA, 21 bp, Artificial Sequence
  Synthetic
gctttgagtgggtatagggtg

SEQ ID NO: 24663 - DNA, 21 bp, Artificial Sequence
  Synthetic
tgggttgttcatgggtcgcag

SEQ ID NO: 24664 - DNA, 21 bp, Artificial Sequence
  Synthetic
ccgattaatccgggtgcgtgg

SEQ ID NO: 24665 - DNA, 21 bp, Artificial Sequence
  Synthetic
gagatttttcttggtgctgct

SEQ ID NO: 24666 - DNA, 21 bp, Artificial Sequence
  Synthetic
gggtatgatactgcgaagtgg

SEQ ID NO: 24667 - DNA, 21 bp, Artificial Sequence
  Synthetic
gagtatcatggtggtgcttct

SEQ ID NO: 24668 - DNA, 21 bp, Artificial Sequence
  Synthetic
cggtcggtggtggatcgggct

SEQ ID NO: 24669 - DNA, 21 bp, Artificial Sequence
  Synthetic
tggaagggtcatcatgagtcg

SEQ ID NO: 24670 - DNA, 21 bp, Artificial Sequence
  Synthetic
cggcagacgagtgcggagaag

SEQ ID NO: 24671 - DNA, 21 bp, Artificial Sequence
  Synthetic
tggtctcagtttgtggagggg

SEQ ID NO: 24672 - DNA, 21 bp, Artificial Sequence
  Synthetic
ccggaggggtcggcgcggtat

SEQ ID NO: 24673 - DNA, 21 bp, Artificial Sequence
  Synthetic
gggagttcggtgggggcttgg

SEQ ID NO: 24674 - DNA, 21 bp, Artificial Sequence
  Synthetic
gggagtcgtacttttgagcgt

SEQ ID NO: 24675 - DNA, 21 bp, Artificial Sequence
  Synthetic
tggactgctggtgggtctacg

SEQ ID NO: 24676 - DNA, 21 bp, Artificial Sequence
  Synthetic
gatgttaagtggacgactttt

SEQ ID NO: 24677 - DNA, 21 bp, Artificial Sequence
  Synthetic
ccgcggttgcaggctgagcgt

SEQ ID NO: 24678 - DNA, 21 bp, Artificial Sequence
  Synthetic
gcgtctgattttagttcgtgg

SEQ ID NO: 24679 - DNA, 21 bp, Artificial Sequence
  Synthetic
cttcagacttatggtagtact

SEQ ID NO: 24680 - DNA, 21 bp, Artificial Sequence
  Synthetic
gataattggaagttgcctaat

SEQ ID NO: 24681 - DNA, 21 bp, Artificial Sequence
  Synthetic
gagaaggcggggtggagtgtt

SEQ ID NO: 24682 - DNA, 21 bp, Artificial Sequence
  Synthetic
ttgtcttatcaggggagtcag

SEQ ID NO: 24683 - DNA, 21 bp, Artificial Sequence
  Synthetic
cctgcttttcatctgtcttcg

SEQ ID NO: 24684 - DNA, 21 bp, Artificial Sequence
  Synthetic
actcctacgtggagtagttcg

SEQ ID NO: 24685 - DNA, 21 bp, Artificial Sequence
  Synthetic
ccttggcttggtgctgcgtcg

SEQ ID NO: 24686 - DNA, 21 bp, Artificial Sequence
  Synthetic
gttgatgtgtcgctgaggtat

SEQ ID NO: 24687 - DNA, 21 bp, Artificial Sequence
  Synthetic
gcgcagcatcctcatgggtgg

SEQ ID NO: 24688 - DNA, 21 bp, Artificial Sequence
  Synthetic
gtgtcgggtgaggcgcggtgg

SEQ ID NO: 24689 - DNA, 21 bp, Artificial Sequence
  Synthetic
aatgttctttatgggtcggcg

SEQ ID NO: 24690 - DNA, 21 bp, Artificial Sequence
  Synthetic
gaggcttttatgggtagtgct

SEQ ID NO: 24691 - DNA, 21 bp, Artificial Sequence
  Synthetic
cttgtgtatggttcgtcgatg

SEQ ID NO: 24692 - DNA, 21 bp, Artificial Sequence
  Synthetic
cttatggagtttggttctacg

SEQ ID NO: 24693 - DNA, 21 bp, Artificial Sequence
  Synthetic
atgaagagttatgatttgcgt

SEQ ID NO: 24694 - DNA, 21 bp, Artificial Sequence
  Synthetic
tatgtgcagcttccggatgtg

SEQ ID NO: 24695 - DNA, 21 bp, Artificial Sequence
  Synthetic
tgggcgcatgcgacgtgggat

SEQ ID NO: 24696 - DNA, 21 bp, Artificial Sequence
  Synthetic
gatcattatctgggtagtacg

SEQ ID NO: 24697 - DNA, 21 bp, Artificial Sequence
  Synthetic
gagaagtatggtacgagtcag

SEQ ID NO: 24698 - DNA, 21 bp, Artificial Sequence
  Synthetic
gcgcatgtgtatggttctacg

SEQ ID NO: 24699 - DNA, 21 bp, Artificial Sequence
  Synthetic
atgtgggagggggattcttct

SEQ ID NO: 24700 - DNA, 21 bp, Artificial Sequence
  Synthetic
gagtttcatcaggggagtgct

SEQ ID NO: 24701 - DNA, 21 bp, Artificial Sequence
  Synthetic
gatcgtcctgtgggtgtgtgg

SEQ ID NO: 24702 - DNA, 21 bp, Artificial Sequence
  Synthetic
tatttgcatggttatactaat

SEQ ID NO: 24703 - DNA, 21 bp, Artificial Sequence
  Synthetic
gatattgtggggaataggtgg

SEQ ID NO: 24704 - DNA, 21 bp, Artificial Sequence
  Synthetic
gatgttagtggttatcgttgg

SEQ ID NO: 24705 - DNA, 21 bp, Artificial Sequence
  Synthetic
ccttattatggtgcggcgagt

SEQ ID NO: 24706 - DNA, 21 bp, Artificial Sequence
  Synthetic
gttcgtgctggggattgggct

SEQ ID NO: 24707 - DNA, 21 bp, Artificial Sequence
  Synthetic
atgatgaagttgggtagtgcg

SEQ ID NO: 24708 - DNA, 21 bp, Artificial Sequence
  Synthetic
tatggtgctcttaattatatg

SEQ ID NO: 24709 - DNA, 21 bp, Artificial Sequence
  Synthetic
tgggatgtgaaggggggttat

SEQ ID NO: 24710 - DNA, 21 bp, Artificial Sequence
  Synthetic
cattatcatggggggtcgcag

SEQ ID NO: 24711 - DNA, 21 bp, Artificial Sequence
  Synthetic
gagccgtggcatttggcttat

SEQ ID NO: 24712 - DNA, 21 bp, Artificial Sequence
  Synthetic
ttgcttgctgggtatgctatt

SEQ ID NO: 24713 - DNA, 21 bp, Artificial Sequence
  Synthetic
tatcatttttctcaggcgatg

SEQ ID NO: 24714 - DNA, 21 bp, Artificial Sequence
  Synthetic
attttgagtgggtatacgctg

SEQ ID NO: 24715 - DNA, 21 bp, Artificial Sequence
  Synthetic
gagtatgttcctgcttcttcg

SEQ ID NO: 24716 - DNA, 21 bp, Artificial Sequence
  Synthetic
gattatcggcttacggggttt

SEQ ID NO: 24717 - DNA, 21 bp, Artificial Sequence
  Synthetic
tggggtgagccttcgcattcg

SEQ ID NO: 24718 - DNA, 21 bp, Artificial Sequence
  Synthetic
ccgttgggtgggaattttagg

SEQ ID NO: 24719 - DNA, 21 bp, Artificial Sequence
  Synthetic
aaggcgaatgttgggccgtgg

SEQ ID NO: 24720 - DNA, 21 bp, Artificial Sequence
  Synthetic
tgtcgttcttttggtagtgct

SEQ ID NO: 24721 - DNA, 21 bp, Artificial Sequence
  Synthetic
gagcatcatggtttttctatg

SEQ ID NO: 24722 - DNA, 21 bp, Artificial Sequence
  Synthetic
caggtggcttctcaggtttgg

SEQ ID NO: 24723 - DNA, 21 bp, Artificial Sequence
  Synthetic
atggatcttatgcctcggggt

SEQ ID NO: 24724 - DNA, 21 bp, Artificial Sequence
  Synthetic
tttatgattggtggggcgcag

SEQ ID NO: 24725 - DNA, 21 bp, Artificial Sequence
  Synthetic
cctgcgggtgggtttagtgct

SEQ ID NO: 24726 - DNA, 21 bp, Artificial Sequence
  Synthetic
gagggtgggggtgctaggtgg

SEQ ID NO: 24727 - DNA, 21 bp, Artificial Sequence
  Synthetic
agtctgactgataggctgtgg

SEQ ID NO: 24728 - DNA, 21 bp, Artificial Sequence
  Synthetic
aaggagcagtggaatgattgg

SEQ ID NO: 24729 - DNA, 21 bp, Artificial Sequence
  Synthetic
cttaggcctaattgggcgatg

SEQ ID NO: 24730 - DNA, 21 bp, Artificial Sequence
  Synthetic
gtggataaggataattatcgt

SEQ ID NO: 24731 - DNA, 21 bp, Artificial Sequence
  Synthetic
acgtttgcggggtggtctgct

SEQ ID NO: 24732 - DNA, 21 bp, Artificial Sequence
  Synthetic
ccttatcctaagtttgctgct

SEQ ID NO: 24733 - DNA, 21 bp, Artificial Sequence
  Synthetic
tgttatcctcagttgacttgt

SEQ ID NO: 24734 - DNA, 21 bp, Artificial Sequence
  Synthetic
tcgaatttgtatgatttgagg

SEQ ID NO: 24735 - DNA, 21 bp, Artificial Sequence
  Synthetic
gatgagtttagtaatcgttgg

SEQ ID NO: 24736 - DNA, 21 bp, Artificial Sequence
  Synthetic
gcggttgtgggtgggtggagt

SEQ ID NO: 24737 - DNA, 21 bp, Artificial Sequence
  Synthetic
agttttagtatggggtctgct

SEQ ID NO: 24738 - DNA, 21 bp, Artificial Sequence
  Synthetic
ctgtggagtggtagttctact

SEQ ID NO: 24739 - DNA, 21 bp, Artificial Sequence
  Synthetic
gattatcggcctcaggcgtcg

SEQ ID NO: 24740 - DNA, 21 bp, Artificial Sequence
  Synthetic
gtgatgcttggttatagttcg

SEQ ID NO: 24741 - DNA, 21 bp, Artificial Sequence
  Synthetic
agtgttacgactgcttattgg

SEQ ID NO: 24742 - DNA, 21 bp, Artificial Sequence
  Synthetic
ttgggtgctcctgggttgtgg

SEQ ID NO: 24743 - DNA, 21 bp, Artificial Sequence
  Synthetic
gagcggaatcctgggaggtgg

SEQ ID NO: 24744 - DNA, 21 bp, Artificial Sequence
  Synthetic
ttgcttttggggtatagtgcg

SEQ ID NO: 24745 - DNA, 21 bp, Artificial Sequence
  Synthetic
gggacgtcgcttggtccttgg

SEQ ID NO: 24746 - DNA, 21 bp, Artificial Sequence
  Synthetic
gttggtgtggtgggtgcttgg

SEQ ID NO: 24747 - DNA, 21 bp, Artificial Sequence
  Synthetic
gctcattttggtggttcgact

SEQ ID NO: 24748 - DNA, 21 bp, Artificial Sequence
  Synthetic
ggggggagtccgggtatgtgg

SEQ ID NO: 24749 - DNA, 21 bp, Artificial Sequence
  Synthetic
gaggttcatacgcgttgggtg

SEQ ID NO: 24750 - DNA, 21 bp, Artificial Sequence
  Synthetic
tctcgtgagtttgattatcgt

SEQ ID NO: 24751 - DNA, 21 bp, Artificial Sequence
  Synthetic
ccgaggaatgttggtatttat

SEQ ID NO: 24752 - DNA, 21 bp, Artificial Sequence
  Synthetic
ccggaggatagtgcgcgttat

SEQ ID NO: 24753 - DNA, 21 bp, Artificial Sequence
  Synthetic
gagtttaatggtgcgcggtgg

SEQ ID NO: 24754 - DNA, 21 bp, Artificial Sequence
  Synthetic
atgcgggaggggtggagttct

SEQ ID NO: 24755 - DNA, 21 bp, Artificial Sequence
  Synthetic
gctggggctcctggtgcgtgg

SEQ ID NO: 24756 - DNA, 21 bp, Artificial Sequence
  Synthetic
ccgtatgcgcatggttcgtcg

SEQ ID NO: 24757 - DNA, 21 bp, Artificial Sequence
  Synthetic
tggcggctggagcttgggtgg

SEQ ID NO: 24758 - DNA, 21 bp, Artificial Sequence
  Synthetic
agtaggcctcatatggggatg

SEQ ID NO: 24759 - DNA, 21 bp, Artificial Sequence
  Synthetic
tggcgggagcatggtgctgcg

SEQ ID NO: 24760 - DNA, 21 bp, Artificial Sequence
  Synthetic
ttgaagatgagtttttcgtcg

SEQ ID NO: 24761 - DNA, 21 bp, Artificial Sequence
  Synthetic
gggtttgggtcttatggtggt

SEQ ID NO: 24762 - DNA, 21 bp, Artificial Sequence
  Synthetic
ggtcagtggaggcttgatgtt

SEQ ID NO: 24763 - DNA, 21 bp, Artificial Sequence
  Synthetic
acgtttgctcgtggggcggct

SEQ ID NO: 24764 - DNA, 21 bp, Artificial Sequence
  Synthetic
agtctgcatggttttgcgcag

SEQ ID NO: 24765 - DNA, 21 bp, Artificial Sequence
  Synthetic
aaggatgtgaattggtcgagt

SEQ ID NO: 24766 - DNA, 21 bp, Artificial Sequence
  Synthetic
ggtagtactattggtccttgg

SEQ ID NO: 24767 - DNA, 21 bp, Artificial Sequence
  Synthetic
ggttcgaatatgggtcagtgg

SEQ ID NO: 24768 - DNA, 21 bp, Artificial Sequence
  Synthetic
agtaagcctgtgggtatttgg

SEQ ID NO: 24769 - DNA, 21 bp, Artificial Sequence
  Synthetic
tatgggtcgtggagtagtatt

SEQ ID NO: 24770 - DNA, 21 bp, Artificial Sequence
  Synthetic
gagtggagggggtctgcgacg

SEQ ID NO: 24771 - DNA, 21 bp, Artificial Sequence
  Synthetic
tggaatgtttatgggtcgcag

SEQ ID NO: 24772 - DNA, 21 bp, Artificial Sequence
  Synthetic
ttgaggttgggtgattattcg

SEQ ID NO: 24773 - DNA, 21 bp, Artificial Sequence
  Synthetic
gatcagtcttctcggtgggct

SEQ ID NO: 24774 - DNA, 21 bp, Artificial Sequence
  Synthetic
gggaataggacggcggagagg

SEQ ID NO: 24775 - DNA, 21 bp, Artificial Sequence
  Synthetic
tcttttttgggtgggtcttcg

SEQ ID NO: 24776 - DNA, 21 bp, Artificial Sequence
  Synthetic
cctgatccttggaatcgggct

SEQ ID NO: 24777 - DNA, 21 bp, Artificial Sequence
  Synthetic
gattcgcgtttgttggcgtat

SEQ ID NO: 24778 - DNA, 21 bp, Artificial Sequence
  Synthetic
ttggtgcgtgttatggagcgg

SEQ ID NO: 24779 - DNA, 21 bp, Artificial Sequence
  Synthetic
tttcatcagatggtggggaag

SEQ ID NO: 24780 - DNA, 21 bp, Artificial Sequence
  Synthetic
tttaagaatttgcctgagatt

SEQ ID NO: 24781 - DNA, 21 bp, Artificial Sequence
  Synthetic
caggagccttggcatgttcgt

SEQ ID NO: 24782 - DNA, 21 bp, Artificial Sequence
  Synthetic
tgtcggaatgagcgggttcat

SEQ ID NO: 24783 - DNA, 21 bp, Artificial Sequence
  Synthetic
cctgagtatcggcttcctcat

SEQ ID NO: 24784 - DNA, 21 bp, Artificial Sequence
  Synthetic
gagcggacggggttttctgcg

SEQ ID NO: 24785 - DNA, 21 bp, Artificial Sequence
  Synthetic
gaggcgcggctttattcttct

SEQ ID NO: 24786 - DNA, 21 bp, Artificial Sequence
  Synthetic
tgggataggtcggggtcgatg

SEQ ID NO: 24787 - DNA, 21 bp, Artificial Sequence
  Synthetic
ccgccgaatcgtttgcgggag

SEQ ID NO: 24788 - DNA, 21 bp, Artificial Sequence
  Synthetic
aagcatactattgctcagatt

SEQ ID NO: 24789 - DNA, 21 bp, Artificial Sequence
  Synthetic
agtgattcgccgggtaggtgg

SEQ ID NO: 24790 - DNA, 21 bp, Artificial Sequence
  Synthetic
cggcttgagtataataattgg

SEQ ID NO: 24791 - DNA, 21 bp, Artificial Sequence
  Synthetic
cagaagaatggggctatgtgg

SEQ ID NO: 24792 - DNA, 21 bp, Artificial Sequence
  Synthetic
gagcggtggggtggtgcgacg

SEQ ID NO: 24793 - DNA, 21 bp, Artificial Sequence
  Synthetic
tgggggagtttgggtgttcat

SEQ ID NO: 24794 - DNA, 21 bp, Artificial Sequence
  Synthetic
ggtgagaatttgtcgcgttgg

SEQ ID NO: 24795 - DNA, 21 bp, Artificial Sequence
  Synthetic
cctaaggtgattctgcataat

SEQ ID NO: 24796 - DNA, 21 bp, Artificial Sequence
  Synthetic
cgtgctggttctatgcgggat

SEQ ID NO: 24797 - DNA, 21 bp, Artificial Sequence
  Synthetic
ttgcgtattgcgctgtctaat

SEQ ID NO: 24798 - DNA, 21 bp, Artificial Sequence
  Synthetic
gagcatagtggtggtaggtgg

SEQ ID NO: 24799 - DNA, 21 bp, Artificial Sequence
  Synthetic
gctggtcttaattggagtcat

SEQ ID NO: 24800 - DNA, 21 bp, Artificial Sequence
  Synthetic
gatgtttttcgtggtagtacg

SEQ ID NO: 24801 - DNA, 21 bp, Artificial Sequence
  Synthetic
tggaagactgggtattcttcg

SEQ ID NO: 24802 - DNA, 21 bp, Artificial Sequence
  Synthetic
tggagtgcgtttattgagggt

SEQ ID NO: 24803 - DNA, 21 bp, Artificial Sequence
  Synthetic
ccgacttatggtgtgattccg

SEQ ID NO: 24804 - DNA, 21 bp, Artificial Sequence
  Synthetic
gagagttatctggcttatatg

SEQ ID NO: 24805 - DNA, 21 bp, Artificial Sequence
  Synthetic
agtttgaagtgggaggctagt

SEQ ID NO: 24806 - DNA, 21 bp, Artificial Sequence
  Synthetic
cctgcggcgaattgggctgct

SEQ ID NO: 24807 - DNA, 21 bp, Artificial Sequence
  Synthetic
ttgtttcagctgggttcttct

SEQ ID NO: 24808 - DNA, 21 bp, Artificial Sequence
  Synthetic
cttagtgagttttcttattat

SEQ ID NO: 24809 - DNA, 21 bp, Artificial Sequence
  Synthetic
cttcgggattcgcagattagg

SEQ ID NO: 24810 - DNA, 21 bp, Artificial Sequence
  Synthetic
gctgcgcgggattttcattgg

SEQ ID NO: 24811 - DNA, 21 bp, Artificial Sequence
  Synthetic
ttgtggtctcctcaggcttcg

SEQ ID NO: 24812 - DNA, 21 bp, Artificial Sequence
  Synthetic
gatatgtttagggagccgtgg

SEQ ID NO: 24813 - DNA, 21 bp, Artificial Sequence
  Synthetic
agttggcaggggcggaatccg

SEQ ID NO: 24814 - DNA, 21 bp, Artificial Sequence
  Synthetic
ggtccggctgattcgaagcgg

SEQ ID NO: 24815 - DNA, 21 bp, Artificial Sequence
  Synthetic
ttgcgggttgggttttctatg

SEQ ID NO: 24816 - DNA, 21 bp, Artificial Sequence
  Synthetic
gtgttgctgtatcgtgttggg

SEQ ID NO: 24817 - DNA, 21 bp, Artificial Sequence
  Synthetic
tttaattttggtatggctcag

SEQ ID NO: 24818 - DNA, 21 bp, Artificial Sequence
  Synthetic
gagggttatcggggttcttcg

SEQ ID NO: 24819 - DNA, 21 bp, Artificial Sequence
  Synthetic
tctttgttgtcggggtttcgg

SEQ ID NO: 24820 - DNA, 21 bp, Artificial Sequence
  Synthetic
gtgaatagtttgtttagttat

SEQ ID NO: 24821 - DNA, 21 bp, Artificial Sequence
  Synthetic
caggtggctacgcagatttgg

SEQ ID NO: 24822 - DNA, 21 bp, Artificial Sequence
  Synthetic
actgagtcttggaggcgtgat

SEQ ID NO: 24823 - DNA, 21 bp, Artificial Sequence
  Synthetic
gcgtatgagcgtggttcttcg

SEQ ID NO: 24824 - DNA, 21 bp, Artificial Sequence
  Synthetic
gttgagaggggttggtcggct

SEQ ID NO: 24825 - DNA, 21 bp, Artificial Sequence
  Synthetic
cgttttgcgggtgggagtact

SEQ ID NO: 24826 - DNA, 21 bp, Artificial Sequence
  Synthetic
gcgcgggtgggtgcggctcag

SEQ ID NO: 24827 - DNA, 21 bp, Artificial Sequence
  Synthetic
atgaggggtggtcatttgagt

SEQ ID NO: 24828 - DNA, 21 bp, Artificial Sequence
  Synthetic
ctttttcatatgggttcgact

SEQ ID NO: 24829 - DNA, 21 bp, Artificial Sequence
  Synthetic
gatgtgctggcgaggccgtgg

SEQ ID NO: 24830 - DNA, 21 bp, Artificial Sequence
  Synthetic
tggcttactccgattgagagg

SEQ ID NO: 24831 - DNA, 21 bp, Artificial Sequence
  Synthetic
atttataatccgtatggggag

SEQ ID NO: 24832 - DNA, 21 bp, Artificial Sequence
  Synthetic
catgcgcatctgggtagtgct

SEQ ID NO: 24833 - DNA, 21 bp, Artificial Sequence
  Synthetic
ctgccggctgatcatcgttgg

SEQ ID NO: 24834 - DNA, 21 bp, Artificial Sequence
  Synthetic
gcgcgggttactgattattgg

SEQ ID NO: 24835 - DNA, 21 bp, Artificial Sequence
  Synthetic
cggtatcctggggatagtgtt

SEQ ID NO: 24836 - DNA, 21 bp, Artificial Sequence
  Synthetic
ggtagggctgagggtgcttgg

SEQ ID NO: 24837 - DNA, 21 bp, Artificial Sequence
  Synthetic
agggatgatattgctcgttgg

SEQ ID NO: 24838 - DNA, 21 bp, Artificial Sequence
  Synthetic
tggacgatggctgaggggtgg

SEQ ID NO: 24839 - DNA, 21 bp, Artificial Sequence
  Synthetic
gtgtggaagatggggtctact

SEQ ID NO: 24840 - DNA, 21 bp, Artificial Sequence
  Synthetic
tcgaggcctggttggagtgtt

SEQ ID NO: 24841 - DNA, 21 bp, Artificial Sequence
  Synthetic
ggggtgtgggggcttagtggt

SEQ ID NO: 24842 - DNA, 21 bp, Artificial Sequence
  Synthetic
tggcatactttggcgctgact

SEQ ID NO: 24843 - DNA, 21 bp, Artificial Sequence
  Synthetic
catcaggctaatccgtcgaag

SEQ ID NO: 24844 - DNA, 21 bp, Artificial Sequence
  Synthetic
attattgcggggtattctgcg

SEQ ID NO: 24845 - DNA, 21 bp, Artificial Sequence
  Synthetic
gagtatccttttagtagtagt

SEQ ID NO: 24846 - DNA, 21 bp, Artificial Sequence
  Synthetic
cctggttataattcggcgttt

SEQ ID NO: 24847 - DNA, 21 bp, Artificial Sequence
  Synthetic
tatgggagtttgagtgttacg

SEQ ID NO: 24848 - DNA, 21 bp, Artificial Sequence
  Synthetic
tatgttttgccggggcctcat

SEQ ID NO: 24849 - DNA, 21 bp, Artificial Sequence
  Synthetic
gagtataggtttgctgcgagt

SEQ ID NO: 24850 - DNA, 21 bp, Artificial Sequence
  Synthetic
ctggtgcatcaggggtggagt

SEQ ID NO: 24851 - DNA, 21 bp, Artificial Sequence
  Synthetic
aaggttggtgggtctatgtgg

SEQ ID NO: 24852 - DNA, 21 bp, Artificial Sequence
  Synthetic
aaggctcctggggcgaattgg

SEQ ID NO: 24853 - DNA, 21 bp, Artificial Sequence
  Synthetic
gagcatggtggtgtgaggtgg

SEQ ID NO: 24854 - DNA, 21 bp, Artificial Sequence
  Synthetic
agttggtcggggatgtcgcag

SEQ ID NO: 24855 - DNA, 21 bp, Artificial Sequence
  Synthetic
acttatcatgggggggcggct

SEQ ID NO: 24856 - DNA, 21 bp, Artificial Sequence
  Synthetic
gagcgttggcagagtgcggcg

SEQ ID NO: 24857 - DNA, 21 bp, Artificial Sequence
  Synthetic
cctattcctgctcagggttgg

SEQ ID NO: 24858 - DNA, 21 bp, Artificial Sequence
  Synthetic
ctgtggcctgcgcatagtcag

SEQ ID NO: 24859 - DNA, 21 bp, Artificial Sequence
  Synthetic
gttgattttgatgcgcatagg

SEQ ID NO: 24860 - DNA, 21 bp, Artificial Sequence
  Synthetic
gttgtgtatggggggtcgcag

SEQ ID NO: 24861 - DNA, 21 bp, Artificial Sequence
  Synthetic
ttttatagtttgggtgctgag

SEQ ID NO: 24862 - DNA, 21 bp, Artificial Sequence
  Synthetic
cgttttattcgggatcaggcg

SEQ ID NO: 24863 - DNA, 21 bp, Artificial Sequence
  Synthetic
attctggtgggttattcggtt

SEQ ID NO: 24864 - DNA, 21 bp, Artificial Sequence
  Synthetic
tggaagttggggggtgcgacg

SEQ ID NO: 24865 - DNA, 21 bp, Artificial Sequence
  Synthetic
tgggttcttcagggtgcgtcg

SEQ ID NO: 24866 - DNA, 21 bp, Artificial Sequence
  Synthetic
cctcgggagcgtggtccgtgg

SEQ ID NO: 24867 - DNA, 21 bp, Artificial Sequence
  Synthetic
atgtcgtatcatgggagtact

SEQ ID NO: 24868 - DNA, 21 bp, Artificial Sequence
  Synthetic
tcggttactactcagcattgg

SEQ ID NO: 24869 - DNA, 21 bp, Artificial Sequence
  Synthetic
gttcatcggattgttaatcag

SEQ ID NO: 24870 - DNA, 21 bp, Artificial Sequence
  Synthetic
ctgattggttggggtagtgcg

SEQ ID NO: 24871 - DNA, 21 bp, Artificial Sequence
  Synthetic
gttgggtatggtgattatcgt

SEQ ID NO: 24872 - DNA, 21 bp, Artificial Sequence
  Synthetic
tggtctcagtttgcggcgggt

SEQ ID NO: 24873 - DNA, 21 bp, Artificial Sequence
  Synthetic
ttgcttgttgggatggctcag

SEQ ID NO: 24874 - DNA, 21 bp, Artificial Sequence
  Synthetic
gatgcgagttggtcggctgct

SEQ ID NO: 24875 - DNA, 21 bp, Artificial Sequence
  Synthetic
gattatccttcgaatcgttgg

SEQ ID NO: 24876 - DNA, 21 bp, Artificial Sequence
  Synthetic
ggtcatgatcgggggccttgg

SEQ ID NO: 24877 - DNA, 21 bp, Artificial Sequence
  Synthetic
cgtgatgatagggcggtgagg

SEQ ID NO: 24878 - DNA, 21 bp, Artificial Sequence
  Synthetic
gatgatgtttctcggtgggcg

SEQ ID NO: 24879 - DNA, 21 bp, Artificial Sequence
  Synthetic
gagcggcataattatgcggct

SEQ ID NO: 24880 - DNA, 21 bp, Artificial Sequence
  Synthetic
ggtcggagtcagggtcatgtg

SEQ ID NO: 24881 - DNA, 21 bp, Artificial Sequence
  Synthetic
ctgtttattggtcaggcttcg

SEQ ID NO: 24882 - DNA, 21 bp, Artificial Sequence
  Synthetic
tttgtgacttatggttcgtct

SEQ ID NO: 24883 - DNA, 21 bp, Artificial Sequence
  Synthetic
gaggtggagtggagttatagt

SEQ ID NO: 24884 - DNA, 21 bp, Artificial Sequence
  Synthetic
aatactactacgcagtattgg

SEQ ID NO: 24885 - DNA, 21 bp, Artificial Sequence
  Synthetic
acttatattgggttgtcgagt

SEQ ID NO: 24886 - DNA, 21 bp, Artificial Sequence
  Synthetic
aagtatgatattcggtcgatt

SEQ ID NO: 24887 - DNA, 21 bp, Artificial Sequence
  Synthetic
tggatgcatgggggggctgct

SEQ ID NO: 24888 - DNA, 21 bp, Artificial Sequence
  Synthetic
tggcattcgctggctactact

SEQ ID NO: 24889 - DNA, 21 bp, Artificial Sequence
  Synthetic
attcggccggcgggttggagt

SEQ ID NO: 24890 - DNA, 21 bp, Artificial Sequence
  Synthetic
cttgataagggtactgtttat

SEQ ID NO: 24891 - DNA, 21 bp, Artificial Sequence
  Synthetic
gatgtgatgtatcgtgggttt

SEQ ID NO: 24892 - DNA, 21 bp, Artificial Sequence
  Synthetic
ccgcgggatgggtgggcttct

SEQ ID NO: 24893 - DNA, 21 bp, Artificial Sequence
  Synthetic
gctcgttcgccgaatgggtgg

SEQ ID NO: 24894 - DNA, 21 bp, Artificial Sequence
  Synthetic
cattggacgaatgggagttcg

SEQ ID NO: 24895 - DNA, 21 bp, Artificial Sequence
  Synthetic
acggcggcttgggctgcgagt

SEQ ID NO: 24896 - DNA, 21 bp, Artificial Sequence
  Synthetic
gggtcggggactagtttgtgg

SEQ ID NO: 24897 - DNA, 21 bp, Artificial Sequence
  Synthetic
aaggaggtttatgcgaattgg

SEQ ID NO: 24898 - DNA, 21 bp, Artificial Sequence
  Synthetic
acgcagaggcctcctgatcgg

SEQ ID NO: 24899 - DNA, 21 bp, Artificial Sequence
  Synthetic
atgagtactgagtattggagg

SEQ ID NO: 24900 - DNA, 21 bp, Artificial Sequence
  Synthetic
tcggtgtatgagggttttcgg

SEQ ID NO: 24901 - DNA, 21 bp, Artificial Sequence
  Synthetic
acttatgtgggtagtgcgtct

SEQ ID NO: 24902 - DNA, 21 bp, Artificial Sequence
  Synthetic
cgtgagtttgagtctcgttgg

SEQ ID NO: 24903 - DNA, 21 bp, Artificial Sequence
  Synthetic
caggttgttcgtcttgtgaat

SEQ ID NO: 24904 - DNA, 21 bp, Artificial Sequence
  Synthetic
cctgctaggggtatggcgcag

SEQ ID NO: 24905 - DNA, 21 bp, Artificial Sequence
  Synthetic
gttagtgattatgctagttgg

SEQ ID NO: 24906 - DNA, 21 bp, Artificial Sequence
  Synthetic
cgggtgttgccgaatctgatt

SEQ ID NO: 24907 - DNA, 21 bp, Artificial Sequence
  Synthetic
cgttgggagcgtgatgctgtg

SEQ ID NO: 24908 - DNA, 21 bp, Artificial Sequence
  Synthetic
actgatagtcgtttttcttat

SEQ ID NO: 24909 - DNA, 21 bp, Artificial Sequence
  Synthetic
gttgctaatgcgtatggttgg

SEQ ID NO: 24910 - DNA, 21 bp, Artificial Sequence
  Synthetic
tctgtgcggttgggttatgcg

SEQ ID NO: 24911 - DNA, 21 bp, Artificial Sequence
  Synthetic
ttggcttattcgcaggcgatg

SEQ ID NO: 24912 - DNA, 21 bp, Artificial Sequence
  Synthetic
ggtcgtgagggttgggcgtat

SEQ ID NO: 24913 - DNA, 21 bp, Artificial Sequence
  Synthetic
caggtgtgggctgggtctcag

SEQ ID NO: 24914 - DNA, 21 bp, Artificial Sequence
  Synthetic
ttgtcttattctcagactttg

SEQ ID NO: 24915 - DNA, 21 bp, Artificial Sequence
  Synthetic
ctttatttgggtcagtctact

SEQ ID NO: 24916 - DNA, 21 bp, Artificial Sequence
  Synthetic
ctgaggaatttggggtctact

SEQ ID NO: 24917 - DNA, 21 bp, Artificial Sequence
  Synthetic
tcgagggagtggtcggctgcg

SEQ ID NO: 24918 - DNA, 21 bp, Artificial Sequence
  Synthetic
tctagtccggggtatagtagt

SEQ ID NO: 24919 - DNA, 21 bp, Artificial Sequence
  Synthetic
atgtggaatagtggggctagt

SEQ ID NO: 24920 - DNA, 21 bp, Artificial Sequence
  Synthetic
tggtcggtggggggtagtcag

SEQ ID NO: 24921 - DNA, 21 bp, Artificial Sequence
  Synthetic
agtgataagaggtctgatagg

SEQ ID NO: 24922 - DNA, 21 bp, Artificial Sequence
  Synthetic
gattttcggggtggtgcggtt

SEQ ID NO: 24923 - DNA, 21 bp, Artificial Sequence
  Synthetic
gtttggagtggtatgtctcag

SEQ ID NO: 24924 - DNA, 21 bp, Artificial Sequence
  Synthetic
acggtgcctaattggagtagt

SEQ ID NO: 24925 - DNA, 21 bp, Artificial Sequence
  Synthetic
ggtggggatacggggcggtgg

SEQ ID NO: 24926 - DNA, 21 bp, Artificial Sequence
  Synthetic
gagtggatggggcaggcgtct

SEQ ID NO: 24927 - DNA, 21 bp, Artificial Sequence
  Synthetic
catgagcatgtgggtaggtgg

SEQ ID NO: 24928 - DNA, 21 bp, Artificial Sequence
  Synthetic
agtgcgggtgataatcgttgg

SEQ ID NO: 24929 - DNA, 21 bp, Artificial Sequence
  Synthetic
gtgttgattgggactgtgtat

SEQ ID NO: 24930 - DNA, 21 bp, Artificial Sequence
  Synthetic
tctgtggagcgtcagtggagt

SEQ ID NO: 24931 - DNA, 21 bp, Artificial Sequence
  Synthetic
catgagaggggtcagtggaat

SEQ ID NO: 24932 - DNA, 21 bp, Artificial Sequence
  Synthetic
tatggtgcgttgatgggtctt

SEQ ID NO: 24933 - DNA, 21 bp, Artificial Sequence
  Synthetic
cggctgcctgtgggtccgtgg

SEQ ID NO: 24934 - DNA, 21 bp, Artificial Sequence
  Synthetic
cttgcgtttatgtttagggat

SEQ ID NO: 24935 - DNA, 21 bp, Artificial Sequence
  Synthetic
gggattaataattggcatacg

SEQ ID NO: 24936 - DNA, 21 bp, Artificial Sequence
  Synthetic
gttatgaagctgtttagtgcg

SEQ ID NO: 24937 - DNA, 21 bp, Artificial Sequence
  Synthetic
gcgtggggtgggccgccgctt

SEQ ID NO: 24938 - DNA, 21 bp, Artificial Sequence
  Synthetic
gagcctacgtggggttcgtcg

SEQ ID NO: 24939 - DNA, 21 bp, Artificial Sequence
  Synthetic
ggtgggaatgttgggaagtgg

SEQ ID NO: 24940 - DNA, 21 bp, Artificial Sequence
  Synthetic
gcggctgttggttggtcgacg

SEQ ID NO: 24941 - DNA, 21 bp, Artificial Sequence
  Synthetic
gctgagtatagtaggcattgg

SEQ ID NO: 24942 - DNA, 21 bp, Artificial Sequence
  Synthetic
cgggctgagggttggtcgtcg

SEQ ID NO: 24943 - DNA, 21 bp, Artificial Sequence
  Synthetic
aaggcggattcttatgtttgg

SEQ ID NO: 24944 - DNA, 21 bp, Artificial Sequence
  Synthetic
tgggttttgccttctatgggg

SEQ ID NO: 24945 - DNA, 21 bp, Artificial Sequence
  Synthetic
ctttggagggaggggtctact

SEQ ID NO: 24946 - DNA, 21 bp, Artificial Sequence
  Synthetic
ctgccttatgatctgcgtttg

SEQ ID NO: 24947 - DNA, 21 bp, Artificial Sequence
  Synthetic
tggggtagtattgcttggaat

SEQ ID NO: 24948 - DNA, 21 bp, Artificial Sequence
  Synthetic
tggggggggtatgggagtacg

SEQ ID NO: 24949 - DNA, 21 bp, Artificial Sequence
  Synthetic
tggtttcagagtggtagtagt

SEQ ID NO: 24950 - DNA, 21 bp, Artificial Sequence
  Synthetic
catgagtttttggggtcggct

SEQ ID NO: 24951 - DNA, 21 bp, Artificial Sequence
  Synthetic
attggtgtgcttgctccgtat

SEQ ID NO: 24952 - DNA, 21 bp, Artificial Sequence
  Synthetic
gttggttggaagttgggggag

SEQ ID NO: 24953 - DNA, 21 bp, Artificial Sequence
  Synthetic
cctttgcatctgcagtatgcg

SEQ ID NO: 24954 - DNA, 21 bp, Artificial Sequence
  Synthetic
aagtatttgggggatattatg

SEQ ID NO: 24955 - DNA, 21 bp, Artificial Sequence
  Synthetic
cggcatgtgaatcatgctggt

SEQ ID NO: 24956 - DNA, 21 bp, Artificial Sequence
  Synthetic
actcgtgtgggtcagagtcag

SEQ ID NO: 24957 - DNA, 21 bp, Artificial Sequence
  Synthetic
gagaggtataatgggagtatg

SEQ ID NO: 24958 - DNA, 21 bp, Artificial Sequence
  Synthetic
gagacgaatgtgggtcgttgg

SEQ ID NO: 24959 - DNA, 21 bp, Artificial Sequence
  Synthetic
tggaagttgttgggttctacg

SEQ ID NO: 24960 - DNA, 21 bp, Artificial Sequence
  Synthetic
tggcatacgttgggggcgtcg

SEQ ID NO: 24961 - DNA, 21 bp, Artificial Sequence
  Synthetic
tgggggtcgcttaatcctttg

SEQ ID NO: 24962 - DNA, 21 bp, Artificial Sequence
  Synthetic
tggggtcctgcttcggggtat

SEQ ID NO: 24963 - DNA, 21 bp, Artificial Sequence
  Synthetic
catgcgcgtcatgatgggact

SEQ ID NO: 24964 - DNA, 21 bp, Artificial Sequence
  Synthetic
ggtcaggttcttacgagtcgg

SEQ ID NO: 24965 - DNA, 21 bp, Artificial Sequence
  Synthetic
atgtatattcctcatccgagt

SEQ ID NO: 24966 - DNA, 21 bp, Artificial Sequence
  Synthetic
tcgaggtttcagggtagtacg

SEQ ID NO: 24967 - DNA, 21 bp, Artificial Sequence
  Synthetic
ggggtttatcgtgatgggtgg

SEQ ID NO: 24968 - DNA, 21 bp, Artificial Sequence
  Synthetic
tttgatcttagtgctcggtat

SEQ ID NO: 24969 - DNA, 21 bp, Artificial Sequence
  Synthetic
ctgacgtctggtatgcattgg

SEQ ID NO: 24970 - DNA, 21 bp, Artificial Sequence
  Synthetic
gagcatgtgaagaatctgtgg

SEQ ID NO: 24971 - DNA, 21 bp, Artificial Sequence
  Synthetic
gttggttattcgctggggctg

SEQ ID NO: 24972 - DNA, 21 bp, Artificial Sequence
  Synthetic
gagagggcgccgtggagtcat

SEQ ID NO: 24973 - DNA, 21 bp, Artificial Sequence
  Synthetic
acttttttttctggggctagt

SEQ ID NO: 24974 - DNA, 21 bp, Artificial Sequence
  Synthetic
tcttggcgtcttgatattccg

SEQ ID NO: 24975 - DNA, 21 bp, Artificial Sequence
  Synthetic
tggggtgttgctgctgggtat

SEQ ID NO: 24976 - DNA, 21 bp, Artificial Sequence
  Synthetic
cgttcgttgggtctttcgcag

SEQ ID NO: 24977 - DNA, 21 bp, Artificial Sequence
  Synthetic
tttactcattatggttcggcg

SEQ ID NO: 24978 - DNA, 21 bp, Artificial Sequence
  Synthetic
gagattgatcgggttcggtgg

SEQ ID NO: 24979 - DNA, 21 bp, Artificial Sequence
  Synthetic
ctttggactgctggtgctact

SEQ ID NO: 24980 - DNA, 21 bp, Artificial Sequence
  Synthetic
gagcggttttttggtgcggcg

SEQ ID NO: 24981 - DNA, 21 bp, Artificial Sequence
  Synthetic
aaggaggcgtgggaggtgagg

SEQ ID NO: 24982 - DNA, 21 bp, Artificial Sequence
  Synthetic
tgggggctttttctgtcggag

SEQ ID NO: 24983 - DNA, 21 bp, Artificial Sequence
  Synthetic
ttgcatgcgggttttgggttt

SEQ ID NO: 24984 - DNA, 21 bp, Artificial Sequence
  Synthetic
gagctgtggagtggtagtacg

SEQ ID NO: 24985 - DNA, 21 bp, Artificial Sequence
  Synthetic
caggctcatggtattccgaag

SEQ ID NO: 24986 - DNA, 21 bp, Artificial Sequence
  Synthetic
ccgattcgggggttttctacg

SEQ ID NO: 24987 - DNA, 21 bp, Artificial Sequence
  Synthetic
ccgattcctacggcttattat

SEQ ID NO: 24988 - DNA, 21 bp, Artificial Sequence
  Synthetic
agggtggagcctagtttgcgt

SEQ ID NO: 24989 - DNA, 21 bp, Artificial Sequence
  Synthetic
gtgaagacttatggtagtagt

SEQ ID NO: 24990 - DNA, 21 bp, Artificial Sequence
  Synthetic
agtcttccggggtggtctgct

SEQ ID NO: 24991 - DNA, 21 bp, Artificial Sequence
  Synthetic
gggcgttttatggggtcggtg

SEQ ID NO: 24992 - DNA, 21 bp, Artificial Sequence
  Synthetic
gattcgccgagggcgatttat

SEQ ID NO: 24993 - DNA, 21 bp, Artificial Sequence
  Synthetic
tggggggtgtatgtttcgaag

SEQ ID NO: 24994 - DNA, 21 bp, Artificial Sequence
  Synthetic
agggtgcatgggtggggtgat

SEQ ID NO: 24995 - DNA, 21 bp, Artificial Sequence
  Synthetic
gtgtatcagaatccgttgcgg

SEQ ID NO: 24996 - DNA, 21 bp, Artificial Sequence
  Synthetic
tatgggtttttggcggctgtg

SEQ ID NO: 24997 - DNA, 21 bp, Artificial Sequence
  Synthetic
ggtggggatcgttgggcttat

SEQ ID NO: 24998 - DNA, 21 bp, Artificial Sequence
  Synthetic
gggagggctgatctgtcgcgg

SEQ ID NO: 24999 - DNA, 21 bp, Artificial Sequence
  Synthetic
ttgagttatggttattctgtg

SEQ ID NO: 25000 - DNA, 21 bp, Artificial Sequence
  Synthetic
tcggagcggttgctgccgtat

SEQ ID NO: 25001 - DNA, 21 bp, Artificial Sequence
  Synthetic
atgtatcatggtttgagtttt

SEQ ID NO: 25002 - DNA, 21 bp, Artificial Sequence
  Synthetic
atgtttactgggttttcgagt

SEQ ID NO: 25003 - DNA, 21 bp, Artificial Sequence
  Synthetic
ttgtgggataatagggctgct

SEQ ID NO: 25004 - DNA, 21 bp, Artificial Sequence
  Synthetic
ctggtgactcatggttcttct

SEQ ID NO: 25005 - DNA, 21 bp, Artificial Sequence
  Synthetic
gctagggagccggcgagtagg

SEQ ID NO: 25006 - DNA, 21 bp, Artificial Sequence
  Synthetic
aagattgcgtatagtgattgg

SEQ ID NO: 25007 - DNA, 21 bp, Artificial Sequence
  Synthetic
tatccgaattggcgttctgat

SEQ ID NO: 25008 - DNA, 21 bp, Artificial Sequence
  Synthetic
ggtgggccttatgatctgcgt

SEQ ID NO: 25009 - DNA, 21 bp, Artificial Sequence
  Synthetic
attctgtatagtcaggcgatt

SEQ ID NO: 25010 - DNA, 21 bp, Artificial Sequence
  Synthetic
ttggttcctcatttttctagt

SEQ ID NO: 25011 - DNA, 21 bp, Artificial Sequence
  Synthetic
tggccgattatgacgtcggat

SEQ ID NO: 25012 - DNA, 21 bp, Artificial Sequence
  Synthetic
tattcggtgtcgcatggttat

SEQ ID NO: 25013 - DNA, 21 bp, Artificial Sequence
  Synthetic
aagtatgagacgaatcattgg

SEQ ID NO: 25014 - DNA, 21 bp, Artificial Sequence
  Synthetic
tatcattttgctggtagtact

SEQ ID NO: 25015 - DNA, 21 bp, Artificial Sequence
  Synthetic
cagagtgcgggttggagtact

SEQ ID NO: 25016 - DNA, 21 bp, Artificial Sequence
  Synthetic
tggggttcgcttgatgtgttg

SEQ ID NO: 25017 - DNA, 21 bp, Artificial Sequence
  Synthetic
tggtctctggaggggtcgagg

SEQ ID NO: 25018 - DNA, 21 bp, Artificial Sequence
  Synthetic
actacggtgcatgcgtatgtg

SEQ ID NO: 25019 - DNA, 21 bp, Artificial Sequence
  Synthetic
atgcggggtgtttatgcgggt

SEQ ID NO: 25020 - DNA, 21 bp, Artificial Sequence
  Synthetic
ccgcagtatagtttggctatt

SEQ ID NO: 25021 - DNA, 21 bp, Artificial Sequence
  Synthetic
tttgtgtatggtactactcat

SEQ ID NO: 25022 - DNA, 21 bp, Artificial Sequence
  Synthetic
ttggttattggtcagtcgtcg

SEQ ID NO: 25023 - DNA, 21 bp, Artificial Sequence
  Synthetic
gttgctactggggggttttgg

SEQ ID NO: 25024 - DNA, 21 bp, Artificial Sequence
  Synthetic
ctggggtatacgtataaggct

SEQ ID NO: 25025 - DNA, 21 bp, Artificial Sequence
  Synthetic
aggagttctcatatggattgg

SEQ ID NO: 25026 - DNA, 21 bp, Artificial Sequence
  Synthetic
agtccgatttggaagttggat

SEQ ID NO: 25027 - DNA, 21 bp, Artificial Sequence
  Synthetic
agttttgttgggatgagtcag

SEQ ID NO: 25028 - DNA, 21 bp, Artificial Sequence
  Synthetic
cctaatcttgttggggggtgg

SEQ ID NO: 25029 - DNA, 21 bp, Artificial Sequence
  Synthetic
tggactgtgggggggtctact

SEQ ID NO: 25030 - DNA, 21 bp, Artificial Sequence
  Synthetic
gaggttatgtcgagtaggtgg

SEQ ID NO: 25031 - DNA, 21 bp, Artificial Sequence
  Synthetic
agtttttatgggggttctcat

SEQ ID NO: 25032 - DNA, 21 bp, Artificial Sequence
  Synthetic
aagccgggttatactggttgg

SEQ ID NO: 25033 - DNA, 21 bp, Artificial Sequence
  Synthetic
aaggttgattataatgggtgg

SEQ ID NO: 25034 - DNA, 21 bp, Artificial Sequence
  Synthetic
gcgggggtgggtttttcgatg

SEQ ID NO: 25035 - DNA, 21 bp, Artificial Sequence
  Synthetic
tggggtgctttggggcctatt

SEQ ID NO: 25036 - DNA, 21 bp, Artificial Sequence
  Synthetic
tggagtacgaattcgggttgg

SEQ ID NO: 25037 - DNA, 21 bp, Artificial Sequence
  Synthetic
tggattgagggtgggtctcag

SEQ ID NO: 25038 - DNA, 21 bp, Artificial Sequence
  Synthetic
atgcatggttttggttcgacg

SEQ ID NO: 25039 - DNA, 21 bp, Artificial Sequence
  Synthetic
tgtggtgcgcatactccttgg

SEQ ID NO: 25040 - DNA, 21 bp, Artificial Sequence
  Synthetic
ctgaagtatcatcttgagcat

SEQ ID NO: 25041 - DNA, 21 bp, Artificial Sequence
  Synthetic
ttgtgggttccgggggctgct

SEQ ID NO: 25042 - DNA, 21 bp, Artificial Sequence
  Synthetic
gagtattatcgtgggtcggtt

SEQ ID NO: 25043 - DNA, 21 bp, Artificial Sequence
  Synthetic
gctcgttttacggagtatcat

SEQ ID NO: 25044 - DNA, 21 bp, Artificial Sequence
  Synthetic
cgtgcgccgtttcttgctagt

SEQ ID NO: 25045 - DNA, 21 bp, Artificial Sequence
  Synthetic
gttagggctggttattcttcg

SEQ ID NO: 25046 - DNA, 21 bp, Artificial Sequence
  Synthetic
agtatttatatgggggcggcg

SEQ ID NO: 25047 - DNA, 21 bp, Artificial Sequence
  Synthetic
tgggctaatgggatgttgaag

SEQ ID NO: 25048 - DNA, 21 bp, Artificial Sequence
  Synthetic
agtaagttgccttattcttat

SEQ ID NO: 25049 - DNA, 21 bp, Artificial Sequence
  Synthetic
catccggcgcgggagggtagg

SEQ ID NO: 25050 - DNA, 21 bp, Artificial Sequence
  Synthetic
tatagtagttggcagagggat

SEQ ID NO: 25051 - DNA, 21 bp, Artificial Sequence
  Synthetic
tctgcgcttccgtttgctttt

SEQ ID NO: 25052 - DNA, 21 bp, Artificial Sequence
  Synthetic
ggtggggagccggggcggtgg

SEQ ID NO: 25053 - DNA, 21 bp, Artificial Sequence
  Synthetic
catgtgaattggcgtgcggat

SEQ ID NO: 25054 - DNA, 21 bp, Artificial Sequence
  Synthetic
ccgtatggtgctggtgtttgg

SEQ ID NO: 25055 - DNA, 21 bp, Artificial Sequence
  Synthetic
gagcataagctgtttagtgcg

SEQ ID NO: 25056 - DNA, 21 bp, Artificial Sequence
  Synthetic
cttctgttgcgtgagtcgctg

SEQ ID NO: 25057 - DNA, 21 bp, Artificial Sequence
  Synthetic
gttcggatgggtcagtcgcag

SEQ ID NO: 25058 - DNA, 21 bp, Artificial Sequence
  Synthetic
agggggggtcaggggatttcg

SEQ ID NO: 25059 - DNA, 21 bp, Artificial Sequence
  Synthetic
gatttgagtagttctcgttgg

SEQ ID NO: 25060 - DNA, 21 bp, Artificial Sequence
  Synthetic
cgtcatgttgcggatcgtacg

SEQ ID NO: 25061 - DNA, 21 bp, Artificial Sequence
  Synthetic
aggacttatgggacgtctcag

SEQ ID NO: 25062 - DNA, 21 bp, Artificial Sequence
  Synthetic
cagggtccgaattggtcgact

SEQ ID NO: 25063 - DNA, 21 bp, Artificial Sequence
  Synthetic
gagaggaatggttggagtact

SEQ ID NO: 25064 - DNA, 21 bp, Artificial Sequence
  Synthetic
ccggggcatctgtatagtgct

SEQ ID NO: 25065 - DNA, 21 bp, Artificial Sequence
  Synthetic
aatgggtatgaggggcggtat

SEQ ID NO: 25066 - DNA, 21 bp, Artificial Sequence
  Synthetic
gtgtggggtggttttagtgag

SEQ ID NO: 25067 - DNA, 21 bp, Artificial Sequence
  Synthetic
cgggggcttggggttaatcat

SEQ ID NO: 25068 - DNA, 21 bp, Artificial Sequence
  Synthetic
cttgtgactcatggtgcgtct

SEQ ID NO: 25069 - DNA, 21 bp, Artificial Sequence
  Synthetic
caggggggtcctgctttgcgt

SEQ ID NO: 25070 - DNA, 21 bp, Artificial Sequence
  Synthetic
tgggttgctttgccgactgtt

SEQ ID NO: 25071 - DNA, 21 bp, Artificial Sequence
  Synthetic
tggagtcctgggaatggttat

SEQ ID NO: 25072 - DNA, 21 bp, Artificial Sequence
  Synthetic
gcggagtatcggggtagtagt

SEQ ID NO: 25073 - DNA, 21 bp, Artificial Sequence
  Synthetic
ccttttcctggtcctcttcat

SEQ ID NO: 25074 - DNA, 21 bp, Artificial Sequence
  Synthetic
agtggggcgccgggtgcttgg

SEQ ID NO: 25075 - DNA, 21 bp, Artificial Sequence
  Synthetic
tggtctactgggcaggggtat

SEQ ID NO: 25076 - DNA, 21 bp, Artificial Sequence
  Synthetic
ggtgtggatcgggggaagtgg

SEQ ID NO: 25077 - DNA, 21 bp, Artificial Sequence
  Synthetic
gctcgtcctagtattgggtat

SEQ ID NO: 25078 - DNA, 21 bp, Artificial Sequence
  Synthetic
gattctgtgccggggcggtgg

SEQ ID NO: 25079 - DNA, 21 bp, Artificial Sequence
  Synthetic
gggatggttgggaatgggtgg

SEQ ID NO: 25080 - DNA, 21 bp, Artificial Sequence
  Synthetic
tctgggcatggtcagtgggct

SEQ ID NO: 25081 - DNA, 21 bp, Artificial Sequence
  Synthetic
gcgatgaggtatgggagtgcg

SEQ ID NO: 25082 - DNA, 21 bp, Artificial Sequence
  Synthetic
ccgcatccgctgggttatggt

SEQ ID NO: 25083 - DNA, 21 bp, Artificial Sequence
  Synthetic
gcggattatgatactcggtgg

SEQ ID NO: 25084 - DNA, 21 bp, Artificial Sequence
  Synthetic
ccggtgtctgatgggcggtgg

SEQ ID NO: 25085 - DNA, 21 bp, Artificial Sequence
  Synthetic
gagcctagtgggggtcgttgg

SEQ ID NO: 25086 - DNA, 21 bp, Artificial Sequence
  Synthetic
agtcattatgggcagagttct

SEQ ID NO: 25087 - DNA, 21 bp, Artificial Sequence
  Synthetic
gatgttttttatagttcttct

SEQ ID NO: 25088 - DNA, 21 bp, Artificial Sequence
  Synthetic
agtcatcctgggtgggctgct

SEQ ID NO: 25089 - DNA, 21 bp, Artificial Sequence
  Synthetic
gcgggggatattgcgaggtgg

SEQ ID NO: 25090 - DNA, 21 bp, Artificial Sequence
  Synthetic
attaatagttggcgggctgat

SEQ ID NO: 25091 - DNA, 21 bp, Artificial Sequence
  Synthetic
tcttattttagtcagtctatt

SEQ ID NO: 25092 - DNA, 21 bp, Artificial Sequence
  Synthetic
catatgatgcgtaataatatt

SEQ ID NO: 25093 - DNA, 21 bp, Artificial Sequence
  Synthetic
gaggagtatatgggttcgtct

SEQ ID NO: 25094 - DNA, 21 bp, Artificial Sequence
  Synthetic
aggacggttgctgagtggtgg

SEQ ID NO: 25095 - DNA, 21 bp, Artificial Sequence
  Synthetic
gagacgtatggtcagcgttgg

SEQ ID NO: 25096 - DNA, 21 bp, Artificial Sequence
  Synthetic
tggggttctcttgctcgtttg

SEQ ID NO: 25097 - DNA, 21 bp, Artificial Sequence
  Synthetic
gttgttacgcatgggtggagt

SEQ ID NO: 25098 - DNA, 21 bp, Artificial Sequence
  Synthetic
ggtagtacggttgggccttgg

SEQ ID NO: 25099 - DNA, 21 bp, Artificial Sequence
  Synthetic
aagtttagtcttgtgggttat

SEQ ID NO: 25100 - DNA, 21 bp, Artificial Sequence
  Synthetic
aagcctcatggtcatgggccg

SEQ ID NO: 25101 - DNA, 21 bp, Artificial Sequence
  Synthetic
gttacgaatccggggcgttgg

SEQ ID NO: 25102 - DNA, 21 bp, Artificial Sequence
  Synthetic
ccgattcagtctggttattgg

SEQ ID NO: 25103 - DNA, 21 bp, Artificial Sequence
  Synthetic
ctgacgcagggttattcgcag

SEQ ID NO: 25104 - DNA, 21 bp, Artificial Sequence
  Synthetic
tggcgggatcttcctgaggtt

SEQ ID NO: 25105 - DNA, 21 bp, Artificial Sequence
  Synthetic
ggtgcggttattgggccgcgg

SEQ ID NO: 25106 - DNA, 21 bp, Artificial Sequence
  Synthetic
acgcttcgtttggggagttct

SEQ ID NO: 25107 - DNA, 21 bp, Artificial Sequence
  Synthetic
ctgcgtgcgaattggagtgcg

SEQ ID NO: 25108 - DNA, 21 bp, Artificial Sequence
  Synthetic
ggtgcgtctgttggggcttgg

SEQ ID NO: 25109 - DNA, 21 bp, Artificial Sequence
  Synthetic
tctcctcagtggagtattgcg

SEQ ID NO: 25110 - DNA, 21 bp, Artificial Sequence
  Synthetic
atgaattggcaggggagtgcg

SEQ ID NO: 25111 - DNA, 21 bp, Artificial Sequence
  Synthetic
tcgggtgatagtgggcggtgg

SEQ ID NO: 25112 - DNA, 21 bp, Artificial Sequence
  Synthetic
acggagtggaggggtgcggcg

SEQ ID NO: 25113 - DNA, 21 bp, Artificial Sequence
  Synthetic
cggaatcatccgtctccgcag

SEQ ID NO: 25114 - DNA, 21 bp, Artificial Sequence
  Synthetic
gatgagcggttgctgcagtat

SEQ ID NO: 25115 - DNA, 21 bp, Artificial Sequence
  Synthetic
attgttccgggttattcgtcg

SEQ ID NO: 25116 - DNA, 21 bp, Artificial Sequence
  Synthetic
gtgattacttatgggtcttct

SEQ ID NO: 25117 - DNA, 21 bp, Artificial Sequence
  Synthetic
tggaggctttctgggtcggcg

SEQ ID NO: 25118 - DNA, 21 bp, Artificial Sequence
  Synthetic
attctgggttatggtcatttg

SEQ ID NO: 25119 - DNA, 21 bp, Artificial Sequence
  Synthetic
gttcctgcggatagtaggtgg

SEQ ID NO: 25120 - DNA, 21 bp, Artificial Sequence
  Synthetic
tcttttgctggtggggctagt

SEQ ID NO: 25121 - DNA, 21 bp, Artificial Sequence
  Synthetic
gttccgtatagtcttacggtt

SEQ ID NO: 25122 - DNA, 21 bp, Artificial Sequence
  Synthetic
cgttatgtgccggcgccggct

SEQ ID NO: 25123 - DNA, 21 bp, Artificial Sequence
  Synthetic
tcttttcaggggggtcagtgg

SEQ ID NO: 25124 - DNA, 21 bp, Artificial Sequence
  Synthetic
gagattattacggcgcgtttt

SEQ ID NO: 25125 - DNA, 21 bp, Artificial Sequence
  Synthetic
cctgctgttgtgcttaagatt

SEQ ID NO: 25126 - DNA, 21 bp, Artificial Sequence
  Synthetic
ttggcgtatatgggtagtgtg

SEQ ID NO: 25127 - DNA, 21 bp, Artificial Sequence
  Synthetic
catgagcgtgggtatagttcg

SEQ ID NO: 25128 - DNA, 21 bp, Artificial Sequence
  Synthetic
cttacggctgggtattcgagt

SEQ ID NO: 25129 - DNA, 21 bp, Artificial Sequence
  Synthetic
tttggtcttggttattcgacg

SEQ ID NO: 25130 - DNA, 21 bp, Artificial Sequence
  Synthetic
aggttggagtgggatagggcg

SEQ ID NO: 25131 - DNA, 21 bp, Artificial Sequence
  Synthetic
tcgatgactggtccgatgtat

SEQ ID NO: 25132 - DNA, 21 bp, Artificial Sequence
  Synthetic
acttcgcgtgggtatgctagt

SEQ ID NO: 25133 - DNA, 21 bp, Artificial Sequence
  Synthetic
gttcgtgagaatcatcctcgg

SEQ ID NO: 25134 - DNA, 21 bp, Artificial Sequence
  Synthetic
cggcagttgaatgatagtcgt

SEQ ID NO: 25135 - DNA, 21 bp, Artificial Sequence
  Synthetic
gtggcttggaatggtagtatt

SEQ ID NO: 25136 - DNA, 21 bp, Artificial Sequence
  Synthetic
ccttgggtgtcggcggcgagt

SEQ ID NO: 25137 - DNA, 21 bp, Artificial Sequence
  Synthetic
atgaggatgaatggtagtatt

SEQ ID NO: 25138 - DNA, 21 bp, Artificial Sequence
  Synthetic
ttgcatgctggttttagtcat

SEQ ID NO: 25139 - DNA, 21 bp, Artificial Sequence
  Synthetic
ccttggcatgggacgagttcg

SEQ ID NO: 25140 - DNA, 21 bp, Artificial Sequence
  Synthetic
gtggctagtctgttgccttat

SEQ ID NO: 25141 - DNA, 21 bp, Artificial Sequence
  Synthetic
tttaggcatcagagtgagagt

SEQ ID NO: 25142 - DNA, 21 bp, Artificial Sequence
  Synthetic
cggcagcggtcggatcttgct

SEQ ID NO: 25143 - DNA, 21 bp, Artificial Sequence
  Synthetic
tttgtgcaggtggcgattagt

SEQ ID NO: 25144 - DNA, 21 bp, Artificial Sequence
  Synthetic
ctgaggcatcagggttctatg

SEQ ID NO: 25145 - DNA, 21 bp, Artificial Sequence
  Synthetic
ctgcgtgtgcagggtagtagt

SEQ ID NO: 25146 - DNA, 21 bp, Artificial Sequence
  Synthetic
gttacgtttgggtattcgact

SEQ ID NO: 25147 - DNA, 21 bp, Artificial Sequence
  Synthetic
tcggagcggtatgggagtagt

SEQ ID NO: 25148 - DNA, 21 bp, Artificial Sequence
  Synthetic
attacgagttcttcgtggaat

SEQ ID NO: 25149 - DNA, 21 bp, Artificial Sequence
  Synthetic
ggggggtgggatatggttgtg

SEQ ID NO: 25150 - DNA, 21 bp, Artificial Sequence
  Synthetic
tcttattcgtatgggagtgcg

SEQ ID NO: 25151 - DNA, 21 bp, Artificial Sequence
  Synthetic
gtgaggtattctgttggtctg

SEQ ID NO: 25152 - DNA, 21 bp, Artificial Sequence
  Synthetic
gatcgtagtcctgggatgtgg

SEQ ID NO: 25153 - DNA, 21 bp, Artificial Sequence
  Synthetic
aagtttccgggtgcgagttcg

SEQ ID NO: 25154 - DNA, 21 bp, Artificial Sequence
  Synthetic
gattatagtcatgtggggtgg

SEQ ID NO: 25155 - DNA, 21 bp, Artificial Sequence
  Synthetic
cctttttcgtatagtgcgtct

SEQ ID NO: 25156 - DNA, 21 bp, Artificial Sequence
  Synthetic
ggggtttatgaggggatgtat

SEQ ID NO: 25157 - DNA, 21 bp, Artificial Sequence
  Synthetic
attatgctgtcgcaggctatg

SEQ ID NO: 25158 - DNA, 21 bp, Artificial Sequence
  Synthetic
gttcagtatcatctgccgctt

SEQ ID NO: 25159 - DNA, 21 bp, Artificial Sequence
  Synthetic
cggtttactggtgataattct

SEQ ID NO: 25160 - DNA, 21 bp, Artificial Sequence
  Synthetic
gggttgcatgttggttcttgg

SEQ ID NO: 25161 - DNA, 21 bp, Artificial Sequence
  Synthetic
atgggttctcctggtatttgg

SEQ ID NO: 25162 - DNA, 21 bp, Artificial Sequence
  Synthetic
gattataggccggcttcgcat

SEQ ID NO: 25163 - DNA, 21 bp, Artificial Sequence
  Synthetic
agtcgggcggggtatgcggcg

SEQ ID NO: 25164 - DNA, 21 bp, Artificial Sequence
  Synthetic
gtgttgagggggagtgtttat

SEQ ID NO: 25165 - DNA, 21 bp, Artificial Sequence
  Synthetic
ccgaatcagtttagtggttat

SEQ ID NO: 25166 - DNA, 21 bp, Artificial Sequence
  Synthetic
atggctgcttatcaggcttcg

SEQ ID NO: 25167 - DNA, 21 bp, Artificial Sequence
  Synthetic
gcggagtggaaggggtctagt

SEQ ID NO: 25168 - DNA, 21 bp, Artificial Sequence
  Synthetic
tggcaggcgtatgggtcggtt

SEQ ID NO: 25169 - DNA, 21 bp, Artificial Sequence
  Synthetic
tggacgccgggtgggtcgcag

SEQ ID NO: 25170 - DNA, 21 bp, Artificial Sequence
  Synthetic
gatgaggttaagccggatcat

SEQ ID NO: 25171 - DNA, 21 bp, Artificial Sequence
  Synthetic
aaggtggagagtgcgtattgg

SEQ ID NO: 25172 - DNA, 21 bp, Artificial Sequence
  Synthetic
gcggcgtcgtttggtagttct

SEQ ID NO: 25173 - DNA, 21 bp, Artificial Sequence
  Synthetic
gcggtggttggttggtcttcg

SEQ ID NO: 25174 - DNA, 21 bp, Artificial Sequence
  Synthetic
cttattcctcggggtagtacg

SEQ ID NO: 25175 - DNA, 21 bp, Artificial Sequence
  Synthetic
tttgctcgtgcttcttgggat

SEQ ID NO: 25176 - DNA, 21 bp, Artificial Sequence
  Synthetic
gagaattttcgtgggtcgacg

SEQ ID NO: 25177 - DNA, 21 bp, Artificial Sequence
  Synthetic
ttgattgctggttatagtcag

SEQ ID NO: 25178 - DNA, 21 bp, Artificial Sequence
  Synthetic
actcgtgtgagtcagtgggag

SEQ ID NO: 25179 - DNA, 21 bp, Artificial Sequence
  Synthetic
gctaagattactaatggttgg

SEQ ID NO: 25180 - DNA, 21 bp, Artificial Sequence
  Synthetic
agggctgggcctgagatgaag

SEQ ID NO: 25181 - DNA, 21 bp, Artificial Sequence
  Synthetic
gggtcgcttaaggggtcgtgg

SEQ ID NO: 25182 - DNA, 21 bp, Artificial Sequence
  Synthetic
gagaagtggagtggtagttct

SEQ ID NO: 25183 - DNA, 21 bp, Artificial Sequence
  Synthetic
ccgtatgttgggtcggctcag

SEQ ID NO: 25184 - DNA, 21 bp, Artificial Sequence
  Synthetic
ccgcgttttcagtatggggag

SEQ ID NO: 25185 - DNA, 21 bp, Artificial Sequence
  Synthetic
acttattatcatggttctgcg

SEQ ID NO: 25186 - DNA, 21 bp, Artificial Sequence
  Synthetic
ttgttgtctacggatatgaat

SEQ ID NO: 25187 - DNA, 21 bp, Artificial Sequence
  Synthetic
agttggcatggttcggcggct

SEQ ID NO: 25188 - DNA, 21 bp, Artificial Sequence
  Synthetic
tttattagtctgccgagtgtg

SEQ ID NO: 25189 - DNA, 21 bp, Artificial Sequence
  Synthetic
tggcttcggctggggtcggcg

SEQ ID NO: 25190 - DNA, 21 bp, Artificial Sequence
  Synthetic
tgggttcttcctctggggggg

SEQ ID NO: 25191 - DNA, 21 bp, Artificial Sequence
  Synthetic
ggtctgcatctgaatagttgg

SEQ ID NO: 25192 - DNA, 21 bp, Artificial Sequence
  Synthetic
gggtatagttatactggtagt

SEQ ID NO: 25193 - DNA, 21 bp, Artificial Sequence
  Synthetic
atgcatgggcagactagtcgg

SEQ ID NO: 25194 - DNA, 21 bp, Artificial Sequence
  Synthetic
gattttgttggggcgcgtttt

SEQ ID NO: 25195 - DNA, 21 bp, Artificial Sequence
  Synthetic
gtttattcgctgaagagtatt

SEQ ID NO: 25196 - DNA, 21 bp, Artificial Sequence
  Synthetic
gggaatcatcatggtgtttgg

SEQ ID NO: 25197 - DNA, 21 bp, Artificial Sequence
  Synthetic
agtgtgtgggggggggcgcag

SEQ ID NO: 25198 - DNA, 21 bp, Artificial Sequence
  Synthetic
actcagtggaagtttgagcat

SEQ ID NO: 25199 - DNA, 21 bp, Artificial Sequence
  Synthetic
aggtcggatcatatgctgtgg

SEQ ID NO: 25200 - DNA, 21 bp, Artificial Sequence
  Synthetic
cctgcgtgggggcaggcgtat

SEQ ID NO: 25201 - DNA, 21 bp, Artificial Sequence
  Synthetic
attacgacgttggtggtggcg

SEQ ID NO: 25202 - DNA, 21 bp, Artificial Sequence
  Synthetic
aatcatgctcgggctatttcg

SEQ ID NO: 25203 - DNA, 21 bp, Artificial Sequence
  Synthetic
gagattccgacgtggtcgcat

SEQ ID NO: 25204 - DNA, 21 bp, Artificial Sequence
  Synthetic
ggtacttatactgggtatggg

SEQ ID NO: 25205 - DNA, 21 bp, Artificial Sequence
  Synthetic
cgttttcatagtgatgctagt

SEQ ID NO: 25206 - DNA, 21 bp, Artificial Sequence
  Synthetic
atgatttcgcgtggtagtgcg

SEQ ID NO: 25207 - DNA, 21 bp, Artificial Sequence
  Synthetic
tatgttccgcttccttatttt

SEQ ID NO: 25208 - DNA, 21 bp, Artificial Sequence
  Synthetic
tcggggttgtttatgtctacg

SEQ ID NO: 25209 - DNA, 21 bp, Artificial Sequence
  Synthetic
gtggagaggcttggttcggct

SEQ ID NO: 25210 - DNA, 21 bp, Artificial Sequence
  Synthetic
tatgcgacgtggagtgcgaat

SEQ ID NO: 25211 - DNA, 21 bp, Artificial Sequence
  Synthetic
gagtcttgggggacggctcag

SEQ ID NO: 25212 - DNA, 21 bp, Artificial Sequence
  Synthetic
ccggaggttgcggggcggtgg

SEQ ID NO: 25213 - DNA, 21 bp, Artificial Sequence
  Synthetic
gatttgatgacttcgcgttgg

SEQ ID NO: 25214 - DNA, 21 bp, Artificial Sequence
  Synthetic
ctttattctgggtatactccg

SEQ ID NO: 25215 - DNA, 21 bp, Artificial Sequence
  Synthetic
gagccttatagggcttttacg

SEQ ID NO: 25216 - DNA, 21 bp, Artificial Sequence
  Synthetic
ggttctagtccgggtatgtgg

SEQ ID NO: 25217 - DNA, 21 bp, Artificial Sequence
  Synthetic
ggtgtggattcgtatcggtgg

SEQ ID NO: 25218 - DNA, 21 bp, Artificial Sequence
  Synthetic
tggggtgctttgaatcgtatg

SEQ ID NO: 25219 - DNA, 21 bp, Artificial Sequence
  Synthetic
gtgcgtgaggagattcgtcgt

SEQ ID NO: 25220 - DNA, 21 bp, Artificial Sequence
  Synthetic
gatgtttggaatggtagtacg

SEQ ID NO: 25221 - DNA, 21 bp, Artificial Sequence
  Synthetic
gatagggatcggggtttgcgt

SEQ ID NO: 25222 - DNA, 21 bp, Artificial Sequence
  Synthetic
tgtaatggtcggagttgttct

SEQ ID NO: 25223 - DNA, 21 bp, Artificial Sequence
  Synthetic
tatgttgagtttcctcggctg

SEQ ID NO: 25224 - DNA, 21 bp, Artificial Sequence
  Synthetic
gtttggccggcgacgtctacg

SEQ ID NO: 25225 - DNA, 21 bp, Artificial Sequence
  Synthetic
acgcctcggaattggcatgat

SEQ ID NO: 25226 - DNA, 21 bp, Artificial Sequence
  Synthetic
gctgcgtgggggagtgtgagt

SEQ ID NO: 25227 - DNA, 21 bp, Artificial Sequence
  Synthetic
gatactattaagcctaatcgg

SEQ ID NO: 25228 - DNA, 21 bp, Artificial Sequence
  Synthetic
tcttatgagcgtacgtgggat

SEQ ID NO: 25229 - DNA, 21 bp, Artificial Sequence
  Synthetic
gagccgcgtgattttagttgg

SEQ ID NO: 25230 - DNA, 21 bp, Artificial Sequence
  Synthetic
cgtggtgatgtgactatgagg

SEQ ID NO: 25231 - DNA, 21 bp, Artificial Sequence
  Synthetic
agggcggctgggttttctagt

SEQ ID NO: 25232 - DNA, 21 bp, Artificial Sequence
  Synthetic
cggtatgcttcggatgctgct

SEQ ID NO: 25233 - DNA, 21 bp, Artificial Sequence
  Synthetic
agggatagttatagggattgg

SEQ ID NO: 25234 - DNA, 21 bp, Artificial Sequence
  Synthetic
ggggagcatatgggtatgtgg

SEQ ID NO: 25235 - DNA, 21 bp, Artificial Sequence
  Synthetic
gttattgattctcagcattgg

SEQ ID NO: 25236 - DNA, 21 bp, Artificial Sequence
  Synthetic
tttgtgagtcttcctgatgtt

SEQ ID NO: 25237 - DNA, 21 bp, Artificial Sequence
  Synthetic
ttggggtggggttcttcgacg

SEQ ID NO: 25238 - DNA, 21 bp, Artificial Sequence
  Synthetic
atttttccgggggagtcgcag

SEQ ID NO: 25239 - DNA, 21 bp, Artificial Sequence
  Synthetic
catggtagtggtgctttgaag

SEQ ID NO: 25240 - DNA, 21 bp, Artificial Sequence
  Synthetic
tcgggttggcatggttcttct

SEQ ID NO: 25241 - DNA, 21 bp, Artificial Sequence
  Synthetic
gcggtgggggctagggttacg

SEQ ID NO: 25242 - DNA, 21 bp, Artificial Sequence
  Synthetic
cgtaatgttaatgttgatcgt

SEQ ID NO: 25243 - DNA, 21 bp, Artificial Sequence
  Synthetic
tggaagagtactactactcat

SEQ ID NO: 25244 - DNA, 21 bp, Artificial Sequence
  Synthetic
gggatgcgtgatcctgtgtgg

SEQ ID NO: 25245 - DNA, 21 bp, Artificial Sequence
  Synthetic
gttgggccgcataggccgcat

SEQ ID NO: 25246 - DNA, 21 bp, Artificial Sequence
  Synthetic
actggtcatgctgggatttgg

SEQ ID NO: 25247 - DNA, 21 bp, Artificial Sequence
  Synthetic
ttgaattatagtcattctatg

SEQ ID NO: 25248 - DNA, 21 bp, Artificial Sequence
  Synthetic
tatggtcggttggatgctctt

SEQ ID NO: 25249 - DNA, 21 bp, Artificial Sequence
  Synthetic
tggggtgcgctttctggtttg

SEQ ID NO: 25250 - DNA, 21 bp, Artificial Sequence
  Synthetic
gttgctagtgggtggtcgacg

SEQ ID NO: 25251 - DNA, 21 bp, Artificial Sequence
  Synthetic
gatgcggtggctgttaggtgg

SEQ ID NO: 25252 - DNA, 21 bp, Artificial Sequence
  Synthetic
attatgcgtaatttggtgcat

SEQ ID NO: 25253 - DNA, 21 bp, Artificial Sequence
  Synthetic
gcggggcatcgtactctggcg

SEQ ID NO: 25254 - DNA, 21 bp, Artificial Sequence
  Synthetic
aaggtgattcaggcgagttgg

SEQ ID NO: 25255 - DNA, 21 bp, Artificial Sequence
  Synthetic
gagccttataggcatttgcat

SEQ ID NO: 25256 - DNA, 21 bp, Artificial Sequence
  Synthetic
attcagtataagatgcctact

SEQ ID NO: 25257 - DNA, 21 bp, Artificial Sequence
  Synthetic
cgggctacgtgggttgcggat

SEQ ID NO: 25258 - DNA, 21 bp, Artificial Sequence
  Synthetic
tgggtttggggggcgactgag

SEQ ID NO: 25259 - DNA, 21 bp, Artificial Sequence
  Synthetic
cctttggagcggtcttttggt

SEQ ID NO: 25260 - DNA, 21 bp, Artificial Sequence
  Synthetic
cttgggtttttgaataagact

SEQ ID NO: 25261 - DNA, 21 bp, Artificial Sequence
  Synthetic
aggggtattgtgttggtgaat

SEQ ID NO: 25262 - DNA, 21 bp, Artificial Sequence
  Synthetic
agtgtggattttgcgaggtat

SEQ ID NO: 25263 - DNA, 21 bp, Artificial Sequence
  Synthetic
attttgagggcttatggggtt

SEQ ID NO: 25264 - DNA, 21 bp, Artificial Sequence
  Synthetic
actgggaatcggttgcatgct

SEQ ID NO: 25265 - DNA, 21 bp, Artificial Sequence
  Synthetic
gagaaggcttggcaggctcag

SEQ ID NO: 25266 - DNA, 21 bp, Artificial Sequence
  Synthetic
ccgctggctaattttagtgcg

SEQ ID NO: 25267 - DNA, 21 bp, Artificial Sequence
  Synthetic
cagggttatacggagcattgg

SEQ ID NO: 25268 - DNA, 21 bp, Artificial Sequence
  Synthetic
gagaagtttcgtttggggcag

SEQ ID NO: 25269 - DNA, 21 bp, Artificial Sequence
  Synthetic
gagtcgcatggttttagttcg

SEQ ID NO: 25270 - DNA, 21 bp, Artificial Sequence
  Synthetic
actcatcctgcgtggagtcat

SEQ ID NO: 25271 - DNA, 21 bp, Artificial Sequence
  Synthetic
aagtgggatctgaggttggag

SEQ ID NO: 25272 - DNA, 21 bp, Artificial Sequence
  Synthetic
gctaggctgatgggtagtcag

SEQ ID NO: 25273 - DNA, 21 bp, Artificial Sequence
  Synthetic
tggaggaatggtggttcgatg

SEQ ID NO: 25274 - DNA, 21 bp, Artificial Sequence
  Synthetic
tcttggccgggttcgagtgcg

SEQ ID NO: 25275 - DNA, 21 bp, Artificial Sequence
  Synthetic
attccggggagtggtatgtgg

SEQ ID NO: 25276 - DNA, 21 bp, Artificial Sequence
  Synthetic
aggtggggtgcggatgcttct

SEQ ID NO: 25277 - DNA, 21 bp, Artificial Sequence
  Synthetic
actcctgatactgctcggtgg

SEQ ID NO: 25278 - DNA, 21 bp, Artificial Sequence
  Synthetic
cgtgtttattctgaggggtgg

SEQ ID NO: 25279 - DNA, 21 bp, Artificial Sequence
  Synthetic
ttgttgtttcatggtagtgcg

SEQ ID NO: 25280 - DNA, 21 bp, Artificial Sequence
  Synthetic
atgtcttctttgtcgcattgg

SEQ ID NO: 25281 - DNA, 21 bp, Artificial Sequence
  Synthetic
gttccgtataagtttgagttg

SEQ ID NO: 25282 - DNA, 21 bp, Artificial Sequence
  Synthetic
agtcatgtggggtatagttct

SEQ ID NO: 25283 - DNA, 21 bp, Artificial Sequence
  Synthetic
ccgtgggagcggagtttgagt

SEQ ID NO: 25284 - DNA, 21 bp, Artificial Sequence
  Synthetic
gagattccgggttattctagt

SEQ ID NO: 25285 - DNA, 21 bp, Artificial Sequence
  Synthetic
acggagcggtattatgcttcg

SEQ ID NO: 25286 - DNA, 21 bp, Artificial Sequence
  Synthetic
ttgttttatgggggggcgtct

SEQ ID NO: 25287 - DNA, 21 bp, Artificial Sequence
  Synthetic
gggaaggctcagggtccttgg

SEQ ID NO: 25288 - DNA, 21 bp, Artificial Sequence
  Synthetic
actcttcgtgggcttgcgcag

SEQ ID NO: 25289 - DNA, 21 bp, Artificial Sequence
  Synthetic
tggggtaagcctccggttatg

SEQ ID NO: 25290 - DNA, 21 bp, Artificial Sequence
  Synthetic
gagttttgggctggtagtgtg

SEQ ID NO: 25291 - DNA, 21 bp, Artificial Sequence
  Synthetic
gcttttgggacggggtttcat

SEQ ID NO: 25292 - DNA, 21 bp, Artificial Sequence
  Synthetic
ggtgtgactgggttgctttgg

SEQ ID NO: 25293 - DNA, 21 bp, Artificial Sequence
  Synthetic
gaggcgcattggagggctgat

SEQ ID NO: 25294 - DNA, 21 bp, Artificial Sequence
  Synthetic
atgcctaaggggtcgggttgg

SEQ ID NO: 25295 - DNA, 21 bp, Artificial Sequence
  Synthetic
gggcggcttattggtgagcgt

SEQ ID NO: 25296 - DNA, 21 bp, Artificial Sequence
  Synthetic
gaggcgcggaattgggcgagt

SEQ ID NO: 25297 - DNA, 21 bp, Artificial Sequence
  Synthetic
gtgccgtatagtcttccgctt

SEQ ID NO: 25298 - DNA, 21 bp, Artificial Sequence
  Synthetic
atgcatgtgggttttgctcag

SEQ ID NO: 25299 - DNA, 21 bp, Artificial Sequence
  Synthetic
gagaaggctctgatgtttcgg

SEQ ID NO: 25300 - DNA, 21 bp, Artificial Sequence
  Synthetic
tatattagtttgcctgatatt

SEQ ID NO: 25301 - DNA, 21 bp, Artificial Sequence
  Synthetic
attctggcgggttatatggat

SEQ ID NO: 25302 - DNA, 21 bp, Artificial Sequence
  Synthetic
caggcgccgggttgggcgtcg

SEQ ID NO: 25303 - DNA, 21 bp, Artificial Sequence
  Synthetic
cctgcgattgggagggcgcag

SEQ ID NO: 25304 - DNA, 21 bp, Artificial Sequence
  Synthetic
ctgtttgtgggtgggtctagt

SEQ ID NO: 25305 - DNA, 21 bp, Artificial Sequence
  Synthetic
tcgcggcctggttttgctcag

SEQ ID NO: 25306 - DNA, 21 bp, Artificial Sequence
  Synthetic
cgtctggtgcagagtggtcat

SEQ ID NO: 25307 - DNA, 21 bp, Artificial Sequence
  Synthetic
acgccttttaagtttcctgat

SEQ ID NO: 25308 - DNA, 21 bp, Artificial Sequence
  Synthetic
gaggtgcttggggcgcgttgg

SEQ ID NO: 25309 - DNA, 21 bp, Artificial Sequence
  Synthetic
tcgcatactggtttttctact

SEQ ID NO: 25310 - DNA, 21 bp, Artificial Sequence
  Synthetic
ggtagtcatcttggggcttgg

SEQ ID NO: 25311 - DNA, 21 bp, Artificial Sequence
  Synthetic
ctttttgctaggggtagtgcg

SEQ ID NO: 25312 - DNA, 21 bp, Artificial Sequence
  Synthetic
tatcctatgtataggtcggat

SEQ ID NO: 25313 - DNA, 21 bp, Artificial Sequence
  Synthetic
gatcagcgtcagtggtctagt

SEQ ID NO: 25314 - DNA, 21 bp, Artificial Sequence
  Synthetic
cgtgggggtattgctgagcgt

SEQ ID NO: 25315 - DNA, 21 bp, Artificial Sequence
  Synthetic
atggagagttatactgctgcg

SEQ ID NO: 25316 - DNA, 21 bp, Artificial Sequence
  Synthetic
gaggggcggattggtacttgg

SEQ ID NO: 25317 - DNA, 21 bp, Artificial Sequence
  Synthetic
agtggtgttgagggtaggtgg

SEQ ID NO: 25318 - DNA, 21 bp, Artificial Sequence
  Synthetic
cgttgggagcatggttctacg

SEQ ID NO: 25319 - DNA, 21 bp, Artificial Sequence
  Synthetic
cttaagtttggtgcggcgcag

SEQ ID NO: 25320 - DNA, 21 bp, Artificial Sequence
  Synthetic
gtggagtatcggctgccgatg

SEQ ID NO: 25321 - DNA, 21 bp, Artificial Sequence
  Synthetic
gtttttgatcttaggcagatg

SEQ ID NO: 25322 - DNA, 21 bp, Artificial Sequence
  Synthetic
tggggtagtttgagtcctact

SEQ ID NO: 25323 - DNA, 21 bp, Artificial Sequence
  Synthetic
tgggagcctttgagtgggtat

SEQ ID NO: 25324 - DNA, 21 bp, Artificial Sequence
  Synthetic
gtgaattctttgtgggttgcg

SEQ ID NO: 25325 - DNA, 21 bp, Artificial Sequence
  Synthetic
actgagtttctttattctgct

SEQ ID NO: 25326 - DNA, 21 bp, Artificial Sequence
  Synthetic
catgggaagatgtctggtggg

SEQ ID NO: 25327 - DNA, 21 bp, Artificial Sequence
  Synthetic
gagcgtatgtttcttagtagt

SEQ ID NO: 25328 - DNA, 21 bp, Artificial Sequence
  Synthetic
ttggtgattcgtggttctcag

SEQ ID NO: 25329 - DNA, 21 bp, Artificial Sequence
  Synthetic
gggggtaatcttggtgtttgg

SEQ ID NO: 25330 - DNA, 21 bp, Artificial Sequence
  Synthetic
ttggtttggcaggggtcgact

SEQ ID NO: 25331 - DNA, 21 bp, Artificial Sequence
  Synthetic
cattatcctagggagctgact

SEQ ID NO: 25332 - DNA, 21 bp, Artificial Sequence
  Synthetic
tttgtgtatggggctcagcag

SEQ ID NO: 25333 - DNA, 21 bp, Artificial Sequence
  Synthetic
aatcagccgcagtctggtcgt

SEQ ID NO: 25334 - DNA, 21 bp, Artificial Sequence
  Synthetic
gggcggaatattggtcctttt

SEQ ID NO: 25335 - DNA, 21 bp, Artificial Sequence
  Synthetic
tgggtgactttgccgagtacg

SEQ ID NO: 25336 - DNA, 21 bp, Artificial Sequence
  Synthetic
gttcatcattcgattacgttg

SEQ ID NO: 25337 - DNA, 21 bp, Artificial Sequence
  Synthetic
cgggtggctggtccgaattgg

SEQ ID NO: 25338 - DNA, 21 bp, Artificial Sequence
  Synthetic
atgagtcatgctggtatttgg

SEQ ID NO: 25339 - DNA, 21 bp, Artificial Sequence
  Synthetic
gatcattatctgggtagtcat

SEQ ID NO: 25340 - DNA, 21 bp, Artificial Sequence
  Synthetic
atggatttgttgcctagtggt

SEQ ID NO: 25341 - DNA, 21 bp, Artificial Sequence
  Synthetic
gttcatacttatgcttttggt

SEQ ID NO: 25342 - DNA, 21 bp, Artificial Sequence
  Synthetic
gtttctccggtgtggtctagt

SEQ ID NO: 25343 - DNA, 21 bp, Artificial Sequence
  Synthetic
aagagtgagtggggtagttat

SEQ ID NO: 25344 - DNA, 21 bp, Artificial Sequence
  Synthetic
aaggatgtgaattggtcttat

SEQ ID NO: 25345 - DNA, 21 bp, Artificial Sequence
  Synthetic
gctttgcggagtgaggcgcgg

SEQ ID NO: 25346 - DNA, 21 bp, Artificial Sequence
  Synthetic
gagagggttggttatgcgtgg

SEQ ID NO: 25347 - DNA, 21 bp, Artificial Sequence
  Synthetic
ctgcttttggggtattcgacg

SEQ ID NO: 25348 - DNA, 21 bp, Artificial Sequence
  Synthetic
cctgttgataatggtaggtgg

SEQ ID NO: 25349 - DNA, 21 bp, Artificial Sequence
  Synthetic
ggggcttttggtttttcgtct

SEQ ID NO: 25350 - DNA, 21 bp, Artificial Sequence
  Synthetic
agggcgtttgattataatatg

SEQ ID NO: 25351 - DNA, 21 bp, Artificial Sequence
  Synthetic
gggcctgatgctggtcgttgg

SEQ ID NO: 25352 - DNA, 21 bp, Artificial Sequence
  Synthetic
gctgagagtcctggtcggtgg

SEQ ID NO: 25353 - DNA, 21 bp, Artificial Sequence
  Synthetic
aggggtgattatgcgccgtgg

SEQ ID NO: 25354 - DNA, 21 bp, Artificial Sequence
  Synthetic
gataagtggaagttgcctact

SEQ ID NO: 25355 - DNA, 21 bp, Artificial Sequence
  Synthetic
cgtcgtcctggggatgctgcg

SEQ ID NO: 25356 - DNA, 21 bp, Artificial Sequence
  Synthetic
agggctcgtgaggagaggctt

SEQ ID NO: 25357 - DNA, 21 bp, Artificial Sequence
  Synthetic
cctgctggtactgtgcggtgg

SEQ ID NO: 25358 - DNA, 21 bp, Artificial Sequence
  Synthetic
cggatgtctgtgatgactttt

SEQ ID NO: 25359 - DNA, 21 bp, Artificial Sequence
  Synthetic
cttgtgattatgggttctagt

SEQ ID NO: 25360 - DNA, 21 bp, Artificial Sequence
  Synthetic
ctttctgatctttcttattgg

SEQ ID NO: 25361 - DNA, 21 bp, Artificial Sequence
  Synthetic
tcggcgtggcaggggagtacg

SEQ ID NO: 25362 - DNA, 21 bp, Artificial Sequence
  Synthetic
cttatgcctaatcctgtgagg

SEQ ID NO: 25363 - DNA, 21 bp, Artificial Sequence
  Synthetic
cgtggggggcggccggattgg

SEQ ID NO: 25364 - DNA, 21 bp, Artificial Sequence
  Synthetic
atgtgggcggggcatagtatg

SEQ ID NO: 25365 - DNA, 21 bp, Artificial Sequence
  Synthetic
actgatcttgggtgggcgcgt

SEQ ID NO: 25366 - DNA, 21 bp, Artificial Sequence
  Synthetic
agtgatcctgtgtggcatagt

SEQ ID NO: 25367 - DNA, 21 bp, Artificial Sequence
  Synthetic
tcgtatgattcgggtcggtgg

SEQ ID NO: 25368 - DNA, 21 bp, Artificial Sequence
  Synthetic
ggggtgggggaggtgcggtgg

SEQ ID NO: 25369 - DNA, 21 bp, Artificial Sequence
  Synthetic
gataattggcatctgcctcat

SEQ ID NO: 25370 - DNA, 21 bp, Artificial Sequence
  Synthetic
caggttctgatgggttctgcg

SEQ ID NO: 25371 - DNA, 21 bp, Artificial Sequence
  Synthetic
gaggtggttgggcgtgggtgg

SEQ ID NO: 25372 - DNA, 21 bp, Artificial Sequence
  Synthetic
aaggagtataggatttatgat

SEQ ID NO: 25373 - DNA, 21 bp, Artificial Sequence
  Synthetic
gtttgggttgggggggcggct

SEQ ID NO: 25374 - DNA, 21 bp, Artificial Sequence
  Synthetic
gataagcatctttatagtgct

SEQ ID NO: 25375 - DNA, 21 bp, Artificial Sequence
  Synthetic
gtgcatcctgggtattcgatg

SEQ ID NO: 25376 - DNA, 21 bp, Artificial Sequence
  Synthetic
ttgattggtgagagtcgttgg

SEQ ID NO: 25377 - DNA, 21 bp, Artificial Sequence
  Synthetic
agttgggcgatggggagtgcg

SEQ ID NO: 25378 - DNA, 21 bp, Artificial Sequence
  Synthetic
gagccgactggtgtgcggtgg

SEQ ID NO: 25379 - DNA, 21 bp, Artificial Sequence
  Synthetic
gggtatgttggttttagtact

SEQ ID NO: 25380 - DNA, 21 bp, Artificial Sequence
  Synthetic
tgtccgggttatacttcggcg

SEQ ID NO: 25381 - DNA, 21 bp, Artificial Sequence
  Synthetic
ttgcatcctggggatagttct

SEQ ID NO: 25382 - DNA, 21 bp, Artificial Sequence
  Synthetic
ctgtatagtatgatgtcttct

SEQ ID NO: 25383 - DNA, 21 bp, Artificial Sequence
  Synthetic
gcgtgggggactactggggct

SEQ ID NO: 25384 - DNA, 21 bp, Artificial Sequence
  Synthetic
ggtcttgagaggggtatgtgg

SEQ ID NO: 25385 - DNA, 21 bp, Artificial Sequence
  Synthetic
attggtcatcagtgggcgtat

SEQ ID NO: 25386 - DNA, 21 bp, Artificial Sequence
  Synthetic
atgccttatttgcttaatggg

SEQ ID NO: 25387 - DNA, 21 bp, Artificial Sequence
  Synthetic
gagcggccttcttattcgtcg

SEQ ID NO: 25388 - DNA, 21 bp, Artificial Sequence
  Synthetic
ccgattgagcatggtagttat

SEQ ID NO: 25389 - DNA, 21 bp, Artificial Sequence
  Synthetic
gattttaggcttgggagtact

SEQ ID NO: 25390 - DNA, 21 bp, Artificial Sequence
  Synthetic
aagtcgatggagaatagtcgt

SEQ ID NO: 25391 - DNA, 21 bp, Artificial Sequence
  Synthetic
ccggggaatggtgggcgttat

SEQ ID NO: 25392 - DNA, 21 bp, Artificial Sequence
  Synthetic
cattctacgctggggagttct

SEQ ID NO: 25393 - DNA, 21 bp, Artificial Sequence
  Synthetic
ccgtttccgggggggagtcag

SEQ ID NO: 25394 - DNA, 21 bp, Artificial Sequence
  Synthetic
atgagggttgcgcattcttct

SEQ ID NO: 25395 - DNA, 21 bp, Artificial Sequence
  Synthetic
cgggttgtgcataataatgct

SEQ ID NO: 25396 - DNA, 21 bp, Artificial Sequence
  Synthetic
gcgtatgagaattggcatgtg

SEQ ID NO: 25397 - DNA, 21 bp, Artificial Sequence
  Synthetic
gggaatgaggttggtcggtgg

SEQ ID NO: 25398 - DNA, 21 bp, Artificial Sequence
  Synthetic
tttatgaagttgggttctacg

SEQ ID NO: 25399 - DNA, 21 bp, Artificial Sequence
  Synthetic
cgttggactatggataatgcg

SEQ ID NO: 25400 - DNA, 21 bp, Artificial Sequence
  Synthetic
gagttggtgggttatcggatt

SEQ ID NO: 25401 - DNA, 21 bp, Artificial Sequence
  Synthetic
catgcttatagtttggagagg

SEQ ID NO: 25402 - DNA, 21 bp, Artificial Sequence
  Synthetic
catggtcctgctcgttgggat

SEQ ID NO: 25403 - DNA, 21 bp, Artificial Sequence
  Synthetic
ctgcatgcggggtatgcgagt

SEQ ID NO: 25404 - DNA, 21 bp, Artificial Sequence
  Synthetic
cctgagccggggtggtctgct

SEQ ID NO: 25405 - DNA, 21 bp, Artificial Sequence
  Synthetic
ggggagtggaggcgttttgat

SEQ ID NO: 25406 - DNA, 21 bp, Artificial Sequence
  Synthetic
ttggctgtgcggttggcgtct

SEQ ID NO: 25407 - DNA, 21 bp, Artificial Sequence
  Synthetic
cctgttgagaggcatggttgg

SEQ ID NO: 25408 - DNA, 21 bp, Artificial Sequence
  Synthetic
tatgattatactaaggggtat

SEQ ID NO: 25409 - DNA, 21 bp, Artificial Sequence
  Synthetic
tctttgtatatggggagtagt

SEQ ID NO: 25410 - DNA, 21 bp, Artificial Sequence
  Synthetic
gcttggcatgataaggagagg

SEQ ID NO: 25411 - DNA, 21 bp, Artificial Sequence
  Synthetic
attatgcttcgtggttcgacg

SEQ ID NO: 25412 - DNA, 21 bp, Artificial Sequence
  Synthetic
atgacgtatgagactaggtat

SEQ ID NO: 25413 - DNA, 21 bp, Artificial Sequence
  Synthetic
gatgtgcgttggaatagtagt

SEQ ID NO: 25414 - DNA, 21 bp, Artificial Sequence
  Synthetic
gagattagttatggtagttcg

SEQ ID NO: 25415 - DNA, 21 bp, Artificial Sequence
  Synthetic
ttgtatcatgggcattctact

SEQ ID NO: 25416 - DNA, 21 bp, Artificial Sequence
  Synthetic
cgtatggagggtccgaattgg

SEQ ID NO: 25417 - DNA, 21 bp, Artificial Sequence
  Synthetic
cctactccgtttctgtcttcg

SEQ ID NO: 25418 - DNA, 21 bp, Artificial Sequence
  Synthetic
ttgacttattcgacgactctt

SEQ ID NO: 25419 - DNA, 21 bp, Artificial Sequence
  Synthetic
tgggttaatctgccggatcgt

SEQ ID NO: 25420 - DNA, 21 bp, Artificial Sequence
  Synthetic
tttaatccggatcctatgatt

SEQ ID NO: 25421 - DNA, 21 bp, Artificial Sequence
  Synthetic
gtttttattgggggttcttct

SEQ ID NO: 25422 - DNA, 21 bp, Artificial Sequence
  Synthetic
agggggatggagtttaatagg

SEQ ID NO: 25423 - DNA, 21 bp, Artificial Sequence
  Synthetic
acggcgcggccggggccgtgg

SEQ ID NO: 25424 - DNA, 21 bp, Artificial Sequence
  Synthetic
tatcgtttgggttatggggct

SEQ ID NO: 25425 - DNA, 21 bp, Artificial Sequence
  Synthetic
atgccgcgtgataatcgttgg

SEQ ID NO: 25426 - DNA, 21 bp, Artificial Sequence
  Synthetic
tcgtatattgggatgagttcg

SEQ ID NO: 25427 - DNA, 21 bp, Artificial Sequence
  Synthetic
ctggattctcggtttagttct

SEQ ID NO: 25428 - DNA, 21 bp, Artificial Sequence
  Synthetic
gaggtgtatcaggggtcgtcg

SEQ ID NO: 25429 - DNA, 21 bp, Artificial Sequence
  Synthetic
tggggggtgctttcggatctg

SEQ ID NO: 25430 - DNA, 21 bp, Artificial Sequence
  Synthetic
tgggagttgcaggcgggttat

SEQ ID NO: 25431 - DNA, 21 bp, Artificial Sequence
  Synthetic
ggtagtaatcttgggaagtgg

SEQ ID NO: 25432 - DNA, 21 bp, Artificial Sequence
  Synthetic
attatgaattcgtatggggtt

SEQ ID NO: 25433 - DNA, 21 bp, Artificial Sequence
  Synthetic
tatggttcgctgcatgggtgg

SEQ ID NO: 25434 - DNA, 21 bp, Artificial Sequence
  Synthetic
tatagtcattcttcttgggcg

SEQ ID NO: 25435 - DNA, 21 bp, Artificial Sequence
  Synthetic
tggaattatgtggggtcgtct

SEQ ID NO: 25436 - DNA, 21 bp, Artificial Sequence
  Synthetic
tgggatgtggctgcggggtat

SEQ ID NO: 25437 - DNA, 21 bp, Artificial Sequence
  Synthetic
tgggcgtataggattggtgat

SEQ ID NO: 25438 - DNA, 21 bp, Artificial Sequence
  Synthetic
gcggttcatgagactcggtgg

SEQ ID NO: 25439 - DNA, 21 bp, Artificial Sequence
  Synthetic
cctagggctcatgcgaatagt

SEQ ID NO: 25440 - DNA, 21 bp, Artificial Sequence
  Synthetic
gctccgcatacgggttttcat

SEQ ID NO: 25441 - DNA, 21 bp, Artificial Sequence
  Synthetic
gcttcttatggtcagtattgg

SEQ ID NO: 25442 - DNA, 21 bp, Artificial Sequence
  Synthetic
tcgtttccgggtatggctcag

SEQ ID NO: 25443 - DNA, 21 bp, Artificial Sequence
  Synthetic
gagatgccgtttgggagtgcg

SEQ ID NO: 25444 - DNA, 21 bp, Artificial Sequence
  Synthetic
tggattcctttgggggcgtcg

SEQ ID NO: 25445 - DNA, 21 bp, Artificial Sequence
  Synthetic
tggggtctgagtagtgggttt

SEQ ID NO: 25446 - DNA, 21 bp, Artificial Sequence
  Synthetic
cttaggattaagggtggggat

SEQ ID NO: 25447 - DNA, 21 bp, Artificial Sequence
  Synthetic
aggccgattggggattgggct

SEQ ID NO: 25448 - DNA, 21 bp, Artificial Sequence
  Synthetic
tcttggggtaagcagggtgcg

SEQ ID NO: 25449 - DNA, 21 bp, Artificial Sequence
  Synthetic
ctttatattccttctagtcat

SEQ ID NO: 25450 - DNA, 21 bp, Artificial Sequence
  Synthetic
ttgtggtctgggggtgctcag

SEQ ID NO: 25451 - DNA, 21 bp, Artificial Sequence
  Synthetic
catggtttgggggcgggtaag

SEQ ID NO: 25452 - DNA, 21 bp, Artificial Sequence
  Synthetic
gttctggttggtaggactggg

SEQ ID NO: 25453 - DNA, 21 bp, Artificial Sequence
  Synthetic
gttcatgttgggggggctcag

SEQ ID NO: 25454 - DNA, 21 bp, Artificial Sequence
  Synthetic
gattctaggccgccggcgcgt

SEQ ID NO: 25455 - DNA, 21 bp, Artificial Sequence
  Synthetic
tctggtgatgtgggtaggtgg

SEQ ID NO: 25456 - DNA, 21 bp, Artificial Sequence
  Synthetic
gatgttccggtgtttcgtccg

SEQ ID NO: 25457 - DNA, 21 bp, Artificial Sequence
  Synthetic
tttgtttggatgcattcggat

SEQ ID NO: 25458 - DNA, 21 bp, Artificial Sequence
  Synthetic
cctttgtcgaatggtcgttat

SEQ ID NO: 25459 - DNA, 21 bp, Artificial Sequence
  Synthetic
attggtcatggtgggtggcat

SEQ ID NO: 25460 - DNA, 21 bp, Artificial Sequence
  Synthetic
ctttcgatggatggtcggtgg

SEQ ID NO: 25461 - DNA, 21 bp, Artificial Sequence
  Synthetic
cataggtttaatgggagttct

SEQ ID NO: 25462 - DNA, 21 bp, Artificial Sequence
  Synthetic
cttcatagtgggtattctcag

SEQ ID NO: 25463 - DNA, 21 bp, Artificial Sequence
  Synthetic
ttgagtgattattcgtttcat

SEQ ID NO: 25464 - DNA, 21 bp, Artificial Sequence
  Synthetic
attcttgctgggtggacggag

SEQ ID NO: 25465 - DNA, 21 bp, Artificial Sequence
  Synthetic
caggagtttcggcttccggtt

SEQ ID NO: 25466 - DNA, 21 bp, Artificial Sequence
  Synthetic
atgcggtttattctgcctgat

SEQ ID NO: 25467 - DNA, 21 bp, Artificial Sequence
  Synthetic
cgtcaggatacgggggcgcgg

SEQ ID NO: 25468 - DNA, 21 bp, Artificial Sequence
  Synthetic
gatggttatttttcttctagt

SEQ ID NO: 25469 - DNA, 21 bp, Artificial Sequence
  Synthetic
tggatgtatgagggtagtagt

SEQ ID NO: 25470 - DNA, 21 bp, Artificial Sequence
  Synthetic
gtgtgggctgggacggcgcag

SEQ ID NO: 25471 - DNA, 21 bp, Artificial Sequence
  Synthetic
cggcgtgatttgcttccttat

SEQ ID NO: 25472 - DNA, 21 bp, Artificial Sequence
  Synthetic
cctgagtttcataatgggtgg

SEQ ID NO: 25473 - DNA, 21 bp, Artificial Sequence
  Synthetic
gagccgttgcattctaggtgg

SEQ ID NO: 25474 - DNA, 21 bp, Artificial Sequence
  Synthetic
aggtggcagtctgatgcgatt

SEQ ID NO: 25475 - DNA, 21 bp, Artificial Sequence
  Synthetic
cctccttatggtggggcttgg

SEQ ID NO: 25476 - DNA, 21 bp, Artificial Sequence
  Synthetic
ctgaattggggtgcggctatg

SEQ ID NO: 25477 - DNA, 21 bp, Artificial Sequence
  Synthetic
gttgttcgtctgggttctgcg

SEQ ID NO: 25478 - DNA, 21 bp, Artificial Sequence
  Synthetic
aatccttttaggttgccggtt

SEQ ID NO: 25479 - DNA, 21 bp, Artificial Sequence
  Synthetic
agttttgttccgtatgcggcg

SEQ ID NO: 25480 - DNA, 21 bp, Artificial Sequence
  Synthetic
gcgattcctggttggagttcg

SEQ ID NO: 25481 - DNA, 21 bp, Artificial Sequence
  Synthetic
aggggtccgagtgttgatcgg

SEQ ID NO: 25482 - DNA, 21 bp, Artificial Sequence
  Synthetic
cataagcaggctggtgggtat

SEQ ID NO: 25483 - DNA, 21 bp, Artificial Sequence
  Synthetic
atgcagaattgggcgtatggg

SEQ ID NO: 25484 - DNA, 21 bp, Artificial Sequence
  Synthetic
acttatcatggggcttcttcg

SEQ ID NO: 25485 - DNA, 21 bp, Artificial Sequence
  Synthetic
tcgtggcctgctacttctacg

SEQ ID NO: 25486 - DNA, 21 bp, Artificial Sequence
  Synthetic
catcgtccggcgatgtctggg

SEQ ID NO: 25487 - DNA, 21 bp, Artificial Sequence
  Synthetic
cgggagtatcagaataattgg

SEQ ID NO: 25488 - DNA, 21 bp, Artificial Sequence
  Synthetic
gagcctattattcttaagcct

SEQ ID NO: 25489 - DNA, 21 bp, Artificial Sequence
  Synthetic
ggggggactgttggggtgtgg

SEQ ID NO: 25490 - DNA, 21 bp, Artificial Sequence
  Synthetic
ttgaatgggagggcgcatcct

SEQ ID NO: 25491 - DNA, 21 bp, Artificial Sequence
  Synthetic
catcgtggggatggtagggtg

SEQ ID NO: 25492 - DNA, 21 bp, Artificial Sequence
  Synthetic
actttggtgaggcagaatcat

SEQ ID NO: 25493 - DNA, 21 bp, Artificial Sequence
  Synthetic
atggtgcttatggggagtacg

SEQ ID NO: 25494 - DNA, 21 bp, Artificial Sequence
  Synthetic
tctaagcttgatgcgcatcgt

SEQ ID NO: 25495 - DNA, 21 bp, Artificial Sequence
  Synthetic
gagaggattgttttgaagcag

SEQ ID NO: 25496 - DNA, 21 bp, Artificial Sequence
  Synthetic
acgcggacgcttgggagtgcg

SEQ ID NO: 25497 - DNA, 21 bp, Artificial Sequence
  Synthetic
tgttatcctgtgttggattgt

SEQ ID NO: 25498 - DNA, 21 bp, Artificial Sequence
  Synthetic
cggtttcatatggatgctacg

SEQ ID NO: 25499 - DNA, 21 bp, Artificial Sequence
  Synthetic
agtaagtgggatatgagggtg

SEQ ID NO: 25500 - DNA, 21 bp, Artificial Sequence
  Synthetic
ttgtggggtggtgggagttct

SEQ ID NO: 25501 - DNA, 21 bp, Artificial Sequence
  Synthetic
ggggcgccttttaatcattat

SEQ ID NO: 25502 - DNA, 21 bp, Artificial Sequence
  Synthetic
cgtcagattgatagtgggcgg

SEQ ID NO: 25503 - DNA, 21 bp, Artificial Sequence
  Synthetic
cagcatgtgggggattttagg

SEQ ID NO: 25504 - DNA, 21 bp, Artificial Sequence
  Synthetic
gggtttatgatggggtctacg

SEQ ID NO: 25505 - DNA, 21 bp, Artificial Sequence
  Synthetic
aagcctccggcgaatacttgg

SEQ ID NO: 25506 - DNA, 21 bp, Artificial Sequence
  Synthetic
aattttgttcctgctcagcat

SEQ ID NO: 25507 - DNA, 21 bp, Artificial Sequence
  Synthetic
aggtatgtgggtttggcgtcg

SEQ ID NO: 25508 - DNA, 21 bp, Artificial Sequence
  Synthetic
aggtttgaggcggatagtgct

SEQ ID NO: 25509 - DNA, 21 bp, Artificial Sequence
  Synthetic
tttggtgtgctggatcgtgtg

SEQ ID NO: 25510 - DNA, 21 bp, Artificial Sequence
  Synthetic
tggcattcgctggggagtgat

SEQ ID NO: 25511 - DNA, 21 bp, Artificial Sequence
  Synthetic
ccggagtggagtgcggggagg

SEQ ID NO: 25512 - DNA, 21 bp, Artificial Sequence
  Synthetic
gagcgtcatgttcatgtgagt

SEQ ID NO: 25513 - DNA, 21 bp, Artificial Sequence
  Synthetic
gggcctcctcgttctattcag

SEQ ID NO: 25514 - DNA, 21 bp, Artificial Sequence
  Synthetic
tcgaagcaggggtggagttct

SEQ ID NO: 25515 - DNA, 21 bp, Artificial Sequence
  Synthetic
ccttgggctcatcttgcgagt

SEQ ID NO: 25516 - DNA, 21 bp, Artificial Sequence
  Synthetic
aggttttcgcctgatgctgcg

SEQ ID NO: 25517 - DNA, 21 bp, Artificial Sequence
  Synthetic
gttggtcatggtttttcgagt

SEQ ID NO: 25518 - DNA, 21 bp, Artificial Sequence
  Synthetic
ctgtatgtgaatgggtctgtg

SEQ ID NO: 25519 - DNA, 21 bp, Artificial Sequence
  Synthetic
tggtcgtctggggggtctcag

SEQ ID NO: 25520 - DNA, 21 bp, Artificial Sequence
  Synthetic
atttgggataataaggtggct

SEQ ID NO: 25521 - DNA, 21 bp, Artificial Sequence
  Synthetic
gtgttgtatagggttgatact

SEQ ID NO: 25522 - DNA, 21 bp, Artificial Sequence
  Synthetic
aggccgtatgttcctactcag

SEQ ID NO: 25523 - DNA, 21 bp, Artificial Sequence
  Synthetic
gagtgggatcggctgcttaag

SEQ ID NO: 25524 - DNA, 21 bp, Artificial Sequence
  Synthetic
gtgatgtggggtgaggctcag

SEQ ID NO: 25525 - DNA, 21 bp, Artificial Sequence
  Synthetic
aaggttgcgaattttcatgtg

SEQ ID NO: 25526 - DNA, 21 bp, Artificial Sequence
  Synthetic
attatggagacttcttattgg

SEQ ID NO: 25527 - DNA, 21 bp, Artificial Sequence
  Synthetic
ctgtttttgtctggttcgacg

SEQ ID NO: 25528 - DNA, 21 bp, Artificial Sequence
  Synthetic
ttgaattctctgtggaatgct

SEQ ID NO: 25529 - DNA, 21 bp, Artificial Sequence
  Synthetic
ggtttgagtgatgggaggtgg

SEQ ID NO: 25530 - DNA, 21 bp, Artificial Sequence
  Synthetic
tggattctggcggggtcggct

SEQ ID NO: 25531 - DNA, 21 bp, Artificial Sequence
  Synthetic
ttggagcatcggtattcttct

SEQ ID NO: 25532 - DNA, 21 bp, Artificial Sequence
  Synthetic
gagtggcctggtagtgctact

SEQ ID NO: 25533 - DNA, 21 bp, Artificial Sequence
  Synthetic
gagaagtggcgtggggatgct

SEQ ID NO: 25534 - DNA, 21 bp, Artificial Sequence
  Synthetic
ttgcattttaatggttctatg

SEQ ID NO: 25535 - DNA, 21 bp, Artificial Sequence
  Synthetic
ttgtctcgtgggtttagtact

SEQ ID NO: 25536 - DNA, 21 bp, Artificial Sequence
  Synthetic
cttatgtcgggttatgcgcag

SEQ ID NO: 25537 - DNA, 21 bp, Artificial Sequence
  Synthetic
tcgctgatgtcggggtatggt

SEQ ID NO: 25538 - DNA, 21 bp, Artificial Sequence
  Synthetic
gatccgcagtggagttatgcg

SEQ ID NO: 25539 - DNA, 21 bp, Artificial Sequence
  Synthetic
ttgatgagtcattattcgact

SEQ ID NO: 25540 - DNA, 21 bp, Artificial Sequence
  Synthetic
catggtacgggggctcgtatg

SEQ ID NO: 25541 - DNA, 21 bp, Artificial Sequence
  Synthetic
tgggttcttccgctggggggt

SEQ ID NO: 25542 - DNA, 21 bp, Artificial Sequence
  Synthetic
tggagtacggatgctgggtat

SEQ ID NO: 25543 - DNA, 21 bp, Artificial Sequence
  Synthetic
gcgatggagttgtatgggcgt

SEQ ID NO: 25544 - DNA, 21 bp, Artificial Sequence
  Synthetic
ggtccgggtgagggtaggtgg

SEQ ID NO: 25545 - DNA, 21 bp, Artificial Sequence
  Synthetic
gagtcgcctacttggcggtat

SEQ ID NO: 25546 - DNA, 21 bp, Artificial Sequence
  Synthetic
gatgttcggtggcaggctagt

SEQ ID NO: 25547 - DNA, 21 bp, Artificial Sequence
  Synthetic
gtgtctatgtcgctgtggagt

SEQ ID NO: 25548 - DNA, 21 bp, Artificial Sequence
  Synthetic
tcgacttattatcataaggag

SEQ ID NO: 25549 - DNA, 21 bp, Artificial Sequence
  Synthetic
gcttctattgggagtgtttat

SEQ ID NO: 25550 - DNA, 21 bp, Artificial Sequence
  Synthetic
attattcgtttgggttctagt

SEQ ID NO: 25551 - DNA, 21 bp, Artificial Sequence
  Synthetic
aatgtgagtacgcagttttat

SEQ ID NO: 25552 - DNA, 21 bp, Artificial Sequence
  Synthetic
gttaagtatagtcttgcgaat

SEQ ID NO: 25553 - DNA, 21 bp, Artificial Sequence
  Synthetic
gattggaattcggcgcgttat

SEQ ID NO: 25554 - DNA, 21 bp, Artificial Sequence
  Synthetic
tggaatatgcagaagggtttt

SEQ ID NO: 25555 - DNA, 21 bp, Artificial Sequence
  Synthetic
tggattactaatggttctgct

SEQ ID NO: 25556 - DNA, 21 bp, Artificial Sequence
  Synthetic
ctgtatgcgtctggttcgact

SEQ ID NO: 25557 - DNA, 21 bp, Artificial Sequence
  Synthetic
gaggttttgggtacgcgttgg

SEQ ID NO: 25558 - DNA, 21 bp, Artificial Sequence
  Synthetic
gattttgcgcgtggggcttcg

SEQ ID NO: 25559 - DNA, 21 bp, Artificial Sequence
  Synthetic
aaggagagtcctggtccgtgg

SEQ ID NO: 25560 - DNA, 21 bp, Artificial Sequence
  Synthetic
ttgggtcgtgggatgaatccg

SEQ ID NO: 25561 - DNA, 21 bp, Artificial Sequence
  Synthetic
aagggggagcagactttgagg

SEQ ID NO: 25562 - DNA, 21 bp, Artificial Sequence
  Synthetic
ccgtatcagggtatgagttct

SEQ ID NO: 25563 - DNA, 21 bp, Artificial Sequence
  Synthetic
ggttcgtctccgggtcggtgg

SEQ ID NO: 25564 - DNA, 21 bp, Artificial Sequence
  Synthetic
cgggttattgctgatcgtgct

SEQ ID NO: 25565 - DNA, 21 bp, Artificial Sequence
  Synthetic
tatcgtcttatgggtgcggct

SEQ ID NO: 25566 - DNA, 21 bp, Artificial Sequence
  Synthetic
ggggtttattcgggtcatttt

SEQ ID NO: 25567 - DNA, 21 bp, Artificial Sequence
  Synthetic
aataagtttgatttgcggagt

SEQ ID NO: 25568 - DNA, 21 bp, Artificial Sequence
  Synthetic
gattatcggcctgcggcgagt

SEQ ID NO: 25569 - DNA, 21 bp, Artificial Sequence
  Synthetic
tgggaggtgaggggggggttt

SEQ ID NO: 25570 - DNA, 21 bp, Artificial Sequence
  Synthetic
cggcagcctggggagtctcag

SEQ ID NO: 25571 - DNA, 21 bp, Artificial Sequence
  Synthetic
actgggctttctaggtttaat

SEQ ID NO: 25572 - DNA, 21 bp, Artificial Sequence
  Synthetic
atttttccggggatggcttct

SEQ ID NO: 25573 - DNA, 21 bp, Artificial Sequence
  Synthetic
gggcttgataagaataggtgg

SEQ ID NO: 25574 - DNA, 21 bp, Artificial Sequence
  Synthetic
gatgttcatttgcgttgggcg

SEQ ID NO: 25575 - DNA, 21 bp, Artificial Sequence
  Synthetic
gagcagtttcgtgggagttcg

SEQ ID NO: 25576 - DNA, 21 bp, Artificial Sequence
  Synthetic
ctgcgtgataatcgggtgcat

SEQ ID NO: 25577 - DNA, 21 bp, Artificial Sequence
  Synthetic
tcgggggcggttgggatgtgg

SEQ ID NO: 25578 - DNA, 21 bp, Artificial Sequence
  Synthetic
cgggattttcgtctgcctaat

SEQ ID NO: 25579 - DNA, 21 bp, Artificial Sequence
  Synthetic
acttttcctggtgctcagtgg

SEQ ID NO: 25580 - DNA, 21 bp, Artificial Sequence
  Synthetic
gggggtcaggttcgttgggat

SEQ ID NO: 25581 - DNA, 21 bp, Artificial Sequence
  Synthetic
tctaggactgagggttattgg

SEQ ID NO: 25582 - DNA, 21 bp, Artificial Sequence
  Synthetic
gataatccgactatgcggtat

SEQ ID NO: 25583 - DNA, 21 bp, Artificial Sequence
  Synthetic
ggtgagtcgttggggccttgg

SEQ ID NO: 25584 - DNA, 21 bp, Artificial Sequence
  Synthetic
gtttggaagcaggagaatgcg

SEQ ID NO: 25585 - DNA, 21 bp, Artificial Sequence
  Synthetic
ctgaatagtctttgggcgggg

SEQ ID NO: 25586 - DNA, 21 bp, Artificial Sequence
  Synthetic
cttcgtgtggcttatagttct

SEQ ID NO: 25587 - DNA, 21 bp, Artificial Sequence
  Synthetic
gataatctggtgaggtggtcg

SEQ ID NO: 25588 - DNA, 21 bp, Artificial Sequence
  Synthetic
atggctacgtctcgttgggat

SEQ ID NO: 25589 - DNA, 21 bp, Artificial Sequence
  Synthetic
tggggtatgattccgcgtgat

SEQ ID NO: 25590 - DNA, 21 bp, Artificial Sequence
  Synthetic
tggggtttgtatgtggatcgt

SEQ ID NO: 25591 - DNA, 21 bp, Artificial Sequence
  Synthetic
tgggggcttttgcctagttcg

SEQ ID NO: 25592 - DNA, 21 bp, Artificial Sequence
  Synthetic
actcgtgcttctgaggttcgt

SEQ ID NO: 25593 - DNA, 21 bp, Artificial Sequence
  Synthetic
aatcggggtgttgagcagaag

SEQ ID NO: 25594 - DNA, 21 bp, Artificial Sequence
  Synthetic
agggatagttcgatgcgtcat

SEQ ID NO: 25595 - DNA, 21 bp, Artificial Sequence
  Synthetic
gagattaagtatgatcttcgt

SEQ ID NO: 25596 - DNA, 21 bp, Artificial Sequence
  Synthetic
ggggtttatgggcagcttttt

SEQ ID NO: 25597 - DNA, 21 bp, Artificial Sequence
  Synthetic
gagaagtatcggcttaatgtt

SEQ ID NO: 25598 - DNA, 21 bp, Artificial Sequence
  Synthetic
tggggtttgtttcaggtgact

SEQ ID NO: 25599 - DNA, 21 bp, Artificial Sequence
  Synthetic
aatgttttgaattatcatatt

SEQ ID NO: 25600 - DNA, 21 bp, Artificial Sequence
  Synthetic
aggatgcataatgtgaatctt

SEQ ID NO: 25601 - DNA, 21 bp, Artificial Sequence
  Synthetic
gagtatcgtggtcaggcgcag

SEQ ID NO: 25602 - DNA, 21 bp, Artificial Sequence
  Synthetic
acgagtcttggttcggtttat

SEQ ID NO: 25603 - DNA, 21 bp, Artificial Sequence
  Synthetic
tgggcgttgcagggggcgcag

SEQ ID NO: 25604 - DNA, 21 bp, Artificial Sequence
  Synthetic
cataatattgagaggagttgg

SEQ ID NO: 25605 - DNA, 21 bp, Artificial Sequence
  Synthetic
cattttatgggggggtcgagt

SEQ ID NO: 25606 - DNA, 21 bp, Artificial Sequence
  Synthetic
cgtactcttcctcatctggtt

SEQ ID NO: 25607 - DNA, 21 bp, Artificial Sequence
  Synthetic
catccgcataaggaggggcgt

SEQ ID NO: 25608 - DNA, 21 bp, Artificial Sequence
  Synthetic
gagaggtggagggagcatccg

SEQ ID NO: 25609 - DNA, 21 bp, Artificial Sequence
  Synthetic
gggttgggtacgggtcctcgg

SEQ ID NO: 25610 - DNA, 21 bp, Artificial Sequence
  Synthetic
cgtttggcggtgaattatccg

SEQ ID NO: 25611 - DNA, 21 bp, Artificial Sequence
  Synthetic
attaagtatgctgggtcttcg

SEQ ID NO: 25612 - DNA, 21 bp, Artificial Sequence
  Synthetic
actgctcctactgcgtattat

SEQ ID NO: 25613 - DNA, 21 bp, Artificial Sequence
  Synthetic
actgttagttattctaagctg

SEQ ID NO: 25614 - DNA, 21 bp, Artificial Sequence
  Synthetic
gatcgggcgatggggtcgtgg

SEQ ID NO: 25615 - DNA, 21 bp, Artificial Sequence
  Synthetic
acgtgggatctggagtttcct

SEQ ID NO: 25616 - DNA, 21 bp, Artificial Sequence
  Synthetic
gtggctcggggttttagtact

SEQ ID NO: 25617 - DNA, 21 bp, Artificial Sequence
  Synthetic
ccggtggcttctgctcggttt

SEQ ID NO: 25618 - DNA, 21 bp, Artificial Sequence
  Synthetic
aagattgcttattcgcctctt

SEQ ID NO: 25619 - DNA, 21 bp, Artificial Sequence
  Synthetic
acgagtggtagtaggtgggat

SEQ ID NO: 25620 - DNA, 21 bp, Artificial Sequence
  Synthetic
acttatgcgtttgggtcggcg

SEQ ID NO: 25621 - DNA, 21 bp, Artificial Sequence
  Synthetic
atggagcgttttggtagtagt

SEQ ID NO: 25622 - DNA, 21 bp, Artificial Sequence
  Synthetic
ccgcatgctcagtggtctgcg

SEQ ID NO: 25623 - DNA, 21 bp, Artificial Sequence
  Synthetic
gagcatgggacggggcgttgg

SEQ ID NO: 25624 - DNA, 21 bp, Artificial Sequence
  Synthetic
gttgctagttttggttcttct

SEQ ID NO: 25625 - DNA, 21 bp, Artificial Sequence
  Synthetic
cgttggcatgagaatgggagt

SEQ ID NO: 25626 - DNA, 21 bp, Artificial Sequence
  Synthetic
tggaattcgctggctaggcct

SEQ ID NO: 25627 - DNA, 21 bp, Artificial Sequence
  Synthetic
atggattatcggctgggtttt

SEQ ID NO: 25628 - DNA, 21 bp, Artificial Sequence
  Synthetic
gagaatgtgcggcatttgtgg

SEQ ID NO: 25629 - DNA, 21 bp, Artificial Sequence
  Synthetic
gagggtacgaggatgctgtgg

SEQ ID NO: 25630 - DNA, 21 bp, Artificial Sequence
  Synthetic
cgggggggtccttcgtttcct

SEQ ID NO: 25631 - DNA, 21 bp, Artificial Sequence
  Synthetic
tggcataaggcggggagtggg

SEQ ID NO: 25632 - DNA, 21 bp, Artificial Sequence
  Synthetic
ttgtatgttgggctttctcag

SEQ ID NO: 25633 - DNA, 21 bp, Artificial Sequence
  Synthetic
cctgattataagcttcctttg

SEQ ID NO: 25634 - DNA, 21 bp, Artificial Sequence
  Synthetic
cttcagatgaattattctagt

SEQ ID NO: 25635 - DNA, 21 bp, Artificial Sequence
  Synthetic
gaggcgaagtggccgggtaat

SEQ ID NO: 25636 - DNA, 21 bp, Artificial Sequence
  Synthetic
ctttttactgggggttcgcag

SEQ ID NO: 25637 - DNA, 21 bp, Artificial Sequence
  Synthetic
cagttgccgtttagtgtgcgg

SEQ ID NO: 25638 - DNA, 21 bp, Artificial Sequence
  Synthetic
tggttgcatgggtatgcgcag

SEQ ID NO: 25639 - DNA, 21 bp, Artificial Sequence
  Synthetic
aggttgggtcctaatactggg

SEQ ID NO: 25640 - DNA, 21 bp, Artificial Sequence
  Synthetic
gctccgaatgaggttcgttgg

SEQ ID NO: 25641 - DNA, 21 bp, Artificial Sequence
  Synthetic
tcgtatctgactgggtatcat

SEQ ID NO: 25642 - DNA, 21 bp, Artificial Sequence
  Synthetic
gggagttctccgggtcagtgg

SEQ ID NO: 25643 - DNA, 21 bp, Artificial Sequence
  Synthetic
cttttgcttccgaagatggct

SEQ ID NO: 25644 - DNA, 21 bp, Artificial Sequence
  Synthetic
ttgtatatgtcggggtcgagt

SEQ ID NO: 25645 - DNA, 21 bp, Artificial Sequence
  Synthetic
aaggcgcagtgggctaatgtg

SEQ ID NO: 25646 - DNA, 21 bp, Artificial Sequence
  Synthetic
cataattctggttatcctaag

SEQ ID NO: 25647 - DNA, 21 bp, Artificial Sequence
  Synthetic
aagactgagtatgctgcgtgg

SEQ ID NO: 25648 - DNA, 21 bp, Artificial Sequence
  Synthetic
cggtatgctgggtcgtcgacg

SEQ ID NO: 25649 - DNA, 21 bp, Artificial Sequence
  Synthetic
ccggctaagtatggttttggt

SEQ ID NO: 25650 - DNA, 21 bp, Artificial Sequence
  Synthetic
gagactaagtttgctatgtgg

SEQ ID NO: 25651 - DNA, 21 bp, Artificial Sequence
  Synthetic
tttgtttcgatggatgctcat

SEQ ID NO: 25652 - DNA, 21 bp, Artificial Sequence
  Synthetic
cttatttataatgggagttcg

SEQ ID NO: 25653 - DNA, 21 bp, Artificial Sequence
  Synthetic
gagaagagttattcggggtgg

SEQ ID NO: 25654 - DNA, 21 bp, Artificial Sequence
  Synthetic
aggagtgcgggtatgtctcag

SEQ ID NO: 25655 - DNA, 21 bp, Artificial Sequence
  Synthetic
gctgatcgggattattggaat

SEQ ID NO: 25656 - DNA, 21 bp, Artificial Sequence
  Synthetic
atgcgtattgggatgtcgtcg

SEQ ID NO: 25657 - DNA, 21 bp, Artificial Sequence
  Synthetic
tggattgtggggggtagtact

SEQ ID NO: 25658 - DNA, 21 bp, Artificial Sequence
  Synthetic
tatgatgctaatgctaggagg

SEQ ID NO: 25659 - DNA, 21 bp, Artificial Sequence
  Synthetic
attaatgctccgggtctgtgg

SEQ ID NO: 25660 - DNA, 21 bp, Artificial Sequence
  Synthetic
atgattctgatgggttctgtg

SEQ ID NO: 25661 - DNA, 21 bp, Artificial Sequence
  Synthetic
actgatgcgactaggtgggct

SEQ ID NO: 25662 - DNA, 21 bp, Artificial Sequence
  Synthetic
gaggtgcagtttggttatcat

SEQ ID NO: 25663 - DNA, 21 bp, Artificial Sequence
  Synthetic
ttgcatattgggggttcgact

SEQ ID NO: 25664 - DNA, 21 bp, Artificial Sequence
  Synthetic
tggggtagtcttttgtcgctg

SEQ ID NO: 25665 - DNA, 21 bp, Artificial Sequence
  Synthetic
gatcctcagagtgttaggtgg

SEQ ID NO: 25666 - DNA, 21 bp, Artificial Sequence
  Synthetic
cgggagtggtcggttggtgtt

SEQ ID NO: 25667 - DNA, 21 bp, Artificial Sequence
  Synthetic
cgtggtcatcagtcgaatggt

SEQ ID NO: 25668 - DNA, 21 bp, Artificial Sequence
  Synthetic
atggatcgtccggctcagcgg

SEQ ID NO: 25669 - DNA, 21 bp, Artificial Sequence
  Synthetic
gcgcttggtcgtgagtgggtt

SEQ ID NO: 25670 - DNA, 21 bp, Artificial Sequence
  Synthetic
gagatgactcatgggtcggct

SEQ ID NO: 25671 - DNA, 21 bp, Artificial Sequence
  Synthetic
cggggggcggggttgagtcag

SEQ ID NO: 25672 - DNA, 21 bp, Artificial Sequence
  Synthetic
ttgtatattgcgcatagtagt

SEQ ID NO: 25673 - DNA, 21 bp, Artificial Sequence
  Synthetic
tttggggttcttgatcgtatt

SEQ ID NO: 25674 - DNA, 21 bp, Artificial Sequence
  Synthetic
ccgaatctgtctggtaggtat

SEQ ID NO: 25675 - DNA, 21 bp, Artificial Sequence
  Synthetic
ttggtgccggcttggagttcg

SEQ ID NO: 25676 - DNA, 21 bp, Artificial Sequence
  Synthetic
ggtgagtggggtgcgcggttt

SEQ ID NO: 25677 - DNA, 21 bp, Artificial Sequence
  Synthetic
ggtgtgactcagtcgatgtgg

SEQ ID NO: 25678 - DNA, 21 bp, Artificial Sequence
  Synthetic
tttctgagtgggtttagtcag

SEQ ID NO: 25679 - DNA, 21 bp, Artificial Sequence
  Synthetic
actaggtcgtttggttttgat

SEQ ID NO: 25680 - DNA, 21 bp, Artificial Sequence
  Synthetic
ttgaaggtgcaggggtggtcg

SEQ ID NO: 25681 - DNA, 21 bp, Artificial Sequence
  Synthetic
gtggcggatttttcgcattgg

SEQ ID NO: 25682 - DNA, 21 bp, Artificial Sequence
  Synthetic
gcggtgtggggtggtgcgtcg

SEQ ID NO: 25683 - DNA, 21 bp, Artificial Sequence
  Synthetic
gagaagtgggatctgtctcgt

SEQ ID NO: 25684 - DNA, 21 bp, Artificial Sequence
  Synthetic
tcgaataagagtcatcagcat

SEQ ID NO: 25685 - DNA, 21 bp, Artificial Sequence
  Synthetic
cgtcatgtgggtgatgcggct

SEQ ID NO: 25686 - DNA, 21 bp, Artificial Sequence
  Synthetic
aagacggcgtatgctgattgg

SEQ ID NO: 25687 - DNA, 21 bp, Artificial Sequence
  Synthetic
aggctgacgaatgagttgaag

SEQ ID NO: 25688 - DNA, 21 bp, Artificial Sequence
  Synthetic
gagcgtagtctggggagtacg

SEQ ID NO: 25689 - DNA, 21 bp, Artificial Sequence
  Synthetic
cattgggcttcggcgcatggg

SEQ ID NO: 25690 - DNA, 21 bp, Artificial Sequence
  Synthetic
ttgtatttggctcatgcgagt

SEQ ID NO: 25691 - DNA, 21 bp, Artificial Sequence
  Synthetic
ccggcgggtactgctcattgg

SEQ ID NO: 25692 - DNA, 21 bp, Artificial Sequence
  Synthetic
cgttctgagtatacgacttgg

SEQ ID NO: 25693 - DNA, 21 bp, Artificial Sequence
  Synthetic
gtggagtataggcgttttgat

SEQ ID NO: 25694 - DNA, 21 bp, Artificial Sequence
  Synthetic
gtgtttgttgggagtagtact

SEQ ID NO: 25695 - DNA, 21 bp, Artificial Sequence
  Synthetic
ttggcgaatcctggggcttgg

SEQ ID NO: 25696 - DNA, 21 bp, Artificial Sequence
  Synthetic
gctttgcatagtccgatttgg

SEQ ID NO: 25697 - DNA, 21 bp, Artificial Sequence
  Synthetic
tttgtttttgataagccgttt

SEQ ID NO: 25698 - DNA, 21 bp, Artificial Sequence
  Synthetic
cttaaggtgggttttagtatg

SEQ ID NO: 25699 - DNA, 21 bp, Artificial Sequence
  Synthetic
gttacgaagctgaatatgtgg

SEQ ID NO: 25700 - DNA, 21 bp, Artificial Sequence
  Synthetic
tatggtctttttgtttctacg

SEQ ID NO: 25701 - DNA, 21 bp, Artificial Sequence
  Synthetic
aggtttgatcatgatgcggcg

SEQ ID NO: 25702 - DNA, 21 bp, Artificial Sequence
  Synthetic
ccgacgtggggtagtattggt

SEQ ID NO: 25703 - DNA, 21 bp, Artificial Sequence
  Synthetic
cctatttggggtgagtcttcg

SEQ ID NO: 25704 - DNA, 21 bp, Artificial Sequence
  Synthetic
tgggcgtataatggtgatcgt

SEQ ID NO: 25705 - DNA, 21 bp, Artificial Sequence
  Synthetic
gggctgagtgatgctaggtgg

SEQ ID NO: 25706 - DNA, 21 bp, Artificial Sequence
  Synthetic
gatgcgacggttcggtggtcg

SEQ ID NO: 25707 - DNA, 21 bp, Artificial Sequence
  Synthetic
cgtcatattgctgatcggtcg

SEQ ID NO: 25708 - DNA, 21 bp, Artificial Sequence
  Synthetic
ttgttgcggctgggttcgact

SEQ ID NO: 25709 - DNA, 21 bp, Artificial Sequence
  Synthetic
gttcgttttggggatttttcg

SEQ ID NO: 25710 - DNA, 21 bp, Artificial Sequence
  Synthetic
actcttttgactaagtattat

SEQ ID NO: 25711 - DNA, 21 bp, Artificial Sequence
  Synthetic
cattattcttttgatagggct

SEQ ID NO: 25712 - DNA, 21 bp, Artificial Sequence
  Synthetic
aggtggtctggtgaggcttcg

SEQ ID NO: 25713 - DNA, 21 bp, Artificial Sequence
  Synthetic
gagactcgtttttttagtgct

SEQ ID NO: 25714 - DNA, 21 bp, Artificial Sequence
  Synthetic
gttttgattggtcgtacgggg

SEQ ID NO: 25715 - DNA, 21 bp, Artificial Sequence
  Synthetic
tggcatagtttgacgtatgag

SEQ ID NO: 25716 - DNA, 21 bp, Artificial Sequence
  Synthetic
tggcattcgctgagtagtgcg

SEQ ID NO: 25717 - DNA, 21 bp, Artificial Sequence
  Synthetic
gtggcgtttaagtatggtgat

SEQ ID NO: 25718 - DNA, 21 bp, Artificial Sequence
  Synthetic
gagtcttctagtgggaggtgg

SEQ ID NO: 25719 - DNA, 21 bp, Artificial Sequence
  Synthetic
cctgctccgtatgttgggtgg

SEQ ID NO: 25720 - DNA, 21 bp, Artificial Sequence
  Synthetic
cagaaggagaatgggaggtgg

SEQ ID NO: 25721 - DNA, 21 bp, Artificial Sequence
  Synthetic
ttgcgtccggttcatgtgaat

SEQ ID NO: 25722 - DNA, 21 bp, Artificial Sequence
  Synthetic
catgctattaatcatattcgt

SEQ ID NO: 25723 - DNA, 21 bp, Artificial Sequence
  Synthetic
attagggctgggtatgcggtt

SEQ ID NO: 25724 - DNA, 21 bp, Artificial Sequence
  Synthetic
aagcattctcctgagtcgcgg

SEQ ID NO: 25725 - DNA, 21 bp, Artificial Sequence
  Synthetic
ctggttattatgggtgcttct

SEQ ID NO: 25726 - DNA, 21 bp, Artificial Sequence
  Synthetic
gtgaggggtactgatgcgcgg

SEQ ID NO: 25727 - DNA, 21 bp, Artificial Sequence
  Synthetic
cagtattttactgggagtgcg

SEQ ID NO: 25728 - DNA, 21 bp, Artificial Sequence
  Synthetic
gttttgaaggggtctatttat

SEQ ID NO: 25729 - DNA, 21 bp, Artificial Sequence
  Synthetic
ggtgcttcttcgcgttgggat

SEQ ID NO: 25730 - DNA, 21 bp, Artificial Sequence
  Synthetic
gagtatatgcgggggagtgct

SEQ ID NO: 25731 - DNA, 21 bp, Artificial Sequence
  Synthetic
agtaagcctggttattctagt

SEQ ID NO: 25732 - DNA, 21 bp, Artificial Sequence
  Synthetic
agttcgacggcgcgttgggat

SEQ ID NO: 25733 - DNA, 21 bp, Artificial Sequence
  Synthetic
gcggcgcatttggctgggtgg

SEQ ID NO: 25734 - DNA, 21 bp, Artificial Sequence
  Synthetic
aagtcggagtgggctcatttt

SEQ ID NO: 25735 - DNA, 21 bp, Artificial Sequence
  Synthetic
tggtcggtgactagtggttat

SEQ ID NO: 25736 - DNA, 21 bp, Artificial Sequence
  Synthetic
gaggatgcgcgtcgttttacg

SEQ ID NO: 25737 - DNA, 21 bp, Artificial Sequence
  Synthetic
ttgtatcatggtgagtcgatg

SEQ ID NO: 25738 - DNA, 21 bp, Artificial Sequence
  Synthetic
cagtgggatctttcgaagagt

SEQ ID NO: 25739 - DNA, 21 bp, Artificial Sequence
  Synthetic
gtttttgcgggttatagtacg

SEQ ID NO: 25740 - DNA, 21 bp, Artificial Sequence
  Synthetic
tgtcgggcgactgcgatgttg

SEQ ID NO: 25741 - DNA, 21 bp, Artificial Sequence
  Synthetic
ggtgggccgagtcgttttaat

SEQ ID NO: 25742 - DNA, 21 bp, Artificial Sequence
  Synthetic
cttgtgcctttttatagtatg

SEQ ID NO: 25743 - DNA, 21 bp, Artificial Sequence
  Synthetic
gatatgttgagtggtaggtgg

SEQ ID NO: 25744 - DNA, 21 bp, Artificial Sequence
  Synthetic
tggggtactttgatggggctg

SEQ ID NO: 25745 - DNA, 21 bp, Artificial Sequence
  Synthetic
gagcatgcgtgggaggcgagt

SEQ ID NO: 25746 - DNA, 21 bp, Artificial Sequence
  Synthetic
gaggctgcgtgggggtctact

SEQ ID NO: 25747 - DNA, 21 bp, Artificial Sequence
  Synthetic
tctgtgtatcgtggtagtgtt

SEQ ID NO: 25748 - DNA, 21 bp, Artificial Sequence
  Synthetic
catgcggggggtcaggttagg

SEQ ID NO: 25749 - DNA, 21 bp, Artificial Sequence
  Synthetic
tggattacgcagggtgcggct

SEQ ID NO: 25750 - DNA, 21 bp, Artificial Sequence
  Synthetic
actaagacgtatggtagtacg

SEQ ID NO: 25751 - DNA, 21 bp, Artificial Sequence
  Synthetic
ggtaggactatgcatgtggcg

SEQ ID NO: 25752 - DNA, 21 bp, Artificial Sequence
  Synthetic
catactggtggtactcgggcg

SEQ ID NO: 25753 - DNA, 21 bp, Artificial Sequence
  Synthetic
attatgatgggtttttcggct

SEQ ID NO: 25754 - DNA, 21 bp, Artificial Sequence
  Synthetic
cgttgggttccggaggcttcg

SEQ ID NO: 25755 - DNA, 21 bp, Artificial Sequence
  Synthetic
ggggaggttgcgggtaggtgg

SEQ ID NO: 25756 - DNA, 21 bp, Artificial Sequence
  Synthetic
cctgataatcctgggttgtgg

SEQ ID NO: 25757 - DNA, 21 bp, Artificial Sequence
  Synthetic
gttatggttggttgggcgtcg

SEQ ID NO: 25758 - DNA, 21 bp, Artificial Sequence
  Synthetic
cgtatttcgcatgggagttgt

SEQ ID NO: 25759 - DNA, 21 bp, Artificial Sequence
  Synthetic
gagcggggtgggtatagttcg

SEQ ID NO: 25760 - DNA, 21 bp, Artificial Sequence
  Synthetic
aatcattatcatgggagtagt

SEQ ID NO: 25761 - DNA, 21 bp, Artificial Sequence
  Synthetic
ggtatttatgagacgcggtgg

SEQ ID NO: 25762 - DNA, 21 bp, Artificial Sequence
  Synthetic
tggcgtcatgttgagcagcat

SEQ ID NO: 25763 - DNA, 21 bp, Artificial Sequence
  Synthetic
gcgtcttttgatggtcggtgg

SEQ ID NO: 25764 - DNA, 21 bp, Artificial Sequence
  Synthetic
cggtttccgggggctgctagt

SEQ ID NO: 25765 - DNA, 21 bp, Artificial Sequence
  Synthetic
atgtatgttggggggtctact

SEQ ID NO: 25766 - DNA, 21 bp, Artificial Sequence
  Synthetic
cttagggattttgggtctagt

SEQ ID NO: 25767 - DNA, 21 bp, Artificial Sequence
  Synthetic
gtgtatcctgggtttagtgtt

SEQ ID NO: 25768 - DNA, 21 bp, Artificial Sequence
  Synthetic
cggtttagtggtgatgcgtct

SEQ ID NO: 25769 - DNA, 21 bp, Artificial Sequence
  Synthetic
ttgattccgtttacttctagt

SEQ ID NO: 25770 - DNA, 21 bp, Artificial Sequence
  Synthetic
tgggctcctaatactgggtat

SEQ ID NO: 25771 - DNA, 21 bp, Artificial Sequence
  Synthetic
tttactcttagtacgcgtcct

SEQ ID NO: 25772 - DNA, 21 bp, Artificial Sequence
  Synthetic
gtggggcgggggatggctcag

SEQ ID NO: 25773 - DNA, 21 bp, Artificial Sequence
  Synthetic
ccttatacgaattttagtgct

SEQ ID NO: 25774 - DNA, 21 bp, Artificial Sequence
  Synthetic
gggctttatatggggctgcat

SEQ ID NO: 25775 - DNA, 21 bp, Artificial Sequence
  Synthetic
aatagttatccgggtgtttgg

SEQ ID NO: 25776 - DNA, 21 bp, Artificial Sequence
  Synthetic
tggcatcagcattcggagcgt

SEQ ID NO: 25777 - DNA, 21 bp, Artificial Sequence
  Synthetic
ggggttcggggggttgatcgt

SEQ ID NO: 25778 - DNA, 21 bp, Artificial Sequence
  Synthetic
gaggcgtggggggggtctcag

SEQ ID NO: 25779 - DNA, 21 bp, Artificial Sequence
  Synthetic
gttgggtcttattcgtcttgg

SEQ ID NO: 25780 - DNA, 21 bp, Artificial Sequence
  Synthetic
ttgtggacggggatggctcag

SEQ ID NO: 25781 - DNA, 21 bp, Artificial Sequence
  Synthetic
gtgttgatgggtcgggagggt

SEQ ID NO: 25782 - DNA, 21 bp, Artificial Sequence
  Synthetic
aggcctcatcctaatcctcat

SEQ ID NO: 25783 - DNA, 21 bp, Artificial Sequence
  Synthetic
acggtggttgggagtctttgg

SEQ ID NO: 25784 - DNA, 21 bp, Artificial Sequence
  Synthetic
ctttttgggggtgggagtact

SEQ ID NO: 25785 - DNA, 21 bp, Artificial Sequence
  Synthetic
aatccggattcgtcgcggtgg

SEQ ID NO: 25786 - DNA, 21 bp, Artificial Sequence
  Synthetic
agttttcctgggtcgtcggcg

SEQ ID NO: 25787 - DNA, 21 bp, Artificial Sequence
  Synthetic
aggttgccgtatccggatttg

SEQ ID NO: 25788 - DNA, 21 bp, Artificial Sequence
  Synthetic
tctgctgttgggacggtgtat

SEQ ID NO: 25789 - DNA, 21 bp, Artificial Sequence
  Synthetic
gctgttgctgggtttcgttat

SEQ ID NO: 25790 - DNA, 21 bp, Artificial Sequence
  Synthetic
ccggtttatggtctgtctagt

SEQ ID NO: 25791 - DNA, 21 bp, Artificial Sequence
  Synthetic
cctcgtcagaattttagtagt

SEQ ID NO: 25792 - DNA, 21 bp, Artificial Sequence
  Synthetic
ctgcagatggggtatgcgcag

SEQ ID NO: 25793 - DNA, 21 bp, Artificial Sequence
  Synthetic
tggatttatggtggtagtgct

SEQ ID NO: 25794 - DNA, 21 bp, Artificial Sequence
  Synthetic
gatgttgctcctgggcgttgg

SEQ ID NO: 25795 - DNA, 21 bp, Artificial Sequence
  Synthetic
ccgtttatgggtacgtatgct

SEQ ID NO: 25796 - DNA, 21 bp, Artificial Sequence
  Synthetic
ttgatgactaagtcgctgtgg

SEQ ID NO: 25797 - DNA, 21 bp, Artificial Sequence
  Synthetic
ggggttctgctgcatattaag

SEQ ID NO: 25798 - DNA, 21 bp, Artificial Sequence
  Synthetic
cggccgacgaggccggagcat

SEQ ID NO: 25799 - DNA, 21 bp, Artificial Sequence
  Synthetic
gctcatgaggttcatcgttgg

SEQ ID NO: 25800 - DNA, 21 bp, Artificial Sequence
  Synthetic
tcggcttttcatcttccgact

SEQ ID NO: 25801 - DNA, 21 bp, Artificial Sequence
  Synthetic
gaggggaatgtggggcgttgg

SEQ ID NO: 25802 - DNA, 21 bp, Artificial Sequence
  Synthetic
ttggtgatttatggtgcggct

SEQ ID NO: 25803 - DNA, 21 bp, Artificial Sequence
  Synthetic
tgggtgtatgggacgagtgag

SEQ ID NO: 25804 - DNA, 21 bp, Artificial Sequence
  Synthetic
ggtgtggcttggggtagttct

SEQ ID NO: 25805 - DNA, 21 bp, Artificial Sequence
  Synthetic
aatctgctgtatggttataat

SEQ ID NO: 25806 - DNA, 21 bp, Artificial Sequence
  Synthetic
acttatcctttgggttctgtt

SEQ ID NO: 25807 - DNA, 21 bp, Artificial Sequence
  Synthetic
ctgccggggtttggtagtcgt

SEQ ID NO: 25808 - DNA, 21 bp, Artificial Sequence
  Synthetic
aggcatcctgcggattcgtcg

SEQ ID NO: 25809 - DNA, 21 bp, Artificial Sequence
  Synthetic
acgtatgatttgcgttttact

SEQ ID NO: 25810 - DNA, 21 bp, Artificial Sequence
  Synthetic
ttgtggccgggggcgtcggcg

SEQ ID NO: 25811 - DNA, 21 bp, Artificial Sequence
  Synthetic
tggggtaatcaggttggtcgg

SEQ ID NO: 25812 - DNA, 21 bp, Artificial Sequence
  Synthetic
cttgttcggccgtatagtagt

SEQ ID NO: 25813 - DNA, 21 bp, Artificial Sequence
  Synthetic
gagtggcatcgtgggtctagt

SEQ ID NO: 25814 - DNA, 21 bp, Artificial Sequence
  Synthetic
gcggagtggcgtggggcggcg

SEQ ID NO: 25815 - DNA, 21 bp, Artificial Sequence
  Synthetic
ctgacttatgggatggctcag

SEQ ID NO: 25816 - DNA, 21 bp, Artificial Sequence
  Synthetic
cgtgtggttgagaatcagcgg

SEQ ID NO: 25817 - DNA, 21 bp, Artificial Sequence
  Synthetic
gcttatgtgcatgattataag

SEQ ID NO: 25818 - DNA, 21 bp, Artificial Sequence
  Synthetic
gagggggctcctggggcttgg

SEQ ID NO: 25819 - DNA, 21 bp, Artificial Sequence
  Synthetic
atggttagttatggtagttcg

SEQ ID NO: 25820 - DNA, 21 bp, Artificial Sequence
  Synthetic
cctgagagttcttttaggtgg

SEQ ID NO: 25821 - DNA, 21 bp, Artificial Sequence
  Synthetic
actcggcctttggggtcttcg

SEQ ID NO: 25822 - DNA, 21 bp, Artificial Sequence
  Synthetic
cagcgtatgttgaatcgtgat

SEQ ID NO: 25823 - DNA, 21 bp, Artificial Sequence
  Synthetic
cataaggttgagatgcatagg

SEQ ID NO: 25824 - DNA, 21 bp, Artificial Sequence
  Synthetic
gtttatgcggggtatagttct

SEQ ID NO: 25825 - DNA, 21 bp, Artificial Sequence
  Synthetic
ggtaaggatatgagtcgttgg

SEQ ID NO: 25826 - DNA, 21 bp, Artificial Sequence
  Synthetic
gatgggccggggcttaggtat

SEQ ID NO: 25827 - DNA, 21 bp, Artificial Sequence
  Synthetic
ggttcgaatcttgggatgtgg

SEQ ID NO: 25828 - DNA, 21 bp, Artificial Sequence
  Synthetic
gaggggtgggggacgagtact

SEQ ID NO: 25829 - DNA, 21 bp, Artificial Sequence
  Synthetic
gatcctagtactgctaggtgg

SEQ ID NO: 25830 - DNA, 21 bp, Artificial Sequence
  Synthetic
tgggtttatgggactaaggag

SEQ ID NO: 25831 - DNA, 21 bp, Artificial Sequence
  Synthetic
gatcctaatcctgggcgttgg

SEQ ID NO: 25832 - DNA, 21 bp, Artificial Sequence
  Synthetic
aatgtgtggcatgggagtgtt

SEQ ID NO: 25833 - DNA, 21 bp, Artificial Sequence
  Synthetic
aaggggggttgggtggagcat

SEQ ID NO: 25834 - DNA, 21 bp, Artificial Sequence
  Synthetic
ccggttaagtttgcgttgggt

SEQ ID NO: 25835 - DNA, 21 bp, Artificial Sequence
  Synthetic
tatctgttgggtaaggaggcg

SEQ ID NO: 25836 - DNA, 21 bp, Artificial Sequence
  Synthetic
cctgtttggggtcatactact

SEQ ID NO: 25837 - DNA, 21 bp, Artificial Sequence
  Synthetic
actactgattatagtaggtgg

SEQ ID NO: 25838 - DNA, 21 bp, Artificial Sequence
  Synthetic
tctgggcatgttgggccttgg

SEQ ID NO: 25839 - DNA, 21 bp, Artificial Sequence
  Synthetic
tattggggtgggcttgggccg

SEQ ID NO: 25840 - DNA, 21 bp, Artificial Sequence
  Synthetic
gatattccgacgcatcgttgg

SEQ ID NO: 25841 - DNA, 21 bp, Artificial Sequence
  Synthetic
aggtttgcgccggggcgggat

SEQ ID NO: 25842 - DNA, 21 bp, Artificial Sequence
  Synthetic
aggcatgatccgtctgggcat

SEQ ID NO: 25843 - DNA, 21 bp, Artificial Sequence
  Synthetic
gtggatggtgttgttcgttgg

SEQ ID NO: 25844 - DNA, 21 bp, Artificial Sequence
  Synthetic
cgtcttgggactgagtctagg

SEQ ID NO: 25845 - DNA, 21 bp, Artificial Sequence
  Synthetic
tgtccggagttgtatgggtgt

SEQ ID NO: 25846 - DNA, 21 bp, Artificial Sequence
  Synthetic
ccgccgcatggttcttggagt

SEQ ID NO: 25847 - DNA, 21 bp, Artificial Sequence
  Synthetic
catgcgtctggttatgctcag

SEQ ID NO: 25848 - DNA, 21 bp, Artificial Sequence
  Synthetic
gagtatattcagcttaggcct

SEQ ID NO: 25849 - DNA, 21 bp, Artificial Sequence
  Synthetic
ccgcggtatgcgattgatcat

SEQ ID NO: 25850 - DNA, 21 bp, Artificial Sequence
  Synthetic
atgtggacggcggggagtact

SEQ ID NO: 25851 - DNA, 21 bp, Artificial Sequence
  Synthetic
agggctggtgctgtggcgtgg

SEQ ID NO: 25852 - DNA, 21 bp, Artificial Sequence
  Synthetic
agtcatgtggcgcatgggtgg

SEQ ID NO: 25853 - DNA, 21 bp, Artificial Sequence
  Synthetic
aagtggacggagcgtcctccg

SEQ ID NO: 25854 - DNA, 21 bp, Artificial Sequence
  Synthetic
tttcgggctgatggtcataag

SEQ ID NO: 25855 - DNA, 21 bp, Artificial Sequence
  Synthetic
ggtacggcgtcgaggtgggat

SEQ ID NO: 25856 - DNA, 21 bp, Artificial Sequence
  Synthetic
tggactttgagtgctgcgtat

SEQ ID NO: 25857 - DNA, 21 bp, Artificial Sequence
  Synthetic
actaagtcgctttgggcggct

SEQ ID NO: 25858 - DNA, 21 bp, Artificial Sequence
  Synthetic
attctgaatcggtggggggat

SEQ ID NO: 25859 - DNA, 21 bp, Artificial Sequence
  Synthetic
tctgagtatattcgtagtatt

SEQ ID NO: 25860 - DNA, 21 bp, Artificial Sequence
  Synthetic
gtttggggggggatgggtcat

SEQ ID NO: 25861 - DNA, 21 bp, Artificial Sequence
  Synthetic
aaggcgccgggtttttcggtt

SEQ ID NO: 25862 - DNA, 21 bp, Artificial Sequence
  Synthetic
atgatttcgctggggtctagt

SEQ ID NO: 25863 - DNA, 21 bp, Artificial Sequence
  Synthetic
gcgcatgcgcatgattattat

SEQ ID NO: 25864 - DNA, 21 bp, Artificial Sequence
  Synthetic
acgtattttgcgggtgctact

SEQ ID NO: 25865 - DNA, 21 bp, Artificial Sequence
  Synthetic
ccttggattgagggggcttgg

SEQ ID NO: 25866 - DNA, 21 bp, Artificial Sequence
  Synthetic
gatccttctcgttcttggacg

SEQ ID NO: 25867 - DNA, 21 bp, Artificial Sequence
  Synthetic
tggcagatgaagggttctact

SEQ ID NO: 25868 - DNA, 21 bp, Artificial Sequence
  Synthetic
tggccggctatggctaggccg

SEQ ID NO: 25869 - DNA, 21 bp, Artificial Sequence
  Synthetic
gtgtatatgagtggttttcat

SEQ ID NO: 25870 - DNA, 21 bp, Artificial Sequence
  Synthetic
ggtcatcggggtggtagttcg

SEQ ID NO: 25871 - DNA, 21 bp, Artificial Sequence
  Synthetic
tggagtacttggactgagggg

SEQ ID NO: 25872 - DNA, 21 bp, Artificial Sequence
  Synthetic
cgttatctgggtgagttgtct

SEQ ID NO: 25873 - DNA, 21 bp, Artificial Sequence
  Synthetic
ccgattcctagtgggcagtgg

SEQ ID NO: 25874 - DNA, 21 bp, Artificial Sequence
  Synthetic
tatcgtattcatggggatcat

SEQ ID NO: 25875 - DNA, 21 bp, Artificial Sequence
  Synthetic
cgtttgtctgctggtagtcat

SEQ ID NO: 25876 - DNA, 21 bp, Artificial Sequence
  Synthetic
tctcaggtgtgggagcggtcg

SEQ ID NO: 25877 - DNA, 21 bp, Artificial Sequence
  Synthetic
cgttttcctggtgataattct

SEQ ID NO: 25878 - DNA, 21 bp, Artificial Sequence
  Synthetic
tttccgggttttaatcttcat

SEQ ID NO: 25879 - DNA, 21 bp, Artificial Sequence
  Synthetic
gagaggctggggttggctcag

SEQ ID NO: 25880 - DNA, 21 bp, Artificial Sequence
  Synthetic
ccggttgctgggtggagttcg

SEQ ID NO: 25881 - DNA, 21 bp, Artificial Sequence
  Synthetic
ctgtctatggggtttgcgcag

SEQ ID NO: 25882 - DNA, 21 bp, Artificial Sequence
  Synthetic
gttgtttatgggggttctact

SEQ ID NO: 25883 - DNA, 21 bp, Artificial Sequence
  Synthetic
agtgcgtttcgtggttcgacg

SEQ ID NO: 25884 - DNA, 21 bp, Artificial Sequence
  Synthetic
cggctgacgactcgtggtgat

SEQ ID NO: 25885 - DNA, 21 bp, Artificial Sequence
  Synthetic
agtcatcagcttctgccgtat

SEQ ID NO: 25886 - DNA, 21 bp, Artificial Sequence
  Synthetic
gggattgagcgtcagtatttt

SEQ ID NO: 25887 - DNA, 21 bp, Artificial Sequence
  Synthetic
ggtgctattaataatcattgg

SEQ ID NO: 25888 - DNA, 21 bp, Artificial Sequence
  Synthetic
ggtgagtcgcatggtcggtgg

SEQ ID NO: 25889 - DNA, 21 bp, Artificial Sequence
  Synthetic
gctaatgagtatatgggttgg

SEQ ID NO: 25890 - DNA, 21 bp, Artificial Sequence
  Synthetic
tcgcttgggtatggttattcg

SEQ ID NO: 25891 - DNA, 21 bp, Artificial Sequence
  Synthetic
aaggcgtattctctgaatgtt

SEQ ID NO: 25892 - DNA, 21 bp, Artificial Sequence
  Synthetic
ccgtcggagttgtatggttgg

SEQ ID NO: 25893 - DNA, 21 bp, Artificial Sequence
  Synthetic
atggggatgagggagaatcgt

SEQ ID NO: 25894 - DNA, 21 bp, Artificial Sequence
  Synthetic
aattggcaggggaatgggaag

SEQ ID NO: 25895 - DNA, 21 bp, Artificial Sequence
  Synthetic
gtttatcatggttatacgatt

SEQ ID NO: 25896 - DNA, 21 bp, Artificial Sequence
  Synthetic
gttcctaattggcgtgcggat

SEQ ID NO: 25897 - DNA, 21 bp, Artificial Sequence
  Synthetic
ccttgggagaggttttcgagt

SEQ ID NO: 25898 - DNA, 21 bp, Artificial Sequence
  Synthetic
gcgcatcttggggattttcgg

SEQ ID NO: 25899 - DNA, 21 bp, Artificial Sequence
  Synthetic
gcttatagtggttatagtctg

SEQ ID NO: 25900 - DNA, 21 bp, Artificial Sequence
  Synthetic
gtgtttttgttgggtagtgct

SEQ ID NO: 25901 - DNA, 21 bp, Artificial Sequence
  Synthetic
agtctggattctggtcgttgg

SEQ ID NO: 25902 - DNA, 21 bp, Artificial Sequence
  Synthetic
ccgtggaataattcgtatggg

SEQ ID NO: 25903 - DNA, 21 bp, Artificial Sequence
  Synthetic
ccggcgcatgctattccgtat

SEQ ID NO: 25904 - DNA, 21 bp, Artificial Sequence
  Synthetic
caggtgaggggtttttcgagt

SEQ ID NO: 25905 - DNA, 21 bp, Artificial Sequence
  Synthetic
atggtgtatgggaatgctcag

SEQ ID NO: 25906 - DNA, 21 bp, Artificial Sequence
  Synthetic
tgggtggttaaggggtctgct

SEQ ID NO: 25907 - DNA, 21 bp, Artificial Sequence
  Synthetic
actaaggctcagtggaatagt

SEQ ID NO: 25908 - DNA, 21 bp, Artificial Sequence
  Synthetic
tataggctgggtcatgagagt

SEQ ID NO: 25909 - DNA, 21 bp, Artificial Sequence
  Synthetic
agggatcgtgatagtacgcgt

SEQ ID NO: 25910 - DNA, 21 bp, Artificial Sequence
  Synthetic
gaggatgggagttctcggtgg

SEQ ID NO: 25911 - DNA, 21 bp, Artificial Sequence
  Synthetic
ccgttgcatgcggcgtatgcg

SEQ ID NO: 25912 - DNA, 21 bp, Artificial Sequence
  Synthetic
gtgggtgtggtgaatatgtgg

SEQ ID NO: 25913 - DNA, 21 bp, Artificial Sequence
  Synthetic
gcgagtgcgcatagtatgtgg

SEQ ID NO: 25914 - DNA, 21 bp, Artificial Sequence
  Synthetic
gcggagtggcatggtagtact

SEQ ID NO: 25915 - DNA, 21 bp, Artificial Sequence
  Synthetic
attgcgatgggttattcgacg

SEQ ID NO: 25916 - DNA, 21 bp, Artificial Sequence
  Synthetic
gtggcggtgtttggttatgct

SEQ ID NO: 25917 - DNA, 21 bp, Artificial Sequence
  Synthetic
tgggcgaatttgggttctacg

SEQ ID NO: 25918 - DNA, 21 bp, Artificial Sequence
  Synthetic
ctgtttattcatcagagttcg

SEQ ID NO: 25919 - DNA, 21 bp, Artificial Sequence
  Synthetic
cagtataaggggtattctacg

SEQ ID NO: 25920 - DNA, 21 bp, Artificial Sequence
  Synthetic
attcatgtggagtcgaggaag

SEQ ID NO: 25921 - DNA, 21 bp, Artificial Sequence
  Synthetic
tatgttccgcttccgggtttt

SEQ ID NO: 25922 - DNA, 21 bp, Artificial Sequence
  Synthetic
cagtcttctttttctggttgg

SEQ ID NO: 25923 - DNA, 21 bp, Artificial Sequence
  Synthetic
catgttccggagaagcgtatt

SEQ ID NO: 25924 - DNA, 21 bp, Artificial Sequence
  Synthetic
atggggaattcggggatttgg

SEQ ID NO: 25925 - DNA, 21 bp, Artificial Sequence
  Synthetic
ctggctccgggtctttcttcg

SEQ ID NO: 25926 - DNA, 21 bp, Artificial Sequence
  Synthetic
ccgtatgcgggtgcttctcat

SEQ ID NO: 25927 - DNA, 21 bp, Artificial Sequence
  Synthetic
tctattagttttggttcgtcg

SEQ ID NO: 25928 - DNA, 21 bp, Artificial Sequence
  Synthetic
aatggggagcctgggcgttgg

SEQ ID NO: 25929 - DNA, 21 bp, Artificial Sequence
  Synthetic
agtgaggtgtggatggctagt

SEQ ID NO: 25930 - DNA, 21 bp, Artificial Sequence
  Synthetic
gatgcgtggaggggttctgct

SEQ ID NO: 25931 - DNA, 21 bp, Artificial Sequence
  Synthetic
ccgctgaataatggtcggtgg

SEQ ID NO: 25932 - DNA, 21 bp, Artificial Sequence
  Synthetic
ggtgtgctggagatgaggtgg

SEQ ID NO: 25933 - DNA, 21 bp, Artificial Sequence
  Synthetic
gatgggcatcggagtatttat

SEQ ID NO: 25934 - DNA, 21 bp, Artificial Sequence
  Synthetic
ggtcgttatgatttgaatcat

SEQ ID NO: 25935 - DNA, 21 bp, Artificial Sequence
  Synthetic
gtggcgtatcggggtgcgagt

SEQ ID NO: 25936 - DNA, 21 bp, Artificial Sequence
  Synthetic
aatgtgcataatagtcggtgt

SEQ ID NO: 25937 - DNA, 21 bp, Artificial Sequence
  Synthetic
ttggggtctggtcatccgagg

SEQ ID NO: 25938 - DNA, 21 bp, Artificial Sequence
  Synthetic
attgtggctatggggtctagt

SEQ ID NO: 25939 - DNA, 21 bp, Artificial Sequence
  Synthetic
cgtgggtttggggattatgtg

SEQ ID NO: 25940 - DNA, 21 bp, Artificial Sequence
  Synthetic
agtgtgacgggtcatctttgg

SEQ ID NO: 25941 - DNA, 21 bp, Artificial Sequence
  Synthetic
tatcgtgggggtacgggtgcg

SEQ ID NO: 25942 - DNA, 21 bp, Artificial Sequence
  Synthetic
cagccgtttcagcttggtcat

SEQ ID NO: 25943 - DNA, 21 bp, Artificial Sequence
  Synthetic
gatcaggggacttcgtattgg

SEQ ID NO: 25944 - DNA, 21 bp, Artificial Sequence
  Synthetic
gagaatggttatgctcgttat

SEQ ID NO: 25945 - DNA, 21 bp, Artificial Sequence
  Synthetic
ttgtggacggggggtgcttcg

SEQ ID NO: 25946 - DNA, 21 bp, Artificial Sequence
  Synthetic
ccgttgtatagttcttttact

SEQ ID NO: 25947 - DNA, 21 bp, Artificial Sequence
  Synthetic
cattcgcggaatgggcttttg

SEQ ID NO: 25948 - DNA, 21 bp, Artificial Sequence
  Synthetic
tttcctggttatgggtcgact

SEQ ID NO: 25949 - DNA, 21 bp, Artificial Sequence
  Synthetic
gagtattataagggtagtgcg

SEQ ID NO: 25950 - DNA, 21 bp, Artificial Sequence
  Synthetic
ctggcgcatcatggttctagt

SEQ ID NO: 25951 - DNA, 21 bp, Artificial Sequence
  Synthetic
attagggttgggcagtcttgg

SEQ ID NO: 25952 - DNA, 21 bp, Artificial Sequence
  Synthetic
gcttattattcgggttcgacg

SEQ ID NO: 25953 - DNA, 21 bp, Artificial Sequence
  Synthetic
gtggttggtgatgctcggtgg

SEQ ID NO: 25954 - DNA, 21 bp, Artificial Sequence
  Synthetic
tttggtttgtttattgagagg

SEQ ID NO: 25955 - DNA, 21 bp, Artificial Sequence
  Synthetic
gatgtgctgggggctaggtgg

SEQ ID NO: 25956 - DNA, 21 bp, Artificial Sequence
  Synthetic
gatcttgatggttggcattat

SEQ ID NO: 25957 - DNA, 21 bp, Artificial Sequence
  Synthetic
cctatgccttatacgagttct

SEQ ID NO: 25958 - DNA, 21 bp, Artificial Sequence
  Synthetic
atggggaatcctttgcttaag

SEQ ID NO: 25959 - DNA, 21 bp, Artificial Sequence
  Synthetic
cgtgggcctaataaggttgat

SEQ ID NO: 25960 - DNA, 21 bp, Artificial Sequence
  Synthetic
acggagtataggggtgcgact

SEQ ID NO: 25961 - DNA, 21 bp, Artificial Sequence
  Synthetic
gtggagagtagtaggtgggcg

SEQ ID NO: 25962 - DNA, 21 bp, Artificial Sequence
  Synthetic
cttgtgtatgctgggagtgcg

SEQ ID NO: 25963 - DNA, 21 bp, Artificial Sequence
  Synthetic
gctaatcatagtcctggttgg

SEQ ID NO: 25964 - DNA, 21 bp, Artificial Sequence
  Synthetic
ggtctttcgtatgtggggtgg

SEQ ID NO: 25965 - DNA, 21 bp, Artificial Sequence
  Synthetic
gagcgtcttaattttagttct

SEQ ID NO: 25966 - DNA, 21 bp, Artificial Sequence
  Synthetic
aggctggattctgctgtgtgg

SEQ ID NO: 25967 - DNA, 21 bp, Artificial Sequence
  Synthetic
gtgatgcagtgggatagggcg

SEQ ID NO: 25968 - DNA, 21 bp, Artificial Sequence
  Synthetic
ctgtttattgggcagtcgagt

SEQ ID NO: 25969 - DNA, 21 bp, Artificial Sequence
  Synthetic
ggtggtcttgctcctcgttat

SEQ ID NO: 25970 - DNA, 21 bp, Artificial Sequence
  Synthetic
gagcggactattccttctcgg

SEQ ID NO: 25971 - DNA, 21 bp, Artificial Sequence
  Synthetic
tatggtactcttagtattttt

SEQ ID NO: 25972 - DNA, 21 bp, Artificial Sequence
  Synthetic
agtgtggtgaattatcatagt

SEQ ID NO: 25973 - DNA, 21 bp, Artificial Sequence
  Synthetic
agttggcctgggctgtcgcag

SEQ ID NO: 25974 - DNA, 21 bp, Artificial Sequence
  Synthetic
cggcagaatcctaattggggt

SEQ ID NO: 25975 - DNA, 21 bp, Artificial Sequence
  Synthetic
cgtgggacgccgggtccgtgg

SEQ ID NO: 25976 - DNA, 21 bp, Artificial Sequence
  Synthetic
gagtattataatgggtctgcg

SEQ ID NO: 25977 - DNA, 21 bp, Artificial Sequence
  Synthetic
gttgagtcttggaatagggcg

SEQ ID NO: 25978 - DNA, 21 bp, Artificial Sequence
  Synthetic
tcttttatggggtatagttcg

SEQ ID NO: 25979 - DNA, 21 bp, Artificial Sequence
  Synthetic
gggagtgcttatgatctgagg

SEQ ID NO: 25980 - DNA, 21 bp, Artificial Sequence
  Synthetic
atggttcagttgggttatgcg

SEQ ID NO: 25981 - DNA, 21 bp, Artificial Sequence
  Synthetic
agttcgattgggtggagtgcg

SEQ ID NO: 25982 - DNA, 21 bp, Artificial Sequence
  Synthetic
aagacttatgagattccgtat

SEQ ID NO: 25983 - DNA, 21 bp, Artificial Sequence
  Synthetic
gatgcgactgtttcgcgttgg

SEQ ID NO: 25984 - DNA, 21 bp, Artificial Sequence
  Synthetic
atgaagcatgagtattctagt

SEQ ID NO: 25985 - DNA, 21 bp, Artificial Sequence
  Synthetic
cgtcttgagacgcagtttaag

SEQ ID NO: 25986 - DNA, 21 bp, Artificial Sequence
  Synthetic
gcggcgtggggtcatgcgcag

SEQ ID NO: 25987 - DNA, 21 bp, Artificial Sequence
  Synthetic
ctgaggcagctgggttcgagt

SEQ ID NO: 25988 - DNA, 21 bp, Artificial Sequence
  Synthetic
agtgctgcttggagtgctagt

SEQ ID NO: 25989 - DNA, 21 bp, Artificial Sequence
  Synthetic
ccgcagtggggtggtattagt

SEQ ID NO: 25990 - DNA, 21 bp, Artificial Sequence
  Synthetic
gcggtgccgggttggtctatg

SEQ ID NO: 25991 - DNA, 21 bp, Artificial Sequence
  Synthetic
tggggtgttttgaatgttatg

SEQ ID NO: 25992 - DNA, 21 bp, Artificial Sequence
  Synthetic
tcggcttggcaggggtcgtcg

SEQ ID NO: 25993 - DNA, 21 bp, Artificial Sequence
  Synthetic
ggtcttcttacggggtttggt

SEQ ID NO: 25994 - DNA, 21 bp, Artificial Sequence
  Synthetic
gagatggggtctgtgaggtgg

SEQ ID NO: 25995 - DNA, 21 bp, Artificial Sequence
  Synthetic
agggatactgggccgggtagg

SEQ ID NO: 25996 - DNA, 21 bp, Artificial Sequence
  Synthetic
ggtaatcgtgctgatggtaag

SEQ ID NO: 25997 - DNA, 21 bp, Artificial Sequence
  Synthetic
actcgtaatcttgggtcggct

SEQ ID NO: 25998 - DNA, 21 bp, Artificial Sequence
  Synthetic
tgggggcggggtatggatggt

SEQ ID NO: 25999 - DNA, 21 bp, Artificial Sequence
  Synthetic
ctttatgtgcatggtgcgagt

SEQ ID NO: 26000 - DNA, 21 bp, Artificial Sequence
  Synthetic
cggagggatccgaatcttgtg

SEQ ID NO: 26001 - DNA, 21 bp, Artificial Sequence
  Synthetic
ttgtttcctcatcagtcgact

SEQ ID NO: 26002 - DNA, 21 bp, Artificial Sequence
  Synthetic
gtgcctttttcgctgtcgttg

SEQ ID NO: 26003 - DNA, 21 bp, Artificial Sequence
  Synthetic
gtgtgggctgggcagagtagt

SEQ ID NO: 26004 - DNA, 21 bp, Artificial Sequence
  Synthetic
cattatgttgggagttcttat

SEQ ID NO: 26005 - DNA, 21 bp, Artificial Sequence
  Synthetic
aggcatactattgaggttagg

SEQ ID NO: 26006 - DNA, 21 bp, Artificial Sequence
  Synthetic
catgggtttcagaggaatgct

SEQ ID NO: 26007 - DNA, 21 bp, Artificial Sequence
  Synthetic
attcgtatgaatcagagtcat

SEQ ID NO: 26008 - DNA, 21 bp, Artificial Sequence
  Synthetic
tgggtgctgccgaggggtgag

SEQ ID NO: 26009 - DNA, 21 bp, Artificial Sequence
  Synthetic
ttgcttggtcgggctgtgggt

SEQ ID NO: 26010 - DNA, 21 bp, Artificial Sequence
  Synthetic
atgcggctgggggcttctcag

SEQ ID NO: 26011 - DNA, 21 bp, Artificial Sequence
  Synthetic
cagtggccgggggatgcgagt

SEQ ID NO: 26012 - DNA, 21 bp, Artificial Sequence
  Synthetic
gatcctgcttcgaataggtgg

SEQ ID NO: 26013 - DNA, 21 bp, Artificial Sequence
  Synthetic
aatttgctgggtggttttcgg

SEQ ID NO: 26014 - DNA, 21 bp, Artificial Sequence
  Synthetic
cggtgggatagggatcttctt

SEQ ID NO: 26015 - DNA, 21 bp, Artificial Sequence
  Synthetic
gaggcgcggggttttagtcag

SEQ ID NO: 26016 - DNA, 21 bp, Artificial Sequence
  Synthetic
gatcggcctgggtatagttct

SEQ ID NO: 26017 - DNA, 21 bp, Artificial Sequence
  Synthetic
gtgttttctattcagagtatt

SEQ ID NO: 26018 - DNA, 21 bp, Artificial Sequence
  Synthetic
aggtatattcctgaggcgagt

SEQ ID NO: 26019 - DNA, 21 bp, Artificial Sequence
  Synthetic
tgggatacggcgaggggttat

SEQ ID NO: 26020 - DNA, 21 bp, Artificial Sequence
  Synthetic
ggggttgagaggggtcctcgt

SEQ ID NO: 26021 - DNA, 21 bp, Artificial Sequence
  Synthetic
agggatggtggtaagcatgct

SEQ ID NO: 26022 - DNA, 21 bp, Artificial Sequence
  Synthetic
gctaagagtcatgggcgggag

SEQ ID NO: 26023 - DNA, 21 bp, Artificial Sequence
  Synthetic
aggggtcagtatgatccgatg

SEQ ID NO: 26024 - DNA, 21 bp, Artificial Sequence
  Synthetic
gagggtcatgttgggaagtgg

SEQ ID NO: 26025 - DNA, 21 bp, Artificial Sequence
  Synthetic
gttgttgatactggtcggtgg

SEQ ID NO: 26026 - DNA, 21 bp, Artificial Sequence
  Synthetic
actgttgtgcatgcgtatttg

SEQ ID NO: 26027 - DNA, 21 bp, Artificial Sequence
  Synthetic
cttaatccgaataatcagcgt

SEQ ID NO: 26028 - DNA, 21 bp, Artificial Sequence
  Synthetic
tggagtgttggtactatttat

SEQ ID NO: 26029 - DNA, 21 bp, Artificial Sequence
  Synthetic
atgcgtgaggctagttcgcgg

SEQ ID NO: 26030 - DNA, 21 bp, Artificial Sequence
  Synthetic
cttgtggctgggtattcttct

SEQ ID NO: 26031 - DNA, 21 bp, Artificial Sequence
  Synthetic
attcctgtttatagtaatacg

SEQ ID NO: 26032 - DNA, 21 bp, Artificial Sequence
  Synthetic
ccggataattctgggcggtgg

SEQ ID NO: 26033 - DNA, 21 bp, Artificial Sequence
  Synthetic
agtcattggggtgctgcgagt

SEQ ID NO: 26034 - DNA, 21 bp, Artificial Sequence
  Synthetic
ccttctgctcattctatgtgg

SEQ ID NO: 26035 - DNA, 21 bp, Artificial Sequence
  Synthetic
cctgctaattctgcggtttgg

SEQ ID NO: 26036 - DNA, 21 bp, Artificial Sequence
  Synthetic
gtgctgttgcggtcgtgggat

SEQ ID NO: 26037 - DNA, 21 bp, Artificial Sequence
  Synthetic
gagtggaagtatagtgcggct

SEQ ID NO: 26038 - DNA, 21 bp, Artificial Sequence
  Synthetic
ttgttttatggtggttcgctt

SEQ ID NO: 26039 - DNA, 21 bp, Artificial Sequence
  Synthetic
agtcctggtcttgatcttttt

SEQ ID NO: 26040 - DNA, 21 bp, Artificial Sequence
  Synthetic
cggtatgagggttattcggcg

SEQ ID NO: 26041 - DNA, 21 bp, Artificial Sequence
  Synthetic
aattggggtggttttggtgag

SEQ ID NO: 26042 - DNA, 21 bp, Artificial Sequence
  Synthetic
gtgcttcgtacggattgggct

SEQ ID NO: 26043 - DNA, 21 bp, Artificial Sequence
  Synthetic
cataatgggtcgtttcctagg

SEQ ID NO: 26044 - DNA, 21 bp, Artificial Sequence
  Synthetic
cattttacgttgatgtctgct

SEQ ID NO: 26045 - DNA, 21 bp, Artificial Sequence
  Synthetic
gagcggcatctgcatccttct

SEQ ID NO: 26046 - DNA, 21 bp, Artificial Sequence
  Synthetic
gggcattctattagtcattgg

SEQ ID NO: 26047 - DNA, 21 bp, Artificial Sequence
  Synthetic
tggagtactttttctgctggt

SEQ ID NO: 26048 - DNA, 21 bp, Artificial Sequence
  Synthetic
ccgcttgggacgcagcattgg

SEQ ID NO: 26049 - DNA, 21 bp, Artificial Sequence
  Synthetic
ttgtgggctcatcattctacg

SEQ ID NO: 26050 - DNA, 21 bp, Artificial Sequence
  Synthetic
tgggagaatatgcgttatggg

SEQ ID NO: 26051 - DNA, 21 bp, Artificial Sequence
  Synthetic
gttttgacttataggcagggt

SEQ ID NO: 26052 - DNA, 21 bp, Artificial Sequence
  Synthetic
tggggtgagattgggcgttgg

SEQ ID NO: 26053 - DNA, 21 bp, Artificial Sequence
  Synthetic
ggtacttcgatgggggcgtgg

SEQ ID NO: 26054 - DNA, 21 bp, Artificial Sequence
  Synthetic
gcttatccgggtcaggcttcg

SEQ ID NO: 26055 - DNA, 21 bp, Artificial Sequence
  Synthetic
gagcagagggggtggagtgcg

SEQ ID NO: 26056 - DNA, 21 bp, Artificial Sequence
  Synthetic
cttcgtgatcgtgcgattttt

SEQ ID NO: 26057 - DNA, 21 bp, Artificial Sequence
  Synthetic
aagctgagtgagaggagtcat

SEQ ID NO: 26058 - DNA, 21 bp, Artificial Sequence
  Synthetic
tggtctgctatggggtctgct

SEQ ID NO: 26059 - DNA, 21 bp, Artificial Sequence
  Synthetic
gatgcgccgtggatgtctcat

SEQ ID NO: 26060 - DNA, 21 bp, Artificial Sequence
  Synthetic
ggggagctgaattggagttct

SEQ ID NO: 26061 - DNA, 21 bp, Artificial Sequence
  Synthetic
ctggattcgatttgggttcat

SEQ ID NO: 26062 - DNA, 21 bp, Artificial Sequence
  Synthetic
ctgaattattcggctagtctg

SEQ ID NO: 26063 - DNA, 21 bp, Artificial Sequence
  Synthetic
tcgaatcctggtttttcttct

SEQ ID NO: 26064 - DNA, 21 bp, Artificial Sequence
  Synthetic
agtgattatagtttgcgttat

SEQ ID NO: 26065 - DNA, 21 bp, Artificial Sequence
  Synthetic
ccgtttgggagtggtgtttgg

SEQ ID NO: 26066 - DNA, 21 bp, Artificial Sequence
  Synthetic
cggccttatgtgcttcctgat

SEQ ID NO: 26067 - DNA, 21 bp, Artificial Sequence
  Synthetic
gagcgtacgcatggttcgtct

SEQ ID NO: 26068 - DNA, 21 bp, Artificial Sequence
  Synthetic
gtgaagactggttatggttat

SEQ ID NO: 26069 - DNA, 21 bp, Artificial Sequence
  Synthetic
gtgcagatgggttcgatttat

SEQ ID NO: 26070 - DNA, 21 bp, Artificial Sequence
  Synthetic
gtgtatgttccgcagtcggcg

SEQ ID NO: 26071 - DNA, 21 bp, Artificial Sequence
  Synthetic
gttcgtagttgggcgagtgat

SEQ ID NO: 26072 - DNA, 21 bp, Artificial Sequence
  Synthetic
gcgcatggtcattatatgcat

SEQ ID NO: 26073 - DNA, 21 bp, Artificial Sequence
  Synthetic
cgtggtatggaggggcctcgg

SEQ ID NO: 26074 - DNA, 21 bp, Artificial Sequence
  Synthetic
tggcgggatggtgggtcgtcg

SEQ ID NO: 26075 - DNA, 21 bp, Artificial Sequence
  Synthetic
tggagtcttccttctgggggg

SEQ ID NO: 26076 - DNA, 21 bp, Artificial Sequence
  Synthetic
ggggttatggatagtaggtgg

SEQ ID NO: 26077 - DNA, 21 bp, Artificial Sequence
  Synthetic
cgtatttggggtagtcctgag

SEQ ID NO: 26078 - DNA, 21 bp, Artificial Sequence
  Synthetic
tcgccggggtatcctttgtat

SEQ ID NO: 26079 - DNA, 21 bp, Artificial Sequence
  Synthetic
atgtttcttgctatgagtagt

SEQ ID NO: 26080 - DNA, 21 bp, Artificial Sequence
  Synthetic
cttgtgaagggttggtcggtg

SEQ ID NO: 26081 - DNA, 21 bp, Artificial Sequence
  Synthetic
ttgagggaggtttggtctagt

SEQ ID NO: 26082 - DNA, 21 bp, Artificial Sequence
  Synthetic
cctgggcttggtactgtttat

SEQ ID NO: 26083 - DNA, 21 bp, Artificial Sequence
  Synthetic
tcttttaatcttcgtgagacg

SEQ ID NO: 26084 - DNA, 21 bp, Artificial Sequence
  Synthetic
atgtgggttccgggtagtagt

SEQ ID NO: 26085 - DNA, 21 bp, Artificial Sequence
  Synthetic
ttggtttggggtgaggtggtt

SEQ ID NO: 26086 - DNA, 21 bp, Artificial Sequence
  Synthetic
tggggtttgctgcctacgaag

SEQ ID NO: 26087 - DNA, 21 bp, Artificial Sequence
  Synthetic
atgtgggctggttctagtacg

SEQ ID NO: 26088 - DNA, 21 bp, Artificial Sequence
  Synthetic
tgggagagtaagttgacgcgt

SEQ ID NO: 26089 - DNA, 21 bp, Artificial Sequence
  Synthetic
acgcatgatagtcggcctagg

SEQ ID NO: 26090 - DNA, 21 bp, Artificial Sequence
  Synthetic
gaggcgcggtggggtgcggcg

SEQ ID NO: 26091 - DNA, 21 bp, Artificial Sequence
  Synthetic
tttcgtttgcgggagatgggg

SEQ ID NO: 26092 - DNA, 21 bp, Artificial Sequence
  Synthetic
catatggttgggtcggcgtgg

SEQ ID NO: 26093 - DNA, 21 bp, Artificial Sequence
  Synthetic
gagaatagtcattggagtagt

SEQ ID NO: 26094 - DNA, 21 bp, Artificial Sequence
  Synthetic
atgatggttgggtttagttcg

SEQ ID NO: 26095 - DNA, 21 bp, Artificial Sequence
  Synthetic
catgggatgctgattcagttg

SEQ ID NO: 26096 - DNA, 21 bp, Artificial Sequence
  Synthetic
cgggttatgtatgagattgcg

SEQ ID NO: 26097 - DNA, 21 bp, Artificial Sequence
  Synthetic
gtttatttgggtggtagttcg

SEQ ID NO: 26098 - DNA, 21 bp, Artificial Sequence
  Synthetic
catatggttggttggagtagt

SEQ ID NO: 26099 - DNA, 21 bp, Artificial Sequence
  Synthetic
cttcatcatgcttgggctagt

SEQ ID NO: 26100 - DNA, 21 bp, Artificial Sequence
  Synthetic
atgctgcgtgggctggcgcag

SEQ ID NO: 26101 - DNA, 21 bp, Artificial Sequence
  Synthetic
tatcctcagtgggatcgtgcg

SEQ ID NO: 26102 - DNA, 21 bp, Artificial Sequence
  Synthetic
catttgcgtacttggagtgat

SEQ ID NO: 26103 - DNA, 21 bp, Artificial Sequence
  Synthetic
cctcggctgcatttgtctgct

SEQ ID NO: 26104 - DNA, 21 bp, Artificial Sequence
  Synthetic
atggtggctcgtgaggggcgt

SEQ ID NO: 26105 - DNA, 21 bp, Artificial Sequence
  Synthetic
cgttctgaggttagtggtaag

SEQ ID NO: 26106 - DNA, 21 bp, Artificial Sequence
  Synthetic
gctgcgcggaattttgatcgg

SEQ ID NO: 26107 - DNA, 21 bp, Artificial Sequence
  Synthetic
aataatgctccggctgttcgt

SEQ ID NO: 26108 - DNA, 21 bp, Artificial Sequence
  Synthetic
gatcggaagcatgttgagtgg

SEQ ID NO: 26109 - DNA, 21 bp, Artificial Sequence
  Synthetic
tttggtggtgcgactcctcgt

SEQ ID NO: 26110 - DNA, 21 bp, Artificial Sequence
  Synthetic
cataagccttctactctgtcg

SEQ ID NO: 26111 - DNA, 21 bp, Artificial Sequence
  Synthetic
tttcaggggccggttgtgcgg

SEQ ID NO: 26112 - DNA, 21 bp, Artificial Sequence
  Synthetic
tgggtgcatggttattctcag

SEQ ID NO: 26113 - DNA, 21 bp, Artificial Sequence
  Synthetic
tggacggttcagaatggtcat

SEQ ID NO: 26114 - DNA, 21 bp, Artificial Sequence
  Synthetic
gttcggtggaggccggaggag

SEQ ID NO: 26115 - DNA, 21 bp, Artificial Sequence
  Synthetic
ttgttgcctgttatgcatcgt

SEQ ID NO: 26116 - DNA, 21 bp, Artificial Sequence
  Synthetic
acggtttcttggccgaagtct

SEQ ID NO: 26117 - DNA, 21 bp, Artificial Sequence
  Synthetic
tatggggttttgtcgcttgtg

SEQ ID NO: 26118 - DNA, 21 bp, Artificial Sequence
  Synthetic
cctttggctcattggtctgcg

SEQ ID NO: 26119 - DNA, 21 bp, Artificial Sequence
  Synthetic
cttcagttgcgtgggagtacg

SEQ ID NO: 26120 - DNA, 21 bp, Artificial Sequence
  Synthetic
aattttgatctgaggtatcat

SEQ ID NO: 26121 - DNA, 21 bp, Artificial Sequence
  Synthetic
tatggttcgctgtcgagtttt

SEQ ID NO: 26122 - DNA, 21 bp, Artificial Sequence
  Synthetic
gaggttgctcattggagtagt

SEQ ID NO: 26123 - DNA, 21 bp, Artificial Sequence
  Synthetic
gcgtatgcgtttcattctagt

SEQ ID NO: 26124 - DNA, 21 bp, Artificial Sequence
  Synthetic
ttttatttgcctgggggggat

SEQ ID NO: 26125 - DNA, 21 bp, Artificial Sequence
  Synthetic
gatggtaggtttatggcgtcg

SEQ ID NO: 26126 - DNA, 21 bp, Artificial Sequence
  Synthetic
gtttggccgggtgatcggagt

SEQ ID NO: 26127 - DNA, 21 bp, Artificial Sequence
  Synthetic
tatgttagttatcctgatcgg

SEQ ID NO: 26128 - DNA, 21 bp, Artificial Sequence
  Synthetic
ttgcgttatgagggttcgatg

SEQ ID NO: 26129 - DNA, 21 bp, Artificial Sequence
  Synthetic
cagaagtttaatggtagtatg

SEQ ID NO: 26130 - DNA, 21 bp, Artificial Sequence
  Synthetic
ccgtatgggggttctgcgtgg

SEQ ID NO: 26131 - DNA, 21 bp, Artificial Sequence
  Synthetic
cttaggcgtgaggggggtgcg

SEQ ID NO: 26132 - DNA, 21 bp, Artificial Sequence
  Synthetic
gttgatagggggtattctgtg

SEQ ID NO: 26133 - DNA, 21 bp, Artificial Sequence
  Synthetic
cattggcggagtgatactcag

SEQ ID NO: 26134 - DNA, 21 bp, Artificial Sequence
  Synthetic
cgtaatcggtcttgggatgat

SEQ ID NO: 26135 - DNA, 21 bp, Artificial Sequence
  Synthetic
gcttggactgggtatgcggct

SEQ ID NO: 26136 - DNA, 21 bp, Artificial Sequence
  Synthetic
cctctgaataatgggatttgg

SEQ ID NO: 26137 - DNA, 21 bp, Artificial Sequence
  Synthetic
attgtgtatgggggttcttct

SEQ ID NO: 26138 - DNA, 21 bp, Artificial Sequence
  Synthetic
ttgttgccgcgtgaggggagg

SEQ ID NO: 26139 - DNA, 21 bp, Artificial Sequence
  Synthetic
tggactactgggacggggttt

SEQ ID NO: 26140 - DNA, 21 bp, Artificial Sequence
  Synthetic
tctaagtggcatatgcaggag

SEQ ID NO: 26141 - DNA, 21 bp, Artificial Sequence
  Synthetic
tttgagtttaggggttcgacg

SEQ ID NO: 26142 - DNA, 21 bp, Artificial Sequence
  Synthetic
gctagggttattatgaataat

SEQ ID NO: 26143 - DNA, 21 bp, Artificial Sequence
  Synthetic
gagcgtgtgtatgggtctcat

SEQ ID NO: 26144 - DNA, 21 bp, Artificial Sequence
  Synthetic
gatgttcgttggggggctagt

SEQ ID NO: 26145 - DNA, 21 bp, Artificial Sequence
  Synthetic
gcgccgaatagtggggtgtgg

SEQ ID NO: 26146 - DNA, 21 bp, Artificial Sequence
  Synthetic
ttgtttttgcatgggagtgtg

SEQ ID NO: 26147 - DNA, 21 bp, Artificial Sequence
  Synthetic
agttttgcgggtagtagtagt

SEQ ID NO: 26148 - DNA, 21 bp, Artificial Sequence
  Synthetic
ttttgggaggggtttagtgct

SEQ ID NO: 26149 - DNA, 21 bp, Artificial Sequence
  Synthetic
aaggatgtgtatgcttcgtgg

SEQ ID NO: 26150 - DNA, 21 bp, Artificial Sequence
  Synthetic
tatcggaattctgagaagcct

SEQ ID NO: 26151 - DNA, 21 bp, Artificial Sequence
  Synthetic
ttgtatcagcattcgaatttt

SEQ ID NO: 26152 - DNA, 21 bp, Artificial Sequence
  Synthetic
caggatgtgccgggtcgttgg

SEQ ID NO: 26153 - DNA, 21 bp, Artificial Sequence
  Synthetic
gctgctcatagtggtctgtgg

SEQ ID NO: 26154 - DNA, 21 bp, Artificial Sequence
  Synthetic
gtgagtccgatgtcgcattgg

SEQ ID NO: 26155 - DNA, 21 bp, Artificial Sequence
  Synthetic
gcttatcatggtggttcgacg

SEQ ID NO: 26156 - DNA, 21 bp, Artificial Sequence
  Synthetic
attcggcatatgggttcgagt

SEQ ID NO: 26157 - DNA, 21 bp, Artificial Sequence
  Synthetic
gcttttgataggtatttgact

SEQ ID NO: 26158 - DNA, 21 bp, Artificial Sequence
  Synthetic
agtaggacgcattttagtgcg

SEQ ID NO: 26159 - DNA, 21 bp, Artificial Sequence
  Synthetic
catgaggtgtgggggagtagt

SEQ ID NO: 26160 - DNA, 21 bp, Artificial Sequence
  Synthetic
gaggtgtggttgcattcgagt

SEQ ID NO: 26161 - DNA, 21 bp, Artificial Sequence
  Synthetic
gcgtcgcagtttgatttgagg

SEQ ID NO: 26162 - DNA, 21 bp, Artificial Sequence
  Synthetic
aatatttcgtgggggagtagt

SEQ ID NO: 26163 - DNA, 21 bp, Artificial Sequence
  Synthetic
cagcggattacgttgtttaat

SEQ ID NO: 26164 - DNA, 21 bp, Artificial Sequence
  Synthetic
tggagggagggtggtgctcag

SEQ ID NO: 26165 - DNA, 21 bp, Artificial Sequence
  Synthetic
gagagtccttcggctcgttat

SEQ ID NO: 26166 - DNA, 21 bp, Artificial Sequence
  Synthetic
gattatccgggttggcaggct

SEQ ID NO: 26167 - DNA, 21 bp, Artificial Sequence
  Synthetic
gatcttcgttggggttctgct

SEQ ID NO: 26168 - DNA, 21 bp, Artificial Sequence
  Synthetic
gagcctaagaatgttgctcgg

SEQ ID NO: 26169 - DNA, 21 bp, Artificial Sequence
  Synthetic
ctgagggggtttgggagttcg

SEQ ID NO: 26170 - DNA, 21 bp, Artificial Sequence
  Synthetic
aataattatggttattcttcg

SEQ ID NO: 26171 - DNA, 21 bp, Artificial Sequence
  Synthetic
gagatgcttgggtttagtagt

SEQ ID NO: 26172 - DNA, 21 bp, Artificial Sequence
  Synthetic
cggggttctgttcatgattgg

SEQ ID NO: 26173 - DNA, 21 bp, Artificial Sequence
  Synthetic
ggttcgccgccttggagtcat

SEQ ID NO: 26174 - DNA, 21 bp, Artificial Sequence
  Synthetic
ggttcgatgggttggtcgtct

SEQ ID NO: 26175 - DNA, 21 bp, Artificial Sequence
  Synthetic
gatccttatacgcttagttat

SEQ ID NO: 26176 - DNA, 21 bp, Artificial Sequence
  Synthetic
ccgtttgctgggtatgcgtcg

SEQ ID NO: 26177 - DNA, 21 bp, Artificial Sequence
  Synthetic
ctgaggattggtgaggcgcag

SEQ ID NO: 26178 - DNA, 21 bp, Artificial Sequence
  Synthetic
aggtttgagcttgattctgct

SEQ ID NO: 26179 - DNA, 21 bp, Artificial Sequence
  Synthetic
cggtatcctgctgatgctatt

SEQ ID NO: 26180 - DNA, 21 bp, Artificial Sequence
  Synthetic
gcgaggatgcagagggatgcg

SEQ ID NO: 26181 - DNA, 21 bp, Artificial Sequence
  Synthetic
aggaatacgactatggatagg

SEQ ID NO: 26182 - DNA, 21 bp, Artificial Sequence
  Synthetic
cgggcgtcgtatggtagtgct

SEQ ID NO: 26183 - DNA, 21 bp, Artificial Sequence
  Synthetic
tgtattacgctgggttctgcg

SEQ ID NO: 26184 - DNA, 21 bp, Artificial Sequence
  Synthetic
agtgagaggtatcagggttgg

SEQ ID NO: 26185 - DNA, 21 bp, Artificial Sequence
  Synthetic
ttgcatacgtggcagtcgcag

SEQ ID NO: 26186 - DNA, 21 bp, Artificial Sequence
  Synthetic
ttggcttatgagggttttagg

SEQ ID NO: 26187 - DNA, 21 bp, Artificial Sequence
  Synthetic
cttactgtgcggtatggtttg

SEQ ID NO: 26188 - DNA, 21 bp, Artificial Sequence
  Synthetic
aggtatccgcatgatgcgagt

SEQ ID NO: 26189 - DNA, 21 bp, Artificial Sequence
  Synthetic
gtgatgattggtcgtgcgggg

SEQ ID NO: 26190 - DNA, 21 bp, Artificial Sequence
  Synthetic
cgttctgagtatatgactttt

SEQ ID NO: 26191 - DNA, 21 bp, Artificial Sequence
  Synthetic
gtgttgatgtttactcatggg

SEQ ID NO: 26192 - DNA, 21 bp, Artificial Sequence
  Synthetic
cggtggactgctgatcagact

SEQ ID NO: 26193 - DNA, 21 bp, Artificial Sequence
  Synthetic
cttacggcgattcgtagtatt

SEQ ID NO: 26194 - DNA, 21 bp, Artificial Sequence
  Synthetic
gcgagttcttctgcttattgg

SEQ ID NO: 26195 - DNA, 21 bp, Artificial Sequence
  Synthetic
atgtttgttgggtttgctagt

SEQ ID NO: 26196 - DNA, 21 bp, Artificial Sequence
  Synthetic
attgtgaaggggtattcgtct

SEQ ID NO: 26197 - DNA, 21 bp, Artificial Sequence
  Synthetic
atttcttcgggttatgctcag

SEQ ID NO: 26198 - DNA, 21 bp, Artificial Sequence
  Synthetic
ggtacttttaattgggctgcg

SEQ ID NO: 26199 - DNA, 21 bp, Artificial Sequence
  Synthetic
agtccgtcgtatcgtgctgat

SEQ ID NO: 26200 - DNA, 21 bp, Artificial Sequence
  Synthetic
atggttgctctggggagtagt

SEQ ID NO: 26201 - DNA, 21 bp, Artificial Sequence
  Synthetic
aatgaggctctgctgccgtat

SEQ ID NO: 26202 - DNA, 21 bp, Artificial Sequence
  Synthetic
cctgctattcgtcttttgaat

SEQ ID NO: 26203 - DNA, 21 bp, Artificial Sequence
  Synthetic
tctcgggagacggagtattgg

SEQ ID NO: 26204 - DNA, 21 bp, Artificial Sequence
  Synthetic
actgatcttactgggcgttgg

SEQ ID NO: 26205 - DNA, 21 bp, Artificial Sequence
  Synthetic
gttgagtatcggcttcctttg

SEQ ID NO: 26206 - DNA, 21 bp, Artificial Sequence
  Synthetic
attgagtggaagattgggaat

SEQ ID NO: 26207 - DNA, 21 bp, Artificial Sequence
  Synthetic
gagcgtgggggttggtcggct

SEQ ID NO: 26208 - DNA, 21 bp, Artificial Sequence
  Synthetic
ggtcagcagccgggtgtgtgg

SEQ ID NO: 26209 - DNA, 21 bp, Artificial Sequence
  Synthetic
gatgcgtatcggcttcctcat

SEQ ID NO: 26210 - DNA, 21 bp, Artificial Sequence
  Synthetic
ctggtggcgcatgggtctact

SEQ ID NO: 26211 - DNA, 21 bp, Artificial Sequence
  Synthetic
atggtttggcagggtagtgtt

SEQ ID NO: 26212 - DNA, 21 bp, Artificial Sequence
  Synthetic
gatcggagggatgttcattgg

SEQ ID NO: 26213 - DNA, 21 bp, Artificial Sequence
  Synthetic
ggtcctcagtggactgcttcg

SEQ ID NO: 26214 - DNA, 21 bp, Artificial Sequence
  Synthetic
gtgagggatatggcgttgcgg

SEQ ID NO: 26215 - DNA, 21 bp, Artificial Sequence
  Synthetic
gtgggttttgggtattcgatg

SEQ ID NO: 26216 - DNA, 21 bp, Artificial Sequence
  Synthetic
ttgattgagaggggttctagt

SEQ ID NO: 26217 - DNA, 21 bp, Artificial Sequence
  Synthetic
cctgttcatcgttcttatggg

SEQ ID NO: 26218 - DNA, 21 bp, Artificial Sequence
  Synthetic
ttgtttgctcatgggtcggct

SEQ ID NO: 26219 - DNA, 21 bp, Artificial Sequence
  Synthetic
cgtgcttggtctcctgatggt

SEQ ID NO: 26220 - DNA, 21 bp, Artificial Sequence
  Synthetic
aagtggccgggtagtgcgatg

SEQ ID NO: 26221 - DNA, 21 bp, Artificial Sequence
  Synthetic
cgtctggattatcagtcgtgg

SEQ ID NO: 26222 - DNA, 21 bp, Artificial Sequence
  Synthetic
ttgggtgcggtgggtccgtgg

SEQ ID NO: 26223 - DNA, 21 bp, Artificial Sequence
  Synthetic
agggaggatcgtatgtgggtg

SEQ ID NO: 26224 - DNA, 21 bp, Artificial Sequence
  Synthetic
gagaagggttatgtgggttgg

SEQ ID NO: 26225 - DNA, 21 bp, Artificial Sequence
  Synthetic
cgtgggaatccggggcatggg

SEQ ID NO: 26226 - DNA, 21 bp, Artificial Sequence
  Synthetic
aagcctcgtcttgttgagact

SEQ ID NO: 26227 - DNA, 21 bp, Artificial Sequence
  Synthetic
tgggttgcgctgccgcattct

SEQ ID NO: 26228 - DNA, 21 bp, Artificial Sequence
  Synthetic
gggaggattgtgctgcatgtg

SEQ ID NO: 26229 - DNA, 21 bp, Artificial Sequence
  Synthetic
atgtggcctggttctagtgtt

SEQ ID NO: 26230 - DNA, 21 bp, Artificial Sequence
  Synthetic
ctgattgagtttggtagtgcg

SEQ ID NO: 26231 - DNA, 21 bp, Artificial Sequence
  Synthetic
gggtatccggggagttctacg

SEQ ID NO: 26232 - DNA, 21 bp, Artificial Sequence
  Synthetic
ttgtttcatgggtatcagcag

SEQ ID NO: 26233 - DNA, 21 bp, Artificial Sequence
  Synthetic
aagtgggtgagtggtaaggat

SEQ ID NO: 26234 - DNA, 21 bp, Artificial Sequence
  Synthetic
tttttgagggatgctgtgcct

SEQ ID NO: 26235 - DNA, 21 bp, Artificial Sequence
  Synthetic
gtgcagtggacggagtttcat

SEQ ID NO: 26236 - DNA, 21 bp, Artificial Sequence
  Synthetic
tcggtgccttatagttctagt

SEQ ID NO: 26237 - DNA, 21 bp, Artificial Sequence
  Synthetic
agttcgcatctgttgccgtat

SEQ ID NO: 26238 - DNA, 21 bp, Artificial Sequence
  Synthetic
attaagtgggagggtagtagt

SEQ ID NO: 26239 - DNA, 21 bp, Artificial Sequence
  Synthetic
tttgagtggatgggtgctgcg

SEQ ID NO: 26240 - DNA, 21 bp, Artificial Sequence
  Synthetic
ttttttttgggtggtagtcag

SEQ ID NO: 26241 - DNA, 21 bp, Artificial Sequence
  Synthetic
tctattacgcatggttctagt

SEQ ID NO: 26242 - DNA, 21 bp, Artificial Sequence
  Synthetic
acttggtatgatggggcttct

SEQ ID NO: 26243 - DNA, 21 bp, Artificial Sequence
  Synthetic
ccttatgcggggtttgcgtct

SEQ ID NO: 26244 - DNA, 21 bp, Artificial Sequence
  Synthetic
gggaatcctgggtggtctcag

SEQ ID NO: 26245 - DNA, 21 bp, Artificial Sequence
  Synthetic
ccttatacgaatgctgctcgg

SEQ ID NO: 26246 - DNA, 21 bp, Artificial Sequence
  Synthetic
catgggactcggcctaatact

SEQ ID NO: 26247 - DNA, 21 bp, Artificial Sequence
  Synthetic
gggtttagttcggggtcgtgg

SEQ ID NO: 26248 - DNA, 21 bp, Artificial Sequence
  Synthetic
cttcagtatatgttgtcttct

SEQ ID NO: 26249 - DNA, 21 bp, Artificial Sequence
  Synthetic
ccttctcagtttgatcttagg

SEQ ID NO: 26250 - DNA, 21 bp, Artificial Sequence
  Synthetic
ggtgtgcatgtggggttgtgg

SEQ ID NO: 26251 - DNA, 21 bp, Artificial Sequence
  Synthetic
cgggcgtttgatcttcggccg

SEQ ID NO: 26252 - DNA, 21 bp, Artificial Sequence
  Synthetic
agttgggctggttctagtact

SEQ ID NO: 26253 - DNA, 21 bp, Artificial Sequence
  Synthetic
tggggtcttgtgccggggcat

SEQ ID NO: 26254 - DNA, 21 bp, Artificial Sequence
  Synthetic
tctgttccgggtatgtcgagt

SEQ ID NO: 26255 - DNA, 21 bp, Artificial Sequence
  Synthetic
gtgctgaggctgatgagtctt

SEQ ID NO: 26256 - DNA, 21 bp, Artificial Sequence
  Synthetic
ccgcctttgactcatgggtgg

SEQ ID NO: 26257 - DNA, 21 bp, Artificial Sequence
  Synthetic
gttggtggtcctggtatttgg

SEQ ID NO: 26258 - DNA, 21 bp, Artificial Sequence
  Synthetic
ggtagttggcatggtcctggg

SEQ ID NO: 26259 - DNA, 21 bp, Artificial Sequence
  Synthetic
aataggaatgttgggtttgcg

SEQ ID NO: 26260 - DNA, 21 bp, Artificial Sequence
  Synthetic
actgcgggtgaggggaggtgg

SEQ ID NO: 26261 - DNA, 21 bp, Artificial Sequence
  Synthetic
cctaatcctactgggcgttat

SEQ ID NO: 26262 - DNA, 21 bp, Artificial Sequence
  Synthetic
ttggtgggtagggctatgggt

SEQ ID NO: 26263 - DNA, 21 bp, Artificial Sequence
  Synthetic
tttgctcatggttattcttcg

SEQ ID NO: 26264 - DNA, 21 bp, Artificial Sequence
  Synthetic
ctgggtagtctggagcgtttt

SEQ ID NO: 26265 - DNA, 21 bp, Artificial Sequence
  Synthetic
gtgagggattatgcgagttgg

SEQ ID NO: 26266 - DNA, 21 bp, Artificial Sequence
  Synthetic
gtggcgcagggttggagtcag

SEQ ID NO: 26267 - DNA, 21 bp, Artificial Sequence
  Synthetic
cggtttatgccggatgctgct

SEQ ID NO: 26268 - DNA, 21 bp, Artificial Sequence
  Synthetic
cctcaggttgtgatggctcct

SEQ ID NO: 26269 - DNA, 21 bp, Artificial Sequence
  Synthetic
ggttctgatggggcgcgtttt

SEQ ID NO: 26270 - DNA, 21 bp, Artificial Sequence
  Synthetic
atgcgttgtgggcagatgtgt

SEQ ID NO: 26271 - DNA, 21 bp, Artificial Sequence
  Synthetic
cggtctgggacgccggagcgt

SEQ ID NO: 26272 - DNA, 21 bp, Artificial Sequence
  Synthetic
aatcataatactagtctgcgt

SEQ ID NO: 26273 - DNA, 21 bp, Artificial Sequence
  Synthetic
gcgagggattggtcgtatggg

SEQ ID NO: 26274 - DNA, 21 bp, Artificial Sequence
  Synthetic
ccgggttcttatatgtctagt

SEQ ID NO: 26275 - DNA, 21 bp, Artificial Sequence
  Synthetic
gctaaggttgttgcgggttgg

SEQ ID NO: 26276 - DNA, 21 bp, Artificial Sequence
  Synthetic
cgtgttcatccgaatagggag

SEQ ID NO: 26277 - DNA, 21 bp, Artificial Sequence
  Synthetic
aggtctgagaatcgtgttaat

SEQ ID NO: 26278 - DNA, 21 bp, Artificial Sequence
  Synthetic
ggtcctgctcatgtggggagg

SEQ ID NO: 26279 - DNA, 21 bp, Artificial Sequence
  Synthetic
tggactttgccgactgggcat

SEQ ID NO: 26280 - DNA, 21 bp, Artificial Sequence
  Synthetic
tggtcgcagtttggtccgggg

SEQ ID NO: 26281 - DNA, 21 bp, Artificial Sequence
  Synthetic
ggtgttcatatggcgatttat

SEQ ID NO: 26282 - DNA, 21 bp, Artificial Sequence
  Synthetic
ggtaatgattataatcgttgg

SEQ ID NO: 26283 - DNA, 21 bp, Artificial Sequence
  Synthetic
gagaggccttatatgagtgcg

SEQ ID NO: 26284 - DNA, 21 bp, Artificial Sequence
  Synthetic
gataatagggcgtggggggct

SEQ ID NO: 26285 - DNA, 21 bp, Artificial Sequence
  Synthetic
ggggagccgcatgggcggtgg

SEQ ID NO: 26286 - DNA, 21 bp, Artificial Sequence
  Synthetic
actctgttgcgtttgcctaat

SEQ ID NO: 26287 - DNA, 21 bp, Artificial Sequence
  Synthetic
actagggagtggggtgcgcag

SEQ ID NO: 26288 - DNA, 21 bp, Artificial Sequence
  Synthetic
gcgtggcatcagggtagtgcg

SEQ ID NO: 26289 - DNA, 21 bp, Artificial Sequence
  Synthetic
aggtttattggttcttcggcg

SEQ ID NO: 26290 - DNA, 21 bp, Artificial Sequence
  Synthetic
gggaaggatgttggtcgttgg

SEQ ID NO: 26291 - DNA, 21 bp, Artificial Sequence
  Synthetic
ctttatctgggtgggagtagt

SEQ ID NO: 26292 - DNA, 21 bp, Artificial Sequence
  Synthetic
cagtcgtttgggtattctagt

SEQ ID NO: 26293 - DNA, 21 bp, Artificial Sequence
  Synthetic
ggtctgtctcgtggggatctt

SEQ ID NO: 26294 - DNA, 21 bp, Artificial Sequence
  Synthetic
ccgggtattgggtatagttcg

SEQ ID NO: 26295 - DNA, 21 bp, Artificial Sequence
  Synthetic
gatgttactaggatgtgggtg

SEQ ID NO: 26296 - DNA, 21 bp, Artificial Sequence
  Synthetic
tgggctgctggttataatcat

SEQ ID NO: 26297 - DNA, 21 bp, Artificial Sequence
  Synthetic
cttggtcctggttttgggagg

SEQ ID NO: 26298 - DNA, 21 bp, Artificial Sequence
  Synthetic
cctgctccgggtattgggtgg

SEQ ID NO: 26299 - DNA, 21 bp, Artificial Sequence
  Synthetic
ttgaatcctgttgctttgtgg

SEQ ID NO: 26300 - DNA, 21 bp, Artificial Sequence
  Synthetic
tggagtgtgggtgggagtagt

SEQ ID NO: 26301 - DNA, 21 bp, Artificial Sequence
  Synthetic
atgaatatgttgaatccgagg

SEQ ID NO: 26302 - DNA, 21 bp, Artificial Sequence
  Synthetic
aagagtttggggcagcataat

SEQ ID NO: 26303 - DNA, 21 bp, Artificial Sequence
  Synthetic
gggccggagcgtcatcggatt

SEQ ID NO: 26304 - DNA, 21 bp, Artificial Sequence
  Synthetic
cgtacgcatgggcctcttatg

SEQ ID NO: 26305 - DNA, 21 bp, Artificial Sequence
  Synthetic
ggtcgtgatgctgcgaggtat

SEQ ID NO: 26306 - DNA, 21 bp, Artificial Sequence
  Synthetic
tggtcggcgggtactgggtat

SEQ ID NO: 26307 - DNA, 21 bp, Artificial Sequence
  Synthetic
tatgcgatttatgggtcgggg

SEQ ID NO: 26308 - DNA, 21 bp, Artificial Sequence
  Synthetic
cttgggttttctatgagtcag

SEQ ID NO: 26309 - DNA, 21 bp, Artificial Sequence
  Synthetic
cgggtgcctgggcatgtggtg

SEQ ID NO: 26310 - DNA, 21 bp, Artificial Sequence
  Synthetic
gcttggggtaagattggtggt

SEQ ID NO: 26311 - DNA, 21 bp, Artificial Sequence
  Synthetic
gtgtggattccggcggcgagt

SEQ ID NO: 26312 - DNA, 21 bp, Artificial Sequence
  Synthetic
cttcatattggtatgggttat

SEQ ID NO: 26313 - DNA, 21 bp, Artificial Sequence
  Synthetic
agttataattttagggttgag

SEQ ID NO: 26314 - DNA, 21 bp, Artificial Sequence
  Synthetic
aagtatttggggggggcgagt

SEQ ID NO: 26315 - DNA, 21 bp, Artificial Sequence
  Synthetic
gcggatagttatgctcattgg

SEQ ID NO: 26316 - DNA, 21 bp, Artificial Sequence
  Synthetic
attggtcctggttggtctatg

SEQ ID NO: 26317 - DNA, 21 bp, Artificial Sequence
  Synthetic
ttgagttctctgttttcgtct

SEQ ID NO: 26318 - DNA, 21 bp, Artificial Sequence
  Synthetic
ctgcgggagcagggtttttgg

SEQ ID NO: 26319 - DNA, 21 bp, Artificial Sequence
  Synthetic
tttgtttttggtacggaggtt

SEQ ID NO: 26320 - DNA, 21 bp, Artificial Sequence
  Synthetic
acttggaatagtttgggggcg

SEQ ID NO: 26321 - DNA, 21 bp, Artificial Sequence
  Synthetic
tgggggacgtatccgtctttt

SEQ ID NO: 26322 - DNA, 21 bp, Artificial Sequence
  Synthetic
tggggtagtcttcctgtgaat

SEQ ID NO: 26323 - DNA, 21 bp, Artificial Sequence
  Synthetic
tggggtagtttggctcagatt

SEQ ID NO: 26324 - DNA, 21 bp, Artificial Sequence
  Synthetic
tgggctagtttgggtagtgcg

SEQ ID NO: 26325 - DNA, 21 bp, Artificial Sequence
  Synthetic
gagaagaatccgggtcgttgg

SEQ ID NO: 26326 - DNA, 21 bp, Artificial Sequence
  Synthetic
gggagtacgcctggtgtttgg

SEQ ID NO: 26327 - DNA, 21 bp, Artificial Sequence
  Synthetic
tttaatacgggttgggcgtcg

SEQ ID NO: 26328 - DNA, 21 bp, Artificial Sequence
  Synthetic
ggttatacgagggagcattgg

SEQ ID NO: 26329 - DNA, 21 bp, Artificial Sequence
  Synthetic
ccggtgacgcggacttcgtgg

SEQ ID NO: 26330 - DNA, 21 bp, Artificial Sequence
  Synthetic
acgagggctatgccggagagg

SEQ ID NO: 26331 - DNA, 21 bp, Artificial Sequence
  Synthetic
catcttgggcgtgggagggag

SEQ ID NO: 26332 - DNA, 21 bp, Artificial Sequence
  Synthetic
tggtcgattatggaggggcat

SEQ ID NO: 26333 - DNA, 21 bp, Artificial Sequence
  Synthetic
tttgggcatactcgttgggag

SEQ ID NO: 26334 - DNA, 21 bp, Artificial Sequence
  Synthetic
cggccgcagcatggtccgaat

SEQ ID NO: 26335 - DNA, 21 bp, Artificial Sequence
  Synthetic
ggttggcctggtcaggcgagt

SEQ ID NO: 26336 - DNA, 21 bp, Artificial Sequence
  Synthetic
tcttgggattttaattcgggt

SEQ ID NO: 26337 - DNA, 21 bp, Artificial Sequence
  Synthetic
actacttgggggggtagtacg

SEQ ID NO: 26338 - DNA, 21 bp, Artificial Sequence
  Synthetic
aatgggttgccttgggcgcat

SEQ ID NO: 26339 - DNA, 21 bp, Artificial Sequence
  Synthetic
cttcttcttaggcctacgctt

SEQ ID NO: 26340 - DNA, 21 bp, Artificial Sequence
  Synthetic
gtgaagattggttggtcgacg

SEQ ID NO: 26341 - DNA, 21 bp, Artificial Sequence
  Synthetic
actgttaggctgggttctacg

SEQ ID NO: 26342 - DNA, 21 bp, Artificial Sequence
  Synthetic
cctattacttcgcctatgtgg

SEQ ID NO: 26343 - DNA, 21 bp, Artificial Sequence
  Synthetic
aggaatacgacggaggctcgt

SEQ ID NO: 26344 - DNA, 21 bp, Artificial Sequence
  Synthetic
agttatgatcttcgtcatccg

SEQ ID NO: 26345 - DNA, 21 bp, Artificial Sequence
  Synthetic
atggttatgcgggggtcggcg

SEQ ID NO: 26346 - DNA, 21 bp, Artificial Sequence
  Synthetic
gcggggcctgttaggttttcg

SEQ ID NO: 26347 - DNA, 21 bp, Artificial Sequence
  Synthetic
acgggtgggtatgggtatcat

SEQ ID NO: 26348 - DNA, 21 bp, Artificial Sequence
  Synthetic
cctaagcagacgggtggttgg

SEQ ID NO: 26349 - DNA, 21 bp, Artificial Sequence
  Synthetic
ctgtatcataatcattctatg

SEQ ID NO: 26350 - DNA, 21 bp, Artificial Sequence
  Synthetic
attccgggtcgtgagtggacg

SEQ ID NO: 26351 - DNA, 21 bp, Artificial Sequence
  Synthetic
gtgcatgggtggaagcatgat

SEQ ID NO: 26352 - DNA, 21 bp, Artificial Sequence
  Synthetic
tcttatttgcttggggcgagt

SEQ ID NO: 26353 - DNA, 21 bp, Artificial Sequence
  Synthetic
aatcatatttcgttgcgggat

SEQ ID NO: 26354 - DNA, 21 bp, Artificial Sequence
  Synthetic
cagcatcagggttggtcttcg

SEQ ID NO: 26355 - DNA, 21 bp, Artificial Sequence
  Synthetic
gaggcgtggcatggttcttcg

SEQ ID NO: 26356 - DNA, 21 bp, Artificial Sequence
  Synthetic
gtgcgtgcgcatgggagttcg

SEQ ID NO: 26357 - DNA, 21 bp, Artificial Sequence
  Synthetic
aatgagcagacgcggtggcag

SEQ ID NO: 26358 - DNA, 21 bp, Artificial Sequence
  Synthetic
tctcatccggggtggtcggcg

SEQ ID NO: 26359 - DNA, 21 bp, Artificial Sequence
  Synthetic
aagtatgttgcggatcggacg

SEQ ID NO: 26360 - DNA, 21 bp, Artificial Sequence
  Synthetic
gaggggtatgggcgtttgaat

SEQ ID NO: 26361 - DNA, 21 bp, Artificial Sequence
  Synthetic
aggtggggggaggattttctg

SEQ ID NO: 26362 - DNA, 21 bp, Artificial Sequence
  Synthetic
cttgagccttggaatcggact

SEQ ID NO: 26363 - DNA, 21 bp, Artificial Sequence
  Synthetic
cctcgggtgattcttagtcct

SEQ ID NO: 26364 - DNA, 21 bp, Artificial Sequence
  Synthetic
agttttttgtatgggagtgtt

SEQ ID NO: 26365 - DNA, 21 bp, Artificial Sequence
  Synthetic
atggttaggttgggtagttcg

SEQ ID NO: 26366 - DNA, 21 bp, Artificial Sequence
  Synthetic
gtgagttatgggatggcgcag

SEQ ID NO: 26367 - DNA, 21 bp, Artificial Sequence
  Synthetic
tggggtctgctgcaggatcgg

SEQ ID NO: 26368 - DNA, 21 bp, Artificial Sequence
  Synthetic
gataatggtggttctcgttgg

SEQ ID NO: 26369 - DNA, 21 bp, Artificial Sequence
  Synthetic
actaggcatcatgatgatagg

SEQ ID NO: 26370 - DNA, 21 bp, Artificial Sequence
  Synthetic
gcttgggatagggggtcgtcg

SEQ ID NO: 26371 - DNA, 21 bp, Artificial Sequence
  Synthetic
catggtgagtatcggcagtgg

SEQ ID NO: 26372 - DNA, 21 bp, Artificial Sequence
  Synthetic
ctgtttcgtgatccggtgcgt

SEQ ID NO: 26373 - DNA, 21 bp, Artificial Sequence
  Synthetic
gttcatagttggtcggctagt

SEQ ID NO: 26374 - DNA, 21 bp, Artificial Sequence
  Synthetic
aggtatgtggggggttctatg

SEQ ID NO: 26375 - DNA, 21 bp, Artificial Sequence
  Synthetic
atgaggcctcttggttcttcg

SEQ ID NO: 26376 - DNA, 21 bp, Artificial Sequence
  Synthetic
agtgagaattctaggtgggcg

SEQ ID NO: 26377 - DNA, 21 bp, Artificial Sequence
  Synthetic
gggcgggcggggaatttgaat

SEQ ID NO: 26378 - DNA, 21 bp, Artificial Sequence
  Synthetic
ggtcgtgatgtgggtgtgtgg

SEQ ID NO: 26379 - DNA, 21 bp, Artificial Sequence
  Synthetic
ggtgggagtggtcggtttttg

SEQ ID NO: 26380 - DNA, 21 bp, Artificial Sequence
  Synthetic
gatgtgaggactccgtttcgg

SEQ ID NO: 26381 - DNA, 21 bp, Artificial Sequence
  Synthetic
gtggctggttctgtgtatctg

SEQ ID NO: 26382 - DNA, 21 bp, Artificial Sequence
  Synthetic
gggtatctgcctcttgggcgt

SEQ ID NO: 26383 - DNA, 21 bp, Artificial Sequence
  Synthetic
cctgctcagtgggcggcgtcg

SEQ ID NO: 26384 - DNA, 21 bp, Artificial Sequence
  Synthetic
tatgttgctttgccggggttg

SEQ ID NO: 26385 - DNA, 21 bp, Artificial Sequence
  Synthetic
gctgagcatcggcatggttgg

SEQ ID NO: 26386 - DNA, 21 bp, Artificial Sequence
  Synthetic
gataatcggccgcctaatagg

SEQ ID NO: 26387 - DNA, 21 bp, Artificial Sequence
  Synthetic
tttgtgagtttgcctcgtctt

SEQ ID NO: 26388 - DNA, 21 bp, Artificial Sequence
  Synthetic
gtgcgtgcgtgggagagtcat

SEQ ID NO: 26389 - DNA, 21 bp, Artificial Sequence
  Synthetic
atgggtgcggggttttcttct

SEQ ID NO: 26390 - DNA, 21 bp, Artificial Sequence
  Synthetic
ccgattgagctgtatggtcgg

SEQ ID NO: 26391 - DNA, 21 bp, Artificial Sequence
  Synthetic
ttggttgagtggggtagtgct

SEQ ID NO: 26392 - DNA, 21 bp, Artificial Sequence
  Synthetic
gggtcgctgccgtggtcttct

SEQ ID NO: 26393 - DNA, 21 bp, Artificial Sequence
  Synthetic
ggtttgggtgctagtcctccg

SEQ ID NO: 26394 - DNA, 21 bp, Artificial Sequence
  Synthetic
aatgagcgtcattgggagcgg

SEQ ID NO: 26395 - DNA, 21 bp, Artificial Sequence
  Synthetic
gctcggcaggagcggttggcg

SEQ ID NO: 26396 - DNA, 21 bp, Artificial Sequence
  Synthetic
ggtattgttgatgtgcggagt

SEQ ID NO: 26397 - DNA, 21 bp, Artificial Sequence
  Synthetic
aagagggatgatggtaagtgg

SEQ ID NO: 26398 - DNA, 21 bp, Artificial Sequence
  Synthetic
cggacggaggagaggcgtgtt

SEQ ID NO: 26399 - DNA, 21 bp, Artificial Sequence
  Synthetic
ggtagtcagggtgggagtcgt

SEQ ID NO: 26400 - DNA, 21 bp, Artificial Sequence
  Synthetic
cgggcttatactgagtcttgg

SEQ ID NO: 26401 - DNA, 21 bp, Artificial Sequence
  Synthetic
ttggctatgggtttttcgact

SEQ ID NO: 26402 - DNA, 21 bp, Artificial Sequence
  Synthetic
gggatgaatagtggtatgtgg

SEQ ID NO: 26403 - DNA, 21 bp, Artificial Sequence
  Synthetic
gtggagtatcggttgccggtt

SEQ ID NO: 26404 - DNA, 21 bp, Artificial Sequence
  Synthetic
ggtgttgcggagggtaggtgg

SEQ ID NO: 26405 - DNA, 21 bp, Artificial Sequence
  Synthetic
cagggtggggctggttttaag

SEQ ID NO: 26406 - DNA, 21 bp, Artificial Sequence
  Synthetic
cggctgccgtatgctaatacg

SEQ ID NO: 26407 - DNA, 21 bp, Artificial Sequence
  Synthetic
gcgctggtttcgtatgcgtat

SEQ ID NO: 26408 - DNA, 21 bp, Artificial Sequence
  Synthetic
tatacggttccgggggggtgg

SEQ ID NO: 26409 - DNA, 21 bp, Artificial Sequence
  Synthetic
tttgagtttaggcttgatcgt

SEQ ID NO: 26410 - DNA, 21 bp, Artificial Sequence
  Synthetic
gcgtcttggggtatgacttcg

SEQ ID NO: 26411 - DNA, 21 bp, Artificial Sequence
  Synthetic
ttggtgattcggcatgcttct

SEQ ID NO: 26412 - DNA, 21 bp, Artificial Sequence
  Synthetic
cgtcatcctggtgagtcttcg

SEQ ID NO: 26413 - DNA, 21 bp, Artificial Sequence
  Synthetic
ggtcttgttgggtgggcgcag

SEQ ID NO: 26414 - DNA, 21 bp, Artificial Sequence
  Synthetic
gatatgtatcggggtgcgagt

SEQ ID NO: 26415 - DNA, 21 bp, Artificial Sequence
  Synthetic
attccttctgaggcgcggtgg

SEQ ID NO: 26416 - DNA, 21 bp, Artificial Sequence
  Synthetic
ggtcgtatgagggaggagtgg

SEQ ID NO: 26417 - DNA, 21 bp, Artificial Sequence
  Synthetic
tctacgggtaatgctatgagg

SEQ ID NO: 26418 - DNA, 21 bp, Artificial Sequence
  Synthetic
gtgtgggataataggctgggg

SEQ ID NO: 26419 - DNA, 21 bp, Artificial Sequence
  Synthetic
tatactgtgactggggggttt

SEQ ID NO: 26420 - DNA, 21 bp, Artificial Sequence
  Synthetic
ccgctgaagcctaatggttgg

SEQ ID NO: 26421 - DNA, 21 bp, Artificial Sequence
  Synthetic
tttcggtctaatggttcgatg

SEQ ID NO: 26422 - DNA, 21 bp, Artificial Sequence
  Synthetic
catacttatcggcttgatatg

SEQ ID NO: 26423 - DNA, 21 bp, Artificial Sequence
  Synthetic
cggctgcgggagatgtctgtg

SEQ ID NO: 26424 - DNA, 21 bp, Artificial Sequence
  Synthetic
gttattagtttttcttttggt

SEQ ID NO: 26425 - DNA, 21 bp, Artificial Sequence
  Synthetic
tatgggaaggggagggagggt

SEQ ID NO: 26426 - DNA, 21 bp, Artificial Sequence
  Synthetic
tatcggagtcttccgggtgtg

SEQ ID NO: 26427 - DNA, 21 bp, Artificial Sequence
  Synthetic
gagaggacgcatggtgcggcg

SEQ ID NO: 26428 - DNA, 21 bp, Artificial Sequence
  Synthetic
cgtggggatttggagcggcgt

SEQ ID NO: 26429 - DNA, 21 bp, Artificial Sequence
  Synthetic
gcgctgggtagttctatttgg

SEQ ID NO: 26430 - DNA, 21 bp, Artificial Sequence
  Synthetic
ttgcagtcttggagtagtcag

SEQ ID NO: 26431 - DNA, 21 bp, Artificial Sequence
  Synthetic
aatcatgagaattttattgag

SEQ ID NO: 26432 - DNA, 21 bp, Artificial Sequence
  Synthetic
gggcttcggagttctgagcgt

SEQ ID NO: 26433 - DNA, 21 bp, Artificial Sequence
  Synthetic
tggtcgaagatggggtctgcg

SEQ ID NO: 26434 - DNA, 21 bp, Artificial Sequence
  Synthetic
tcgcgggcgtatggttcggct

SEQ ID NO: 26435 - DNA, 21 bp, Artificial Sequence
  Synthetic
cttctgcagggtccttgttgt

SEQ ID NO: 26436 - DNA, 21 bp, Artificial Sequence
  Synthetic
gaggttatttatgggtcgtcg

SEQ ID NO: 26437 - DNA, 21 bp, Artificial Sequence
  Synthetic
gatgttcagtggggtagttcg

SEQ ID NO: 26438 - DNA, 21 bp, Artificial Sequence
  Synthetic
ctgctttcgtttgggagttct

SEQ ID NO: 26439 - DNA, 21 bp, Artificial Sequence
  Synthetic
tgggagttgcgtggtagttct

SEQ ID NO: 26440 - DNA, 21 bp, Artificial Sequence
  Synthetic
ctttatgcgggttcggctagt

SEQ ID NO: 26441 - DNA, 21 bp, Artificial Sequence
  Synthetic
gagcgtaagcttatgagtgct

SEQ ID NO: 26442 - DNA, 21 bp, Artificial Sequence
  Synthetic
catgctaaggattctattcgt

SEQ ID NO: 26443 - DNA, 21 bp, Artificial Sequence
  Synthetic
tggggtcttgagggggggtgg

SEQ ID NO: 26444 - DNA, 21 bp, Artificial Sequence
  Synthetic
aagtctttgggtttgtcgcag

SEQ ID NO: 26445 - DNA, 21 bp, Artificial Sequence
  Synthetic
gggccgcatcttggtacgtgg

SEQ ID NO: 26446 - DNA, 21 bp, Artificial Sequence
  Synthetic
cggactgttgttgagggtcgt

SEQ ID NO: 26447 - DNA, 21 bp, Artificial Sequence
  Synthetic
cgtcagcatcatactctgggt

SEQ ID NO: 26448 - DNA, 21 bp, Artificial Sequence
  Synthetic
tggaatgatctgctgggtcgg

SEQ ID NO: 26449 - DNA, 21 bp, Artificial Sequence
  Synthetic
tatggtaggctggagtttatg

SEQ ID NO: 26450 - DNA, 21 bp, Artificial Sequence
  Synthetic
attttggcggggtatcagcag

SEQ ID NO: 26451 - DNA, 21 bp, Artificial Sequence
  Synthetic
ccttttgagtatgcggttgct

SEQ ID NO: 26452 - DNA, 21 bp, Artificial Sequence
  Synthetic
ggggtttcggaggggcggtgg

SEQ ID NO: 26453 - DNA, 21 bp, Artificial Sequence
  Synthetic
gggggtgtggagggtaggtgg

SEQ ID NO: 26454 - DNA, 21 bp, Artificial Sequence
  Synthetic
cttgctgttccgtggtcttct

SEQ ID NO: 26455 - DNA, 21 bp, Artificial Sequence
  Synthetic
gaggttagttgggcggcgtcg

SEQ ID NO: 26456 - DNA, 21 bp, Artificial Sequence
  Synthetic
gattatcgggttttgccttat

SEQ ID NO: 26457 - DNA, 21 bp, Artificial Sequence
  Synthetic
gatattcgttgggtggcgggt

SEQ ID NO: 26458 - DNA, 21 bp, Artificial Sequence
  Synthetic
gctcagtatatgggttcgtcg

SEQ ID NO: 26459 - DNA, 21 bp, Artificial Sequence
  Synthetic
agtgcgagttttggttcttct

SEQ ID NO: 26460 - DNA, 21 bp, Artificial Sequence
  Synthetic
catctgtatggtctttctcag

SEQ ID NO: 26461 - DNA, 21 bp, Artificial Sequence
  Synthetic
cttaggcagatggggtcggcg

SEQ ID NO: 26462 - DNA, 21 bp, Artificial Sequence
  Synthetic
ggtccggattggaatcgtact

SEQ ID NO: 26463 - DNA, 21 bp, Artificial Sequence
  Synthetic
catctgagtagtgggggtcgg

SEQ ID NO: 26464 - DNA, 21 bp, Artificial Sequence
  Synthetic
ggtattcggcatgtggctatt

SEQ ID NO: 26465 - DNA, 21 bp, Artificial Sequence
  Synthetic
tggactctgcaggaggcgtat

SEQ ID NO: 26466 - DNA, 21 bp, Artificial Sequence
  Synthetic
gctgttgttaatacgcatagg

SEQ ID NO: 26467 - DNA, 21 bp, Artificial Sequence
  Synthetic
attacgcgtgctattccgtat

SEQ ID NO: 26468 - DNA, 21 bp, Artificial Sequence
  Synthetic
tcttttgggcatggttttcat

SEQ ID NO: 26469 - DNA, 21 bp, Artificial Sequence
  Synthetic
gatcctggtgatgcgcgttgg

SEQ ID NO: 26470 - DNA, 21 bp, Artificial Sequence
  Synthetic
ggtcatccgattgctgttaag

SEQ ID NO: 26471 - DNA, 21 bp, Artificial Sequence
  Synthetic
catgattataattcgaggttt

SEQ ID NO: 26472 - DNA, 21 bp, Artificial Sequence
  Synthetic
acgcattatggtcagggttgg

SEQ ID NO: 26473 - DNA, 21 bp, Artificial Sequence
  Synthetic
aagacgttgaatgattattgg

SEQ ID NO: 26474 - DNA, 21 bp, Artificial Sequence
  Synthetic
cgttctctggggaatgatagg

SEQ ID NO: 26475 - DNA, 21 bp, Artificial Sequence
  Synthetic
cggattgcgcaggagactcgt

SEQ ID NO: 26476 - DNA, 21 bp, Artificial Sequence
  Synthetic
aggtgggggaatgatgctatt

SEQ ID NO: 26477 - DNA, 21 bp, Artificial Sequence
  Synthetic
catcataagacgagtaatccg

SEQ ID NO: 26478 - DNA, 21 bp, Artificial Sequence
  Synthetic
gggatgcgtcttcctgctcat

SEQ ID NO: 26479 - DNA, 21 bp, Artificial Sequence
  Synthetic
ccgaagttggataatcgttgg

SEQ ID NO: 26480 - DNA, 21 bp, Artificial Sequence
  Synthetic
tggtcgccggagcggggttat

SEQ ID NO: 26481 - DNA, 21 bp, Artificial Sequence
  Synthetic
atgactacgcctagttttttt

SEQ ID NO: 26482 - DNA, 21 bp, Artificial Sequence
  Synthetic
cgtcttaataatgttcatacg

SEQ ID NO: 26483 - DNA, 21 bp, Artificial Sequence
  Synthetic
atgggggataggtgggcgtat

SEQ ID NO: 26484 - DNA, 21 bp, Artificial Sequence
  Synthetic
ggtttgctgaatggttttcat

SEQ ID NO: 26485 - DNA, 21 bp, Artificial Sequence
  Synthetic
gaggttaggtttggttctgcg

SEQ ID NO: 26486 - DNA, 21 bp, Artificial Sequence
  Synthetic
gatagttatgcgactcggttt

SEQ ID NO: 26487 - DNA, 21 bp, Artificial Sequence
  Synthetic
gttaatgttgggtattctagt

SEQ ID NO: 26488 - DNA, 21 bp, Artificial Sequence
  Synthetic
tctcttcatgcgcggtgggat

SEQ ID NO: 26489 - DNA, 21 bp, Artificial Sequence
  Synthetic
cctaggcttcagtattcggcg

SEQ ID NO: 26490 - DNA, 21 bp, Artificial Sequence
  Synthetic
tctgtgccgcatagtcattgg

SEQ ID NO: 26491 - DNA, 21 bp, Artificial Sequence
  Synthetic
ctttgggagttggggtcgtcg

SEQ ID NO: 26492 - DNA, 21 bp, Artificial Sequence
  Synthetic
actacgatgggttatagttcg

SEQ ID NO: 26493 - DNA, 21 bp, Artificial Sequence
  Synthetic
atgaattatggtatgagtact

SEQ ID NO: 26494 - DNA, 21 bp, Artificial Sequence
  Synthetic
tgggcggagaggggtagtagt

SEQ ID NO: 26495 - DNA, 21 bp, Artificial Sequence
  Synthetic
catatgctgggtagggtgaat

SEQ ID NO: 26496 - DNA, 21 bp, Artificial Sequence
  Synthetic
ggtgttccggcttcgttttat

SEQ ID NO: 26497 - DNA, 21 bp, Artificial Sequence
  Synthetic
tcgaattatgagactcggttt

SEQ ID NO: 26498 - DNA, 21 bp, Artificial Sequence
  Synthetic
ggttatcctggttatgctgct

SEQ ID NO: 26499 - DNA, 21 bp, Artificial Sequence
  Synthetic
ggttatcctggtttttcgagt

SEQ ID NO: 26500 - DNA, 21 bp, Artificial Sequence
  Synthetic
tggcaggctaggcaggcgaat

SEQ ID NO: 26501 - DNA, 21 bp, Artificial Sequence
  Synthetic
catggtgttcgtatgacggct

SEQ ID NO: 26502 - DNA, 21 bp, Artificial Sequence
  Synthetic
aataggcctgtgattcatcag

SEQ ID NO: 26503 - DNA, 21 bp, Artificial Sequence
  Synthetic
gaggtttcgtttggttctgct

SEQ ID NO: 26504 - DNA, 21 bp, Artificial Sequence
  Synthetic
tgggtggagtatccgaatcag

SEQ ID NO: 26505 - DNA, 21 bp, Artificial Sequence
  Synthetic
aggttggagactatgctgtat

SEQ ID NO: 26506 - DNA, 21 bp, Artificial Sequence
  Synthetic
gttctttatcagcttcctact

SEQ ID NO: 26507 - DNA, 21 bp, Artificial Sequence
  Synthetic
gatcatgctggggcgcgttgg

SEQ ID NO: 26508 - DNA, 21 bp, Artificial Sequence
  Synthetic
tcgggtcatgagaggtgggct

SEQ ID NO: 26509 - DNA, 21 bp, Artificial Sequence
  Synthetic
ttgagggagtcttgggcgtcg

SEQ ID NO: 26510 - DNA, 21 bp, Artificial Sequence
  Synthetic
tcgccgggttatagggcggat

SEQ ID NO: 26511 - DNA, 21 bp, Artificial Sequence
  Synthetic
acgtttgctggtcagagtcag

SEQ ID NO: 26512 - DNA, 21 bp, Artificial Sequence
  Synthetic
ttttttagtcttggggctgcg

SEQ ID NO: 26513 - DNA, 21 bp, Artificial Sequence
  Synthetic
gctctggttatttatggggcg

SEQ ID NO: 26514 - DNA, 21 bp, Artificial Sequence
  Synthetic
ggtttgacttttggtagtatt

SEQ ID NO: 26515 - DNA, 21 bp, Artificial Sequence
  Synthetic
gttgcgtcggggcagtattgg

SEQ ID NO: 26516 - DNA, 21 bp, Artificial Sequence
  Synthetic
acgtttcatattgcgagtatt

SEQ ID NO: 26517 - DNA, 21 bp, Artificial Sequence
  Synthetic
cgttatatgggggatagtcag

SEQ ID NO: 26518 - DNA, 21 bp, Artificial Sequence
  Synthetic
agtaagcgtgtggatatgggg

SEQ ID NO: 26519 - DNA, 21 bp, Artificial Sequence
  Synthetic
gttggttcgctgtttcggaat

SEQ ID NO: 26520 - DNA, 21 bp, Artificial Sequence
  Synthetic
cttgtggctcatcctaatcgt

SEQ ID NO: 26521 - DNA, 21 bp, Artificial Sequence
  Synthetic
gattctcataagggtaataag

SEQ ID NO: 26522 - DNA, 21 bp, Artificial Sequence
  Synthetic
cgtgatccgggtcggcatggt

SEQ ID NO: 26523 - DNA, 21 bp, Artificial Sequence
  Synthetic
tggagttcgaatgagggtcgg

SEQ ID NO: 26524 - DNA, 21 bp, Artificial Sequence
  Synthetic
cttaggaatatttcgtcgttt

SEQ ID NO: 26525 - DNA, 21 bp, Artificial Sequence
  Synthetic
ggtagtcagttggggttgtgg

SEQ ID NO: 26526 - DNA, 21 bp, Artificial Sequence
  Synthetic
tgggctactaggggtagtgct

SEQ ID NO: 26527 - DNA, 21 bp, Artificial Sequence
  Synthetic
gtgaaggcgacttggtcgtct

SEQ ID NO: 26528 - DNA, 21 bp, Artificial Sequence
  Synthetic
ctgatgactaatgggtgggct

SEQ ID NO: 26529 - DNA, 21 bp, Artificial Sequence
  Synthetic
gtgggtgcgagtcgttgggat

SEQ ID NO: 26530 - DNA, 21 bp, Artificial Sequence
  Synthetic
gatcatgggcctaggcatatg

SEQ ID NO: 26531 - DNA, 21 bp, Artificial Sequence
  Synthetic
gcgagggtggggtctttgtat

SEQ ID NO: 26532 - DNA, 21 bp, Artificial Sequence
  Synthetic
ggtgttgctgatgctagttgg

SEQ ID NO: 26533 - DNA, 21 bp, Artificial Sequence
  Synthetic
gtgcgttttgttggttctcat

SEQ ID NO: 26534 - DNA, 21 bp, Artificial Sequence
  Synthetic
ggttatgataggggtgcgtgg

SEQ ID NO: 26535 - DNA, 21 bp, Artificial Sequence
  Synthetic
acgtgggctcaggggagttct

SEQ ID NO: 26536 - DNA, 21 bp, Artificial Sequence
  Synthetic
aatcgttttaatctgaatttg

SEQ ID NO: 26537 - DNA, 21 bp, Artificial Sequence
  Synthetic
cgggggcttgggtttagtgct

SEQ ID NO: 26538 - DNA, 21 bp, Artificial Sequence
  Synthetic
tcttctgattataatcggtgg

SEQ ID NO: 26539 - DNA, 21 bp, Artificial Sequence
  Synthetic
gaggtttggcctaggaatcct

SEQ ID NO: 26540 - DNA, 21 bp, Artificial Sequence
  Synthetic
gcgacggtgtatgagcattgg

SEQ ID NO: 26541 - DNA, 21 bp, Artificial Sequence
  Synthetic
atgaattatggggcggctcag

SEQ ID NO: 26542 - DNA, 21 bp, Artificial Sequence
  Synthetic
catgggacgactggtttttgg

SEQ ID NO: 26543 - DNA, 21 bp, Artificial Sequence
  Synthetic
gttccgctgtatcggtatgat

SEQ ID NO: 26544 - DNA, 21 bp, Artificial Sequence
  Synthetic
cggctgtatgggtatggggat

SEQ ID NO: 26545 - DNA, 21 bp, Artificial Sequence
  Synthetic
tgggagaagtttgggagttct

SEQ ID NO: 26546 - DNA, 21 bp, Artificial Sequence
  Synthetic
ccgggtgatcgtagttggctg

SEQ ID NO: 26547 - DNA, 21 bp, Artificial Sequence
  Synthetic
gagaagagtttttcgcattgg

SEQ ID NO: 26548 - DNA, 21 bp, Artificial Sequence
  Synthetic
gaggttattcataggacgtgg

SEQ ID NO: 26549 - DNA, 21 bp, Artificial Sequence
  Synthetic
ctggagcgtgggtttgctcag

SEQ ID NO: 26550 - DNA, 21 bp, Artificial Sequence
  Synthetic
tggattatgggggggtcggcg

SEQ ID NO: 26551 - DNA, 21 bp, Artificial Sequence
  Synthetic
ccgattgcgtatcatgctgcg

SEQ ID NO: 26552 - DNA, 21 bp, Artificial Sequence
  Synthetic
cgggtgacgacgcagacgtat

SEQ ID NO: 26553 - DNA, 21 bp, Artificial Sequence
  Synthetic
catgagagggagcggcctagg

SEQ ID NO: 26554 - DNA, 21 bp, Artificial Sequence
  Synthetic
ggtgcttttcgtgattttacg

SEQ ID NO: 26555 - DNA, 21 bp, Artificial Sequence
  Synthetic
cctgtggggctgcttccgtat

SEQ ID NO: 26556 - DNA, 21 bp, Artificial Sequence
  Synthetic
cggaattttaagcctgatggg

SEQ ID NO: 26557 - DNA, 21 bp, Artificial Sequence
  Synthetic
gatgcttatgagacgcgttgg

SEQ ID NO: 26558 - DNA, 21 bp, Artificial Sequence
  Synthetic
cgttgggtgtcggagagtgcg

SEQ ID NO: 26559 - DNA, 21 bp, Artificial Sequence
  Synthetic
cgttttactggtgatccgtcg

SEQ ID NO: 26560 - DNA, 21 bp, Artificial Sequence
  Synthetic
cggctggagtcttcttattgg

SEQ ID NO: 26561 - DNA, 21 bp, Artificial Sequence
  Synthetic
cagcctggttcgtatggttgg

SEQ ID NO: 26562 - DNA, 21 bp, Artificial Sequence
  Synthetic
agggagttgagtatgcggaat

SEQ ID NO: 26563 - DNA, 21 bp, Artificial Sequence
  Synthetic
tttaaggagcagtggcctcgt

SEQ ID NO: 26564 - DNA, 21 bp, Artificial Sequence
  Synthetic
catgattggcagcagcgtgct

SEQ ID NO: 26565 - DNA, 21 bp, Artificial Sequence
  Synthetic
cggcatccgggttatagtgtg

SEQ ID NO: 26566 - DNA, 21 bp, Artificial Sequence
  Synthetic
aggcatggtaagactgagtgt

SEQ ID NO: 26567 - DNA, 21 bp, Artificial Sequence
  Synthetic
atggggatgggtttggggagg

SEQ ID NO: 26568 - DNA, 21 bp, Artificial Sequence
  Synthetic
gtgaatcagcctaatcatcgg

SEQ ID NO: 26569 - DNA, 21 bp, Artificial Sequence
  Synthetic
ggtatgcggagttctcatcag

SEQ ID NO: 26570 - DNA, 21 bp, Artificial Sequence
  Synthetic
aataagttgcgtgcgcttggt

SEQ ID NO: 26571 - DNA, 21 bp, Artificial Sequence
  Synthetic
gttcatgctaattgggcgcat

SEQ ID NO: 26572 - DNA, 21 bp, Artificial Sequence
  Synthetic
tttgttagtttgccgtatacg

SEQ ID NO: 26573 - DNA, 21 bp, Artificial Sequence
  Synthetic
gtggatgctcggatttttcat

SEQ ID NO: 26574 - DNA, 21 bp, Artificial Sequence
  Synthetic
attctgggtggttatcatagt

SEQ ID NO: 26575 - DNA, 21 bp, Artificial Sequence
  Synthetic
tcttcttattttgggtcggcg

SEQ ID NO: 26576 - DNA, 21 bp, Artificial Sequence
  Synthetic
gagcgtgagtgggcgattagt

SEQ ID NO: 26577 - DNA, 21 bp, Artificial Sequence
  Synthetic
tttcgggagtatcctcattat

SEQ ID NO: 26578 - DNA, 21 bp, Artificial Sequence
  Synthetic
attcgggcgggttatgctatg

SEQ ID NO: 26579 - DNA, 21 bp, Artificial Sequence
  Synthetic
aggtttactaatgattcgtcg

SEQ ID NO: 26580 - DNA, 21 bp, Artificial Sequence
  Synthetic
cttttgaggcttggtagtacg

SEQ ID NO: 26581 - DNA, 21 bp, Artificial Sequence
  Synthetic
gagtggacgcgtgggagtgcg

SEQ ID NO: 26582 - DNA, 21 bp, Artificial Sequence
  Synthetic
catggtcctgttgggattcgg

SEQ ID NO: 26583 - DNA, 21 bp, Artificial Sequence
  Synthetic
aagcattctccggctacgagt

SEQ ID NO: 26584 - DNA, 21 bp, Artificial Sequence
  Synthetic
tctaatagggctcctgagcgg

SEQ ID NO: 26585 - DNA, 21 bp, Artificial Sequence
  Synthetic
agggagcgggtggctagggag

SEQ ID NO: 26586 - DNA, 21 bp, Artificial Sequence
  Synthetic
gagaatttgccgtggtcgtat

SEQ ID NO: 26587 - DNA, 21 bp, Artificial Sequence
  Synthetic
gagaggactcgggggtcgagt

SEQ ID NO: 26588 - DNA, 21 bp, Artificial Sequence
  Synthetic
atgatgcagattagtgcgcgg

SEQ ID NO: 26589 - DNA, 21 bp, Artificial Sequence
  Synthetic
ggtggggatcggggtcattgg

SEQ ID NO: 26590 - DNA, 21 bp, Artificial Sequence
  Synthetic
ccggtgaataagaatggttgg

SEQ ID NO: 26591 - DNA, 21 bp, Artificial Sequence
  Synthetic
aggttggctagtcatgggccg

SEQ ID NO: 26592 - DNA, 21 bp, Artificial Sequence
  Synthetic
cttattgagggttggagtact

SEQ ID NO: 26593 - DNA, 21 bp, Artificial Sequence
  Synthetic
ggtgggtggggtgggtcgagt

SEQ ID NO: 26594 - DNA, 21 bp, Artificial Sequence
  Synthetic
ccgcttggttctgggtttcgt

SEQ ID NO: 26595 - DNA, 21 bp, Artificial Sequence
  Synthetic
acgcattcggggcatttgtgg

SEQ ID NO: 26596 - DNA, 21 bp, Artificial Sequence
  Synthetic
cataagattccggttgagcgg

SEQ ID NO: 26597 - DNA, 21 bp, Artificial Sequence
  Synthetic
gggggtcatcaggggctttgg

SEQ ID NO: 26598 - DNA, 21 bp, Artificial Sequence
  Synthetic
agggcggttgggatggattgg

SEQ ID NO: 26599 - DNA, 21 bp, Artificial Sequence
  Synthetic
atgatggggattcttgggagg

SEQ ID NO: 26600 - DNA, 21 bp, Artificial Sequence
  Synthetic
actcggttgggtggtgcgcag

SEQ ID NO: 26601 - DNA, 21 bp, Artificial Sequence
  Synthetic
cgtcagatgccggagaataag

SEQ ID NO: 26602 - DNA, 21 bp, Artificial Sequence
  Synthetic
gtgtggagggagggtcgtccg

SEQ ID NO: 26603 - DNA, 21 bp, Artificial Sequence
  Synthetic
gagaggcctattcctacgcgt

SEQ ID NO: 26604 - DNA, 21 bp, Artificial Sequence
  Synthetic
gagtattttgcggggagtagt

SEQ ID NO: 26605 - DNA, 21 bp, Artificial Sequence
  Synthetic
attattcctgggtattctatt

SEQ ID NO: 26606 - DNA, 21 bp, Artificial Sequence
  Synthetic
atgaatcttgggttttcgagt

SEQ ID NO: 26607 - DNA, 21 bp, Artificial Sequence
  Synthetic
gcggctcgtacgaatggttgg

SEQ ID NO: 26608 - DNA, 21 bp, Artificial Sequence
  Synthetic
gatcatactactaattattgg

SEQ ID NO: 26609 - DNA, 21 bp, Artificial Sequence
  Synthetic
ggtgagccggttaggtgggct

SEQ ID NO: 26610 - DNA, 21 bp, Artificial Sequence
  Synthetic
gttaagactcctggtgtttgg

SEQ ID NO: 26611 - DNA, 21 bp, Artificial Sequence
  Synthetic
agggttgtgatgggttatgcg

SEQ ID NO: 26612 - DNA, 21 bp, Artificial Sequence
  Synthetic
agtcatgtgacggattatagg

SEQ ID NO: 26613 - DNA, 21 bp, Artificial Sequence
  Synthetic
cataatagggcgtctcagaat

SEQ ID NO: 26614 - DNA, 21 bp, Artificial Sequence
  Synthetic
cttgaggtgcatcagatttgg

SEQ ID NO: 26615 - DNA, 21 bp, Artificial Sequence
  Synthetic
ttgagtgggtatacgtttggg

SEQ ID NO: 26616 - DNA, 21 bp, Artificial Sequence
  Synthetic
tcgtttcctgggtgggctcag

SEQ ID NO: 26617 - DNA, 21 bp, Artificial Sequence
  Synthetic
tggggttcgttgatgtcttat

SEQ ID NO: 26618 - DNA, 21 bp, Artificial Sequence
  Synthetic
aatcatgtgggtatgcggttg

SEQ ID NO: 26619 - DNA, 21 bp, Artificial Sequence
  Synthetic
atgccgtatcatgttcctaat

SEQ ID NO: 26620 - DNA, 21 bp, Artificial Sequence
  Synthetic
tgggctttgcttggtgcgtct

SEQ ID NO: 26621 - DNA, 21 bp, Artificial Sequence
  Synthetic
tttcttgcgcgggcggagcgt

SEQ ID NO: 26622 - DNA, 21 bp, Artificial Sequence
  Synthetic
ttgtattatgctggtatgacg

SEQ ID NO: 26623 - DNA, 21 bp, Artificial Sequence
  Synthetic
agtcggcagattcatcctccg

SEQ ID NO: 26624 - DNA, 21 bp, Artificial Sequence
  Synthetic
gtggagaggaatacttggagt

SEQ ID NO: 26625 - DNA, 21 bp, Artificial Sequence
  Synthetic
tggactcgttggaatgtggag

SEQ ID NO: 26626 - DNA, 21 bp, Artificial Sequence
  Synthetic
catagttttcatctggatctg

SEQ ID NO: 26627 - DNA, 21 bp, Artificial Sequence
  Synthetic
agtaagtggggtctttatgag

SEQ ID NO: 26628 - DNA, 21 bp, Artificial Sequence
  Synthetic
cgtcctaatggttggcatgag

SEQ ID NO: 26629 - DNA, 21 bp, Artificial Sequence
  Synthetic
tgttttgtgtatgggagtgcg

SEQ ID NO: 26630 - DNA, 21 bp, Artificial Sequence
  Synthetic
actgcggatcttggtcgttgg

SEQ ID NO: 26631 - DNA, 21 bp, Artificial Sequence
  Synthetic
tattgggggggttttggtgat

SEQ ID NO: 26632 - DNA, 21 bp, Artificial Sequence
  Synthetic
aataagtgggagctgcctgtg

SEQ ID NO: 26633 - DNA, 21 bp, Artificial Sequence
  Synthetic
cattcgcatggggggttgtcg

SEQ ID NO: 26634 - DNA, 21 bp, Artificial Sequence
  Synthetic
gggcatagtcctgggctttgg

SEQ ID NO: 26635 - DNA, 21 bp, Artificial Sequence
  Synthetic
ggtttgcttcgtcttgttaat

SEQ ID NO: 26636 - DNA, 21 bp, Artificial Sequence
  Synthetic
gaggagtttcggggtagtgct

SEQ ID NO: 26637 - DNA, 21 bp, Artificial Sequence
  Synthetic
cagggggatactggtcggtgg

SEQ ID NO: 26638 - DNA, 21 bp, Artificial Sequence
  Synthetic
cgttggagtgtggatgcggcg

SEQ ID NO: 26639 - DNA, 21 bp, Artificial Sequence
  Synthetic
cgtggtgggttgcgtgagccg

SEQ ID NO: 26640 - DNA, 21 bp, Artificial Sequence
  Synthetic
aatttgaataatcctgctagg

SEQ ID NO: 26641 - DNA, 21 bp, Artificial Sequence
  Synthetic
cagcatgtgtcggattttcgt

SEQ ID NO: 26642 - DNA, 21 bp, Artificial Sequence
  Synthetic
aggtttcttaatgatgcggcg

SEQ ID NO: 26643 - DNA, 21 bp, Artificial Sequence
  Synthetic
gatcctaattttgctcgttgg

SEQ ID NO: 26644 - DNA, 21 bp, Artificial Sequence
  Synthetic
tttactggtcctccgaggagt

SEQ ID NO: 26645 - DNA, 21 bp, Artificial Sequence
  Synthetic
gagcggctgatgggggcttcg

SEQ ID NO: 26646 - DNA, 21 bp, Artificial Sequence
  Synthetic
ttgacgcatagtggtgtgtgg

SEQ ID NO: 26647 - DNA, 21 bp, Artificial Sequence
  Synthetic
atgcgtactgcgggtcatggg

SEQ ID NO: 26648 - DNA, 21 bp, Artificial Sequence
  Synthetic
cggcatattgggaatcttggg

SEQ ID NO: 26649 - DNA, 21 bp, Artificial Sequence
  Synthetic
agtattttgcgtgggtctact

SEQ ID NO: 26650 - DNA, 21 bp, Artificial Sequence
  Synthetic
gcgtggtctctggggtcgagt

SEQ ID NO: 26651 - DNA, 21 bp, Artificial Sequence
  Synthetic
gagcggcagtttggtgcggcg

SEQ ID NO: 26652 - DNA, 21 bp, Artificial Sequence
  Synthetic
cttgcggtggggtggagttcg

SEQ ID NO: 26653 - DNA, 21 bp, Artificial Sequence
  Synthetic
gatgtggcgaatgggcggtgg

SEQ ID NO: 26654 - DNA, 21 bp, Artificial Sequence
  Synthetic
gagactggtgctgcgaggtgg

SEQ ID NO: 26655 - DNA, 21 bp, Artificial Sequence
  Synthetic
gcgaggacgagtgcggagcgg

SEQ ID NO: 26656 - DNA, 21 bp, Artificial Sequence
  Synthetic
attggtacgcggcatgtgtgt

SEQ ID NO: 26657 - DNA, 21 bp, Artificial Sequence
  Synthetic
catgatgagggtcataagcgg

SEQ ID NO: 26658 - DNA, 21 bp, Artificial Sequence
  Synthetic
gggcatgcgaattggtctgcg

SEQ ID NO: 26659 - DNA, 21 bp, Artificial Sequence
  Synthetic
ggtactaattattctggttgg

SEQ ID NO: 26660 - DNA, 21 bp, Artificial Sequence
  Synthetic
ggtcagaagagttcgagtatg

SEQ ID NO: 26661 - DNA, 21 bp, Artificial Sequence
  Synthetic
atgcggcatgttgtggtgccg

SEQ ID NO: 26662 - DNA, 21 bp, Artificial Sequence
  Synthetic
cataggtctggtttttctcag

SEQ ID NO: 26663 - DNA, 21 bp, Artificial Sequence
  Synthetic
cgtgatactaatgcggtgagg

SEQ ID NO: 26664 - DNA, 21 bp, Artificial Sequence
  Synthetic
cgttggccgggggatgcggtt

SEQ ID NO: 26665 - DNA, 21 bp, Artificial Sequence
  Synthetic
aggcctctgggtcatcgggat

SEQ ID NO: 26666 - DNA, 21 bp, Artificial Sequence
  Synthetic
gttccgtcggaggcgaggtgg

SEQ ID NO: 26667 - DNA, 21 bp, Artificial Sequence
  Synthetic
aggccgtatgataatgttatt

SEQ ID NO: 26668 - DNA, 21 bp, Artificial Sequence
  Synthetic
ggttctcttgctcatgcgagg

SEQ ID NO: 26669 - DNA, 21 bp, Artificial Sequence
  Synthetic
cgtaggagtattattgatgct

SEQ ID NO: 26670 - DNA, 21 bp, Artificial Sequence
  Synthetic
cataatcctgtgtggggttcg

SEQ ID NO: 26671 - DNA, 21 bp, Artificial Sequence
  Synthetic
atgccgcatcgtattatggtt

SEQ ID NO: 26672 - DNA, 21 bp, Artificial Sequence
  Synthetic
attaggtctgatgtgatgcgt

SEQ ID NO: 26673 - DNA, 21 bp, Artificial Sequence
  Synthetic
gataatacgtcgcatcgttgg

SEQ ID NO: 26674 - DNA, 21 bp, Artificial Sequence
  Synthetic
gagaatgatcgtaggctgtgg

SEQ ID NO: 26675 - DNA, 21 bp, Artificial Sequence
  Synthetic
gtttattttgctgggtcttcg

SEQ ID NO: 26676 - DNA, 21 bp, Artificial Sequence
  Synthetic
cagcatgctcattggagtgct

SEQ ID NO: 26677 - DNA, 21 bp, Artificial Sequence
  Synthetic
gatcggatgggttttagtcag

SEQ ID NO: 26678 - DNA, 21 bp, Artificial Sequence
  Synthetic
gcgccgaatagtggttattgg

SEQ ID NO: 26679 - DNA, 21 bp, Artificial Sequence
  Synthetic
gagccgtggacgacttatcat

SEQ ID NO: 26680 - DNA, 21 bp, Artificial Sequence
  Synthetic
gatcaggttgttaggtgggcg

SEQ ID NO: 26681 - DNA, 21 bp, Artificial Sequence
  Synthetic
tataattctctttggcctcag

SEQ ID NO: 26682 - DNA, 21 bp, Artificial Sequence
  Synthetic
tgggatattgagagggggttt

SEQ ID NO: 26683 - DNA, 21 bp, Artificial Sequence
  Synthetic
acgcattgggggggggcgtct

SEQ ID NO: 26684 - DNA, 21 bp, Artificial Sequence
  Synthetic
cagcgtaatgatattggtcgt

SEQ ID NO: 26685 - DNA, 21 bp, Artificial Sequence
  Synthetic
gattatgggagtgcgcggtat

SEQ ID NO: 26686 - DNA, 21 bp, Artificial Sequence
  Synthetic
ccgcgtatggcgcagcatctt

SEQ ID NO: 26687 - DNA, 21 bp, Artificial Sequence
  Synthetic
agtaatgattatgctcgttat

SEQ ID NO: 26688 - DNA, 21 bp, Artificial Sequence
  Synthetic
atgcgtgatgggaagtttcct

SEQ ID NO: 26689 - DNA, 21 bp, Artificial Sequence
  Synthetic
gttgtgcgtttggatcagtgg

SEQ ID NO: 26690 - DNA, 21 bp, Artificial Sequence
  Synthetic
tatgtgtcgttgcctcatagt

SEQ ID NO: 26691 - DNA, 21 bp, Artificial Sequence
  Synthetic
cagtttgtgggtgatgcgtct

SEQ ID NO: 26692 - DNA, 21 bp, Artificial Sequence
  Synthetic
gatgtttgggctgggagtgtt

SEQ ID NO: 26693 - DNA, 21 bp, Artificial Sequence
  Synthetic
gatgcgatgccggggcgttgg

SEQ ID NO: 26694 - DNA, 21 bp, Artificial Sequence
  Synthetic
gctggggtggggtgggcttct

SEQ ID NO: 26695 - DNA, 21 bp, Artificial Sequence
  Synthetic
tcgtggtctgggcagcctatg

SEQ ID NO: 26696 - DNA, 21 bp, Artificial Sequence
  Synthetic
tgtgcggttgcgcagacgtgg

SEQ ID NO: 26697 - DNA, 21 bp, Artificial Sequence
  Synthetic
acggttgcttatttggcttcg

SEQ ID NO: 26698 - DNA, 21 bp, Artificial Sequence
  Synthetic
cttgtgggttggcatgggctt

SEQ ID NO: 26699 - DNA, 21 bp, Artificial Sequence
  Synthetic
cggatgcagctggatggtaag

SEQ ID NO: 26700 - DNA, 21 bp, Artificial Sequence
  Synthetic
agtgcttcttggtcttctgcg

SEQ ID NO: 26701 - DNA, 21 bp, Artificial Sequence
  Synthetic
attattactagtgcttggaat

SEQ ID NO: 26702 - DNA, 21 bp, Artificial Sequence
  Synthetic
tggcagggtactgggcggccg

SEQ ID NO: 26703 - DNA, 21 bp, Artificial Sequence
  Synthetic
cgggggggtatgatggctttg

SEQ ID NO: 26704 - DNA, 21 bp, Artificial Sequence
  Synthetic
attagggatttgacggcgcgg

SEQ ID NO: 26705 - DNA, 21 bp, Artificial Sequence
  Synthetic
cggaattatgaggggtgggcg

SEQ ID NO: 26706 - DNA, 21 bp, Artificial Sequence
  Synthetic
gcgtttcttgggctttcttcg

SEQ ID NO: 26707 - DNA, 21 bp, Artificial Sequence
  Synthetic
actcatattggtggggttcgg

SEQ ID NO: 26708 - DNA, 21 bp, Artificial Sequence
  Synthetic
gtgccttttgatttgtcgcgg

SEQ ID NO: 26709 - DNA, 21 bp, Artificial Sequence
  Synthetic
gcgtatgtgcgggatctgaat

SEQ ID NO: 26710 - DNA, 21 bp, Artificial Sequence
  Synthetic
tcgcatgatgggcagtattgg

SEQ ID NO: 26711 - DNA, 21 bp, Artificial Sequence
  Synthetic
ccggggcatgggtttagtgtg

SEQ ID NO: 26712 - DNA, 21 bp, Artificial Sequence
  Synthetic
gagttgtggcaggggttttcg

SEQ ID NO: 26713 - DNA, 21 bp, Artificial Sequence
  Synthetic
actcctccgtggggtagttcg

SEQ ID NO: 26714 - DNA, 21 bp, Artificial Sequence
  Synthetic
tatactattcctgagtatcgg

SEQ ID NO: 26715 - DNA, 21 bp, Artificial Sequence
  Synthetic
tggatggcgcggagtgcggtg

SEQ ID NO: 26716 - DNA, 21 bp, Artificial Sequence
  Synthetic
tgggctagtaagggtactgtg

SEQ ID NO: 26717 - DNA, 21 bp, Artificial Sequence
  Synthetic
gcttgggataagggttatggt

SEQ ID NO: 26718 - DNA, 21 bp, Artificial Sequence
  Synthetic
cagggggctatgcggtgggat

SEQ ID NO: 26719 - DNA, 21 bp, Artificial Sequence
  Synthetic
gagaagcattcgggggtgtgg

SEQ ID NO: 26720 - DNA, 21 bp, Artificial Sequence
  Synthetic
gcgaggaatggggagtcgaag

SEQ ID NO: 26721 - DNA, 21 bp, Artificial Sequence
  Synthetic
aatgcttctggtcttcatcgt

SEQ ID NO: 26722 - DNA, 21 bp, Artificial Sequence
  Synthetic
cgtgcggggggtggtcatttt

SEQ ID NO: 26723 - DNA, 21 bp, Artificial Sequence
  Synthetic
cgggggggtgctgctccgcat

SEQ ID NO: 26724 - DNA, 21 bp, Artificial Sequence
  Synthetic
ggggctgagaagtttcagcgg

SEQ ID NO: 26725 - DNA, 21 bp, Artificial Sequence
  Synthetic
agtcgggtggggatggcgcag

SEQ ID NO: 26726 - DNA, 21 bp, Artificial Sequence
  Synthetic
gtgcgtccgtatggtagtgct

SEQ ID NO: 26727 - DNA, 21 bp, Artificial Sequence
  Synthetic
aatgttgtgggttggagtagt

SEQ ID NO: 26728 - DNA, 21 bp, Artificial Sequence
  Synthetic
gcggctgattatatgaggtat

SEQ ID NO: 26729 - DNA, 21 bp, Artificial Sequence
  Synthetic
actcatactcatgggagtact

SEQ ID NO: 26730 - DNA, 21 bp, Artificial Sequence
  Synthetic
tctgtttatttgggttctact

SEQ ID NO: 26731 - DNA, 21 bp, Artificial Sequence
  Synthetic
gtgttgaggggttatagtgct

SEQ ID NO: 26732 - DNA, 21 bp, Artificial Sequence
  Synthetic
caggttcctggttatagtgct

SEQ ID NO: 26733 - DNA, 21 bp, Artificial Sequence
  Synthetic
ccttttattggtatggcggcg

SEQ ID NO: 26734 - DNA, 21 bp, Artificial Sequence
  Synthetic
tggattaatatgtatggggag

SEQ ID NO: 26735 - DNA, 21 bp, Artificial Sequence
  Synthetic
tggcatagtttgtctactagt

SEQ ID NO: 26736 - DNA, 21 bp, Artificial Sequence
  Synthetic
ggtgttactcgtactctgtat

SEQ ID NO: 26737 - DNA, 21 bp, Artificial Sequence
  Synthetic
ggtgttgttggtgagcggtgg

SEQ ID NO: 26738 - DNA, 21 bp, Artificial Sequence
  Synthetic
tggcgtagtgcggggtctacg

SEQ ID NO: 26739 - DNA, 21 bp, Artificial Sequence
  Synthetic
gtgggtttggggcgttgggag

SEQ ID NO: 26740 - DNA, 21 bp, Artificial Sequence
  Synthetic
aggcagtattcttatactgat

SEQ ID NO: 26741 - DNA, 21 bp, Artificial Sequence
  Synthetic
actaatcagtggtctgcttcg

SEQ ID NO: 26742 - DNA, 21 bp, Artificial Sequence
  Synthetic
atgtgggttccttctagttct

SEQ ID NO: 26743 - DNA, 21 bp, Artificial Sequence
  Synthetic
gctaagctggggatggctcag

SEQ ID NO: 26744 - DNA, 21 bp, Artificial Sequence
  Synthetic
gtgtcgagggatcagttgcgg

SEQ ID NO: 26745 - DNA, 21 bp, Artificial Sequence
  Synthetic
gtgatgagttatcatacgcat

SEQ ID NO: 26746 - DNA, 21 bp, Artificial Sequence
  Synthetic
cgtggtgttaatttggataag

SEQ ID NO: 26747 - DNA, 21 bp, Artificial Sequence
  Synthetic
gcgctggtggggtatagtttt

SEQ ID NO: 26748 - DNA, 21 bp, Artificial Sequence
  Synthetic
catatgggtgataatcggtgg

SEQ ID NO: 26749 - DNA, 21 bp, Artificial Sequence
  Synthetic
gatgggaatcctggtcattgg

SEQ ID NO: 26750 - DNA, 21 bp, Artificial Sequence
  Synthetic
actaagagtcctggtccgtgg

SEQ ID NO: 26751 - DNA, 21 bp, Artificial Sequence
  Synthetic
ccgtggccgggggctgcgacg

SEQ ID NO: 26752 - DNA, 21 bp, Artificial Sequence
  Synthetic
gtgtcgattggttggtcttcg

SEQ ID NO: 26753 - DNA, 21 bp, Artificial Sequence
  Synthetic
tgtgttgggctttatggttgt

SEQ ID NO: 26754 - DNA, 21 bp, Artificial Sequence
  Synthetic
tttcagcctggtgggttttgg

SEQ ID NO: 26755 - DNA, 21 bp, Artificial Sequence
  Synthetic
cttgtttggggtgctgtggag

SEQ ID NO: 26756 - DNA, 21 bp, Artificial Sequence
  Synthetic
tggcatacgttggctgtgaag

SEQ ID NO: 26757 - DNA, 21 bp, Artificial Sequence
  Synthetic
tgggagattgagaggggttat

SEQ ID NO: 26758 - DNA, 21 bp, Artificial Sequence
  Synthetic
tgggcgagttatggggcggct

SEQ ID NO: 26759 - DNA, 21 bp, Artificial Sequence
  Synthetic
gaggttgttcgtcttcataat

SEQ ID NO: 26760 - DNA, 21 bp, Artificial Sequence
  Synthetic
gttaggccgggtgattggtct

SEQ ID NO: 26761 - DNA, 21 bp, Artificial Sequence
  Synthetic
aatagtgtgcatcctattagg

SEQ ID NO: 26762 - DNA, 21 bp, Artificial Sequence
  Synthetic
cgtggtggtatttcgcatatg

SEQ ID NO: 26763 - DNA, 21 bp, Artificial Sequence
  Synthetic
tggcctcgtgcgaattctcct

SEQ ID NO: 26764 - DNA, 21 bp, Artificial Sequence
  Synthetic
gtttctcatcattatccgaag

SEQ ID NO: 26765 - DNA, 21 bp, Artificial Sequence
  Synthetic
tggaatcttgtggatgggttt

SEQ ID NO: 26766 - DNA, 21 bp, Artificial Sequence
  Synthetic
agtgctacgaagagtatgtgg

SEQ ID NO: 26767 - DNA, 21 bp, Artificial Sequence
  Synthetic
ccgaatgtgtctaatatgtgg

SEQ ID NO: 26768 - DNA, 21 bp, Artificial Sequence
  Synthetic
gttaatcatggttgggcttcg

SEQ ID NO: 26769 - DNA, 21 bp, Artificial Sequence
  Synthetic
tcgacgacgacgagttattgg

SEQ ID NO: 26770 - DNA, 21 bp, Artificial Sequence
  Synthetic
gtgtatcatggttttagtcag

SEQ ID NO: 26771 - DNA, 21 bp, Artificial Sequence
  Synthetic
aagtatgctgggatgtcttcg

SEQ ID NO: 26772 - DNA, 21 bp, Artificial Sequence
  Synthetic
ccggagtggggggctgcgcag

SEQ ID NO: 26773 - DNA, 21 bp, Artificial Sequence
  Synthetic
gatggtaatatggctcgttgg

SEQ ID NO: 26774 - DNA, 21 bp, Artificial Sequence
  Synthetic
ggggatactaatctggagtgg

SEQ ID NO: 26775 - DNA, 21 bp, Artificial Sequence
  Synthetic
cgggattatgatttgcggcat

SEQ ID NO: 26776 - DNA, 21 bp, Artificial Sequence
  Synthetic
ggtattgatctgggtaggtgg

SEQ ID NO: 26777 - DNA, 21 bp, Artificial Sequence
  Synthetic
gatagtaatgatgggcggtgg

SEQ ID NO: 26778 - DNA, 21 bp, Artificial Sequence
  Synthetic
cggattgagttgctgccttat

SEQ ID NO: 26779 - DNA, 21 bp, Artificial Sequence
  Synthetic
cggtatattcctgatgctagt

SEQ ID NO: 26780 - DNA, 21 bp, Artificial Sequence
  Synthetic
gtgtatttttctggttctgcg

SEQ ID NO: 26781 - DNA, 21 bp, Artificial Sequence
  Synthetic
tggggttcgcttgagactttg

SEQ ID NO: 26782 - DNA, 21 bp, Artificial Sequence
  Synthetic
tggggggcgcttgagcgtcat

SEQ ID NO: 26783 - DNA, 21 bp, Artificial Sequence
  Synthetic
gtgtggcatagtggttcgagt

SEQ ID NO: 26784 - DNA, 21 bp, Artificial Sequence
  Synthetic
tggtcgagttggacgactgct

SEQ ID NO: 26785 - DNA, 21 bp, Artificial Sequence
  Synthetic
ctgcttgaggggtgggcttct

SEQ ID NO: 26786 - DNA, 21 bp, Artificial Sequence
  Synthetic
cagagggttgtgctggtgtcg

SEQ ID NO: 26787 - DNA, 21 bp, Artificial Sequence
  Synthetic
gatgcgaggaattggcatacg

SEQ ID NO: 26788 - DNA, 21 bp, Artificial Sequence
  Synthetic
gctagtcatgggactctttgg

SEQ ID NO: 26789 - DNA, 21 bp, Artificial Sequence
  Synthetic
aagcagtatgctcttccgagt

SEQ ID NO: 26790 - DNA, 21 bp, Artificial Sequence
  Synthetic
cgttttcctgagttgagtcgg

SEQ ID NO: 26791 - DNA, 21 bp, Artificial Sequence
  Synthetic
cggcatatgaatactaatgct

SEQ ID NO: 26792 - DNA, 21 bp, Artificial Sequence
  Synthetic
aataatgagcatacgtattgg

SEQ ID NO: 26793 - DNA, 21 bp, Artificial Sequence
  Synthetic
gaggagtggcggggggctacg

SEQ ID NO: 26794 - DNA, 21 bp, Artificial Sequence
  Synthetic
gagagttggggtgggagtgct

SEQ ID NO: 26795 - DNA, 21 bp, Artificial Sequence
  Synthetic
tcttttgtgggggattatcgg

SEQ ID NO: 26796 - DNA, 21 bp, Artificial Sequence
  Synthetic
atgtatgaggggttttcgcag

SEQ ID NO: 26797 - DNA, 21 bp, Artificial Sequence
  Synthetic
cataagagtttgtatgggttg

SEQ ID NO: 26798 - DNA, 21 bp, Artificial Sequence
  Synthetic
agttttgctgggtatgcgagt

SEQ ID NO: 26799 - DNA, 21 bp, Artificial Sequence
  Synthetic
ttgagggttccgcgtccggat

SEQ ID NO: 26800 - DNA, 21 bp, Artificial Sequence
  Synthetic
ccgccgcagagtggggtgtgg

SEQ ID NO: 26801 - DNA, 21 bp, Artificial Sequence
  Synthetic
aagggtccgggggctgggtgg

SEQ ID NO: 26802 - DNA, 21 bp, Artificial Sequence
  Synthetic
cgtattcatagtcctggggct

SEQ ID NO: 26803 - DNA, 21 bp, Artificial Sequence
  Synthetic
cataggccggatattgggcgg

SEQ ID NO: 26804 - DNA, 21 bp, Artificial Sequence
  Synthetic
tttattggtgataatcgttgg

SEQ ID NO: 26805 - DNA, 21 bp, Artificial Sequence
  Synthetic
aataggtttcagggttcgacg

SEQ ID NO: 26806 - DNA, 21 bp, Artificial Sequence
  Synthetic
ggtgctttgctgcatgttagg

SEQ ID NO: 26807 - DNA, 21 bp, Artificial Sequence
  Synthetic
ctgtatcctggtcattctatg

SEQ ID NO: 26808 - DNA, 21 bp, Artificial Sequence
  Synthetic
attaatcaggggtggagtact

SEQ ID NO: 26809 - DNA, 21 bp, Artificial Sequence
  Synthetic
agtttggattatgctgggtgg

SEQ ID NO: 26810 - DNA, 21 bp, Artificial Sequence
  Synthetic
atgggtgttgggttttcgtct

SEQ ID NO: 26811 - DNA, 21 bp, Artificial Sequence
  Synthetic
aagggggagcatcttgttcgg

SEQ ID NO: 26812 - DNA, 21 bp, Artificial Sequence
  Synthetic
tcgtatgtgcctcagagtgct

SEQ ID NO: 26813 - DNA, 21 bp, Artificial Sequence
  Synthetic
tgggctactggtgggtcttct

SEQ ID NO: 26814 - DNA, 21 bp, Artificial Sequence
  Synthetic
ccggtgtggggtcaggtgggg

SEQ ID NO: 26815 - DNA, 21 bp, Artificial Sequence
  Synthetic
aggtcggctgcttcggctcat

SEQ ID NO: 26816 - DNA, 21 bp, Artificial Sequence
  Synthetic
cagaatgagtatgcgcggtat

SEQ ID NO: 26817 - DNA, 21 bp, Artificial Sequence
  Synthetic
tggagtgtttcgggttatggt

SEQ ID NO: 26818 - DNA, 21 bp, Artificial Sequence
  Synthetic
aatggtcatcgggagcgggtg

SEQ ID NO: 26819 - DNA, 21 bp, Artificial Sequence
  Synthetic
cggactgtggatcatatgagg

SEQ ID NO: 26820 - DNA, 21 bp, Artificial Sequence
  Synthetic
tggaaggctttgccgggggtg

SEQ ID NO: 26821 - DNA, 21 bp, Artificial Sequence
  Synthetic
tgggatctgcgtgggggtttt

SEQ ID NO: 26822 - DNA, 21 bp, Artificial Sequence
  Synthetic
tttgcgacggggtttagtagt

SEQ ID NO: 26823 - DNA, 21 bp, Artificial Sequence
  Synthetic
aggttggtggatcatgggaag

SEQ ID NO: 26824 - DNA, 21 bp, Artificial Sequence
  Synthetic
aggtgggcgggtggtgcgccg

SEQ ID NO: 26825 - DNA, 21 bp, Artificial Sequence
  Synthetic
gcgagggtggatatgaggttt

SEQ ID NO: 26826 - DNA, 21 bp, Artificial Sequence
  Synthetic
cttcgtgcggggacgatttat

SEQ ID NO: 26827 - DNA, 21 bp, Artificial Sequence
  Synthetic
atggctcgttatggggcgcag

SEQ ID NO: 26828 - DNA, 21 bp, Artificial Sequence
  Synthetic
ggtaatcatggtaagggttat

SEQ ID NO: 26829 - DNA, 21 bp, Artificial Sequence
  Synthetic
gagtgggcgaagattggtcgg

SEQ ID NO: 26830 - DNA, 21 bp, Artificial Sequence
  Synthetic
gatacgttgactaatcgttgg

SEQ ID NO: 26831 - DNA, 21 bp, Artificial Sequence
  Synthetic
tggggtatgctgccggagaag

SEQ ID NO: 26832 - DNA, 21 bp, Artificial Sequence
  Synthetic
gttgcttattctcctcggggg

SEQ ID NO: 26833 - DNA, 21 bp, Artificial Sequence
  Synthetic
actgggcctgcgagtcattgg

SEQ ID NO: 26834 - DNA, 21 bp, Artificial Sequence
  Synthetic
agtgttgttatgtcggggtgg

SEQ ID NO: 26835 - DNA, 21 bp, Artificial Sequence
  Synthetic
tttagggctgcgcagcagggg

SEQ ID NO: 26836 - DNA, 21 bp, Artificial Sequence
  Synthetic
acgggggatcggcctatgagg

SEQ ID NO: 26837 - DNA, 21 bp, Artificial Sequence
  Synthetic
gatgcgggtgtggctcgttgg

SEQ ID NO: 26838 - DNA, 21 bp, Artificial Sequence
  Synthetic
gctaggtatatgggtagtgtg

SEQ ID NO: 26839 - DNA, 21 bp, Artificial Sequence
  Synthetic
gggtctgatgttgggcggtgg

SEQ ID NO: 26840 - DNA, 21 bp, Artificial Sequence
  Synthetic
ttgctgttgagggagtcgttg

SEQ ID NO: 26841 - DNA, 21 bp, Artificial Sequence
  Synthetic
cattctgggatgcagacgagg

SEQ ID NO: 26842 - DNA, 21 bp, Artificial Sequence
  Synthetic
attgcgcgtctgggttatgct

SEQ ID NO: 26843 - DNA, 21 bp, Artificial Sequence
  Synthetic
gctcgtccgtatgatcatgct

SEQ ID NO: 26844 - DNA, 21 bp, Artificial Sequence
  Synthetic
cctagtgagtatagtggttgg

SEQ ID NO: 26845 - DNA, 21 bp, Artificial Sequence
  Synthetic
ggtgattttgtgggtgcgtgg

SEQ ID NO: 26846 - DNA, 21 bp, Artificial Sequence
  Synthetic
acgccgatgcatacgggtcgg

SEQ ID NO: 26847 - DNA, 21 bp, Artificial Sequence
  Synthetic
tgggttgctaggggtgcggcg

SEQ ID NO: 26848 - DNA, 21 bp, Artificial Sequence
  Synthetic
catccgacgtttgggtatgct

SEQ ID NO: 26849 - DNA, 21 bp, Artificial Sequence
  Synthetic
gttccttatgggtatggtagt

SEQ ID NO: 26850 - DNA, 21 bp, Artificial Sequence
  Synthetic
actatgtggggggggtcgacg

SEQ ID NO: 26851 - DNA, 21 bp, Artificial Sequence
  Synthetic
cgtgagtttgcgggttcgtgg

SEQ ID NO: 26852 - DNA, 21 bp, Artificial Sequence
  Synthetic
gagcattggggggcggcttcg

SEQ ID NO: 26853 - DNA, 21 bp, Artificial Sequence
  Synthetic
aatatttggggggaggttgtg

SEQ ID NO: 26854 - DNA, 21 bp, Artificial Sequence
  Synthetic
gatggtgagtatatgcgttgg

SEQ ID NO: 26855 - DNA, 21 bp, Artificial Sequence
  Synthetic
gatgttctgtatgggagtagt

SEQ ID NO: 26856 - DNA, 21 bp, Artificial Sequence
  Synthetic
gaggttatgggggggcgttgg

SEQ ID NO: 26857 - DNA, 21 bp, Artificial Sequence
  Synthetic
atgcctgttcatgcggcgcgg

SEQ ID NO: 26858 - DNA, 21 bp, Artificial Sequence
  Synthetic
gtgcctaataggtcgggttgg

SEQ ID NO: 26859 - DNA, 21 bp, Artificial Sequence
  Synthetic
actgagaagtgggcttatagt

SEQ ID NO: 26860 - DNA, 21 bp, Artificial Sequence
  Synthetic
gggaatcgtcctcctgatcgg

SEQ ID NO: 26861 - DNA, 21 bp, Artificial Sequence
  Synthetic
ccggtgattgcttcgcattgg

SEQ ID NO: 26862 - DNA, 21 bp, Artificial Sequence
  Synthetic
cgtagtcagtttaatgattgg

SEQ ID NO: 26863 - DNA, 21 bp, Artificial Sequence
  Synthetic
attgatacttcggtgtggaat

SEQ ID NO: 26864 - DNA, 21 bp, Artificial Sequence
  Synthetic
ggtgggctggtgcgttgggat

SEQ ID NO: 26865 - DNA, 21 bp, Artificial Sequence
  Synthetic
gggatttggcaggggtctact

SEQ ID NO: 26866 - DNA, 21 bp, Artificial Sequence
  Synthetic
atgcaggggccggtgcggatg

SEQ ID NO: 26867 - DNA, 21 bp, Artificial Sequence
  Synthetic
ctgaaggtggggtctgtttat

SEQ ID NO: 26868 - DNA, 21 bp, Artificial Sequence
  Synthetic
gatagtcgttgggttgctcat

SEQ ID NO: 26869 - DNA, 21 bp, Artificial Sequence
  Synthetic
ttggtgtcgcagggttttcgg

SEQ ID NO: 26870 - DNA, 21 bp, Artificial Sequence
  Synthetic
cgggcggagcggcatgggggt

SEQ ID NO: 26871 - DNA, 21 bp, Artificial Sequence
  Synthetic
tatagtatgcggacggagcgt

SEQ ID NO: 26872 - DNA, 21 bp, Artificial Sequence
  Synthetic
atggagcagcagcgttgggcg

SEQ ID NO: 26873 - DNA, 21 bp, Artificial Sequence
  Synthetic
cgtgcgggtgttttggagcgg

SEQ ID NO: 26874 - DNA, 21 bp, Artificial Sequence
  Synthetic
attaatattcatcggccgcat

SEQ ID NO: 26875 - DNA, 21 bp, Artificial Sequence
  Synthetic
cggggtgatgcggcgctgcgg

SEQ ID NO: 26876 - DNA, 21 bp, Artificial Sequence
  Synthetic
atgaagcctgggtggtcgacg

SEQ ID NO: 26877 - DNA, 21 bp, Artificial Sequence
  Synthetic
tgtcctgcttattcggctgct

SEQ ID NO: 26878 - DNA, 21 bp, Artificial Sequence
  Synthetic
actatgcttggttatgctact

SEQ ID NO: 26879 - DNA, 21 bp, Artificial Sequence
  Synthetic
tatacggtggcgaatggttat

SEQ ID NO: 26880 - DNA, 21 bp, Artificial Sequence
  Synthetic
tttgtgtatggtgctcatttg

SEQ ID NO: 26881 - DNA, 21 bp, Artificial Sequence
  Synthetic
cagctgccgagtcagtattat

SEQ ID NO: 26882 - DNA, 21 bp, Artificial Sequence
  Synthetic
attccgaggcggattgatacg

SEQ ID NO: 26883 - DNA, 21 bp, Artificial Sequence
  Synthetic
ttgtggagtctgggggagccg

SEQ ID NO: 26884 - DNA, 21 bp, Artificial Sequence
  Synthetic
ggtgcggatgtggggccttgg

SEQ ID NO: 26885 - DNA, 21 bp, Artificial Sequence
  Synthetic
aagcgggagggtcgggatttt

SEQ ID NO: 26886 - DNA, 21 bp, Artificial Sequence
  Synthetic
gataggaagctggtgcagctt

SEQ ID NO: 26887 - DNA, 21 bp, Artificial Sequence
  Synthetic
cgtcctctgcagaatgatcgt

SEQ ID NO: 26888 - DNA, 21 bp, Artificial Sequence
  Synthetic
tcttctcgtgaggcgcttagg

SEQ ID NO: 26889 - DNA, 21 bp, Artificial Sequence
  Synthetic
tgggtgactcatggttcggtt

SEQ ID NO: 26890 - DNA, 21 bp, Artificial Sequence
  Synthetic
actcttattagtgggtatcgt

SEQ ID NO: 26891 - DNA, 21 bp, Artificial Sequence
  Synthetic
ctgcgtgatctgggttctcgg

SEQ ID NO: 26892 - DNA, 21 bp, Artificial Sequence
  Synthetic
gcgaggcatggtttttcgagt

SEQ ID NO: 26893 - DNA, 21 bp, Artificial Sequence
  Synthetic
tcgcatattgggcatagttgg

SEQ ID NO: 26894 - DNA, 21 bp, Artificial Sequence
  Synthetic
cgttctattgttgagagttgg

SEQ ID NO: 26895 - DNA, 21 bp, Artificial Sequence
  Synthetic
ggtgtgcatgttgggcattgg

SEQ ID NO: 26896 - DNA, 21 bp, Artificial Sequence
  Synthetic
tcgtatcgtcagggtgctgct

SEQ ID NO: 26897 - DNA, 21 bp, Artificial Sequence
  Synthetic
cagacgtatctgggttatgct

SEQ ID NO: 26898 - DNA, 21 bp, Artificial Sequence
  Synthetic
gaggattggcatcgtagtagt

SEQ ID NO: 26899 - DNA, 21 bp, Artificial Sequence
  Synthetic
tttgctagttatgggtctcag

SEQ ID NO: 26900 - DNA, 21 bp, Artificial Sequence
  Synthetic
tcgtattatactgggtcgtct

SEQ ID NO: 26901 - DNA, 21 bp, Artificial Sequence
  Synthetic
ttgtatcctgctgggtctagt

SEQ ID NO: 26902 - DNA, 21 bp, Artificial Sequence
  Synthetic
cctgtgaatgatgcgcgttgg

SEQ ID NO: 26903 - DNA, 21 bp, Artificial Sequence
  Synthetic
cctatgaattcggggctttgg

SEQ ID NO: 26904 - DNA, 21 bp, Artificial Sequence
  Synthetic
ggtgggagtgtgggtccttgg

SEQ ID NO: 26905 - DNA, 21 bp, Artificial Sequence
  Synthetic
gttgtggagagtcagtattat

SEQ ID NO: 26906 - DNA, 21 bp, Artificial Sequence
  Synthetic
tttgctcagggtttttctact

SEQ ID NO: 26907 - DNA, 21 bp, Artificial Sequence
  Synthetic
aagacgtctgctgagttttgg

SEQ ID NO: 26908 - DNA, 21 bp, Artificial Sequence
  Synthetic
ttggcgactgggtatgctcag

SEQ ID NO: 26909 - DNA, 21 bp, Artificial Sequence
  Synthetic
cataatcagttgcagtctcgt

SEQ ID NO: 26910 - DNA, 21 bp, Artificial Sequence
  Synthetic
gcggttactcatggtagtgcg

SEQ ID NO: 26911 - DNA, 21 bp, Artificial Sequence
  Synthetic
cgtgagtggcagtcggagcgt

SEQ ID NO: 26912 - DNA, 21 bp, Artificial Sequence
  Synthetic
gatgggattgttgtgcggtgg

SEQ ID NO: 26913 - DNA, 21 bp, Artificial Sequence
  Synthetic
aggcagcatgcggattcgaag

SEQ ID NO: 26914 - DNA, 21 bp, Artificial Sequence
  Synthetic
gtggcgcatgggtgggcgagt

SEQ ID NO: 26915 - DNA, 21 bp, Artificial Sequence
  Synthetic
gatattacttataaggggtgg

SEQ ID NO: 26916 - DNA, 21 bp, Artificial Sequence
  Synthetic
tttcctacgcataagggtgcg

SEQ ID NO: 26917 - DNA, 21 bp, Artificial Sequence
  Synthetic
gcgctgattcatggtggttgg

SEQ ID NO: 26918 - DNA, 21 bp, Artificial Sequence
  Synthetic
gagaagtatcaggggagtact

SEQ ID NO: 26919 - DNA, 21 bp, Artificial Sequence
  Synthetic
tttccgagtgataatcgttgg

SEQ ID NO: 26920 - DNA, 21 bp, Artificial Sequence
  Synthetic
aagcattctctttcggctgtt

SEQ ID NO: 26921 - DNA, 21 bp, Artificial Sequence
  Synthetic
cggggggggcttcatagttgt

SEQ ID NO: 26922 - DNA, 21 bp, Artificial Sequence
  Synthetic
gcgatggctggttggtctgct

SEQ ID NO: 26923 - DNA, 21 bp, Artificial Sequence
  Synthetic
gaggttgcgtatgggagtagt

SEQ ID NO: 26924 - DNA, 21 bp, Artificial Sequence
  Synthetic
gtttataggggtggtgcgcag

SEQ ID NO: 26925 - DNA, 21 bp, Artificial Sequence
  Synthetic
cattctgttgggtctatttat

SEQ ID NO: 26926 - DNA, 21 bp, Artificial Sequence
  Synthetic
aatgatgggagttcgcggtgg

SEQ ID NO: 26927 - DNA, 21 bp, Artificial Sequence
  Synthetic
tatgagtggaggggtgcggcg

SEQ ID NO: 26928 - DNA, 21 bp, Artificial Sequence
  Synthetic
ggtcatgcggctggggcgtgg

SEQ ID NO: 26929 - DNA, 21 bp, Artificial Sequence
  Synthetic
aagactgtgggtcagagttgg

SEQ ID NO: 26930 - DNA, 21 bp, Artificial Sequence
  Synthetic
agggcgagtccgtcgcatcat

SEQ ID NO: 26931 - DNA, 21 bp, Artificial Sequence
  Synthetic
cctaatcgtcctgagggtagg

SEQ ID NO: 26932 - DNA, 21 bp, Artificial Sequence
  Synthetic
aatgggcggctgggtcagcat

SEQ ID NO: 26933 - DNA, 21 bp, Artificial Sequence
  Synthetic
ctgcgtgagactgctatgagg

SEQ ID NO: 26934 - DNA, 21 bp, Artificial Sequence
  Synthetic
cggccgaatggtcgggattat

SEQ ID NO: 26935 - DNA, 21 bp, Artificial Sequence
  Synthetic
tgttatcctcagcagatgtgt

SEQ ID NO: 26936 - DNA, 21 bp, Artificial Sequence
  Synthetic
agtgctgcgtcttttaatggg

SEQ ID NO: 26937 - DNA, 21 bp, Artificial Sequence
  Synthetic
atggatttgatgcctacgggt

SEQ ID NO: 26938 - DNA, 21 bp, Artificial Sequence
  Synthetic
cttcggccgattccgcagcat

SEQ ID NO: 26939 - DNA, 21 bp, Artificial Sequence
  Synthetic
gagcatgttatggggtttcgt

SEQ ID NO: 26940 - DNA, 21 bp, Artificial Sequence
  Synthetic
gtttatcatagtattgctctt

SEQ ID NO: 26941 - DNA, 21 bp, Artificial Sequence
  Synthetic
gatgttcttaatatgcgtttt

SEQ ID NO: 26942 - DNA, 21 bp, Artificial Sequence
  Synthetic
acttttaggggtagtgcgagt

SEQ ID NO: 26943 - DNA, 21 bp, Artificial Sequence
  Synthetic
gagaataagggttggtcttct

SEQ ID NO: 26944 - DNA, 21 bp, Artificial Sequence
  Synthetic
gtgaatgagtatgcgtatttt

SEQ ID NO: 26945 - DNA, 21 bp, Artificial Sequence
  Synthetic
gataattggaagctgccgatt

SEQ ID NO: 26946 - DNA, 21 bp, Artificial Sequence
  Synthetic
gcttatgtggctcattcgagt

SEQ ID NO: 26947 - DNA, 21 bp, Artificial Sequence
  Synthetic
ggtgggtatgagggggtttgg

SEQ ID NO: 26948 - DNA, 21 bp, Artificial Sequence
  Synthetic
cttaattatgggggtagtcag

SEQ ID NO: 26949 - DNA, 21 bp, Artificial Sequence
  Synthetic
cttactcatggtgctgcgcag

SEQ ID NO: 26950 - DNA, 21 bp, Artificial Sequence
  Synthetic
gagtggattgggagtgcgtcg

SEQ ID NO: 26951 - DNA, 21 bp, Artificial Sequence
  Synthetic
tggcatctggagaggggttat

SEQ ID NO: 26952 - DNA, 21 bp, Artificial Sequence
  Synthetic
catcttggtccggggtctaag

SEQ ID NO: 26953 - DNA, 21 bp, Artificial Sequence
  Synthetic
ctgcgtactgggtattcgagt

SEQ ID NO: 26954 - DNA, 21 bp, Artificial Sequence
  Synthetic
atgcgtggtaatgttgttatt

SEQ ID NO: 26955 - DNA, 21 bp, Artificial Sequence
  Synthetic
ctgcatcttgggttttctacg

SEQ ID NO: 26956 - DNA, 21 bp, Artificial Sequence
  Synthetic
cataagcttctggaggttcgt

SEQ ID NO: 26957 - DNA, 21 bp, Artificial Sequence
  Synthetic
ctgcggattggttatgcggcg

SEQ ID NO: 26958 - DNA, 21 bp, Artificial Sequence
  Synthetic
gctggtgggcggcctcttctg

SEQ ID NO: 26959 - DNA, 21 bp, Artificial Sequence
  Synthetic
cgtgctacgagtagtatgcat

SEQ ID NO: 26960 - DNA, 21 bp, Artificial Sequence
  Synthetic
cggctttcggcgcatccgcat

SEQ ID NO: 26961 - DNA, 21 bp, Artificial Sequence
  Synthetic
cgtaatgaggtgctgagtcgg

SEQ ID NO: 26962 - DNA, 21 bp, Artificial Sequence
  Synthetic
gagcgtgttttggctacgcgt

SEQ ID NO: 26963 - DNA, 21 bp, Artificial Sequence
  Synthetic
atgcgtaatgggagtgagagg

SEQ ID NO: 26964 - DNA, 21 bp, Artificial Sequence
  Synthetic
catatggctgttaatcataag

SEQ ID NO: 26965 - DNA, 21 bp, Artificial Sequence
  Synthetic
cggcagttggaggctcagaag

SEQ ID NO: 26966 - DNA, 21 bp, Artificial Sequence
  Synthetic
tggacgacgcttggtagtagt

SEQ ID NO: 26967 - DNA, 21 bp, Artificial Sequence
  Synthetic
tggagtgttagtgcgggtcat

SEQ ID NO: 26968 - DNA, 21 bp, Artificial Sequence
  Synthetic
gggactgatcttgctcgttgg

SEQ ID NO: 26969 - DNA, 21 bp, Artificial Sequence
  Synthetic
cggggtgagaatatgtggaag

SEQ ID NO: 26970 - DNA, 21 bp, Artificial Sequence
  Synthetic
cgttttttgtctgatcatgcg

SEQ ID NO: 26971 - DNA, 21 bp, Artificial Sequence
  Synthetic
agggattggggtgctgcgcag

SEQ ID NO: 26972 - DNA, 21 bp, Artificial Sequence
  Synthetic
atggtttctgggtgggcgcag

SEQ ID NO: 26973 - DNA, 21 bp, Artificial Sequence
  Synthetic
gagtatttggggggttcgtct

SEQ ID NO: 26974 - DNA, 21 bp, Artificial Sequence
  Synthetic
gcgacgattggttggtcttcg

SEQ ID NO: 26975 - DNA, 21 bp, Artificial Sequence
  Synthetic
gggcggattgtgcttcagatg

SEQ ID NO: 26976 - DNA, 21 bp, Artificial Sequence
  Synthetic
ggggcggcgaatttttcgtgg

SEQ ID NO: 26977 - DNA, 21 bp, Artificial Sequence
  Synthetic
tataagagtctgccttatgtg

SEQ ID NO: 26978 - DNA, 21 bp, Artificial Sequence
  Synthetic
attaggtatgaggggagtacg

SEQ ID NO: 26979 - DNA, 21 bp, Artificial Sequence
  Synthetic
gggttgtctgagggtcgttgg

SEQ ID NO: 26980 - DNA, 21 bp, Artificial Sequence
  Synthetic
tgggaggttacgtctgggttt

SEQ ID NO: 26981 - DNA, 21 bp, Artificial Sequence
  Synthetic
tgggctcatatggggagttcg

SEQ ID NO: 26982 - DNA, 21 bp, Artificial Sequence
  Synthetic
gcgtttcctggttctgcggcg

SEQ ID NO: 26983 - DNA, 21 bp, Artificial Sequence
  Synthetic
actaagagtattacgtgtact

SEQ ID NO: 26984 - DNA, 21 bp, Artificial Sequence
  Synthetic
tatccgaagtcgagtgagcgg

SEQ ID NO: 26985 - DNA, 21 bp, Artificial Sequence
  Synthetic
ccgaataggcctgagagggcg

SEQ ID NO: 26986 - DNA, 21 bp, Artificial Sequence
  Synthetic
tctagtgcgaatccggctcgg

SEQ ID NO: 26987 - DNA, 21 bp, Artificial Sequence
  Synthetic
aataagtggactattcgtgag

SEQ ID NO: 26988 - DNA, 21 bp, Artificial Sequence
  Synthetic
agtcaggcgcattattcttcg

SEQ ID NO: 26989 - DNA, 21 bp, Artificial Sequence
  Synthetic
tgggcgattgcggttggttat

SEQ ID NO: 26990 - DNA, 21 bp, Artificial Sequence
  Synthetic
aaggatgtgtatgcgcattgg

SEQ ID NO: 26991 - DNA, 21 bp, Artificial Sequence
  Synthetic
tgggggtataggatgtcggat

SEQ ID NO: 26992 - DNA, 21 bp, Artificial Sequence
  Synthetic
tcgtctcatggtttttcgacg

SEQ ID NO: 26993 - DNA, 21 bp, Artificial Sequence
  Synthetic
aatgagcttcggcctggtaag

SEQ ID NO: 26994 - DNA, 21 bp, Artificial Sequence
  Synthetic
atgacgcgtggttatgctggt

SEQ ID NO: 26995 - DNA, 21 bp, Artificial Sequence
  Synthetic
gcgcgtgagtattcttattcg

SEQ ID NO: 26996 - DNA, 21 bp, Artificial Sequence
  Synthetic
aggatggctgtttcgaatcat

SEQ ID NO: 26997 - DNA, 21 bp, Artificial Sequence
  Synthetic
ttgtttgagcgggtggggcgt

SEQ ID NO: 26998 - DNA, 21 bp, Artificial Sequence
  Synthetic
tggaatcagtggggttctgct

SEQ ID NO: 26999 - DNA, 21 bp, Artificial Sequence
  Synthetic
ttgcaggttgggggggcgatg

SEQ ID NO: 27000 - DNA, 21 bp, Artificial Sequence
  Synthetic
gagggttggatgggggcgcag

SEQ ID NO: 27001 - DNA, 21 bp, Artificial Sequence
  Synthetic
gtgggggatcgtccttgtcgg

SEQ ID NO: 27002 - DNA, 21 bp, Artificial Sequence
  Synthetic
ccggtttatgctgcttatgct

SEQ ID NO: 27003 - DNA, 21 bp, Artificial Sequence
  Synthetic
gttcatccttattctagtact

SEQ ID NO: 27004 - DNA, 21 bp, Artificial Sequence
  Synthetic
gagcgtaggcatgctgatttg

SEQ ID NO: 27005 - DNA, 21 bp, Artificial Sequence
  Synthetic
gggatgcatatgggtgcttgg

SEQ ID NO: 27006 - DNA, 21 bp, Artificial Sequence
  Synthetic
tttaaggcgggttatgctacg

SEQ ID NO: 27007 - DNA, 21 bp, Artificial Sequence
  Synthetic
gagtggcatgctggggcgagt

SEQ ID NO: 27008 - DNA, 21 bp, Artificial Sequence
  Synthetic
agtatttatgagaggatgttt

SEQ ID NO: 27009 - DNA, 21 bp, Artificial Sequence
  Synthetic
gatcgtgagactaggtgggcg

SEQ ID NO: 27010 - DNA, 21 bp, Artificial Sequence
  Synthetic
gcgcctcagtggtcgattggt

SEQ ID NO: 27011 - DNA, 21 bp, Artificial Sequence
  Synthetic
agtgtgcgtcttctggcttat

SEQ ID NO: 27012 - DNA, 21 bp, Artificial Sequence
  Synthetic
cctcatctgggttattctgct

SEQ ID NO: 27013 - DNA, 21 bp, Artificial Sequence
  Synthetic
ccttggtcgaataatattttg

SEQ ID NO: 27014 - DNA, 21 bp, Artificial Sequence
  Synthetic
ctgcctcataggactatgttt

SEQ ID NO: 27015 - DNA, 21 bp, Artificial Sequence
  Synthetic
gtgcataggaatctggggtcg

SEQ ID NO: 27016 - DNA, 21 bp, Artificial Sequence
  Synthetic
ggttctcagccttcgtggaat

SEQ ID NO: 27017 - DNA, 21 bp, Artificial Sequence
  Synthetic
tttgtgattggtgagcgtttg

SEQ ID NO: 27018 - DNA, 21 bp, Artificial Sequence
  Synthetic
ggggagcgggctcaggggagg

SEQ ID NO: 27019 - DNA, 21 bp, Artificial Sequence
  Synthetic
ctgattcctcgtggttctgtt

SEQ ID NO: 27020 - DNA, 21 bp, Artificial Sequence
  Synthetic
tgggggacgttggctggtatg

SEQ ID NO: 27021 - DNA, 21 bp, Artificial Sequence
  Synthetic
actacgattggtaggggttgg

SEQ ID NO: 27022 - DNA, 21 bp, Artificial Sequence
  Synthetic
cggacgggtgagaagcagtgg

SEQ ID NO: 27023 - DNA, 21 bp, Artificial Sequence
  Synthetic
gagcctaattggtcttctgcg

SEQ ID NO: 27024 - DNA, 21 bp, Artificial Sequence
  Synthetic
ctggcgtatggtggttttcat

SEQ ID NO: 27025 - DNA, 21 bp, Artificial Sequence
  Synthetic
gagcggtatgcggcgtatgct

SEQ ID NO: 27026 - DNA, 21 bp, Artificial Sequence
  Synthetic
catcatttgggtcctcctcgg

SEQ ID NO: 27027 - DNA, 21 bp, Artificial Sequence
  Synthetic
tatgttactctgcctagggtg

SEQ ID NO: 27028 - DNA, 21 bp, Artificial Sequence
  Synthetic
gcgaagtttgggtattctact

SEQ ID NO: 27029 - DNA, 21 bp, Artificial Sequence
  Synthetic
gctaggtatcaggagcattgg

SEQ ID NO: 27030 - DNA, 21 bp, Artificial Sequence
  Synthetic
cgttataatggggatgcggct

SEQ ID NO: 27031 - DNA, 21 bp, Artificial Sequence
  Synthetic
acggttcgttatgaggcttcg

SEQ ID NO: 27032 - DNA, 21 bp, Artificial Sequence
  Synthetic
tttggggtgctggcgtctctg

SEQ ID NO: 27033 - DNA, 21 bp, Artificial Sequence
  Synthetic
agtgtttttcttggtagtgcg

SEQ ID NO: 27034 - DNA, 21 bp, Artificial Sequence
  Synthetic
atgagtactggtgggttttgg

SEQ ID NO: 27035 - DNA, 21 bp, Artificial Sequence
  Synthetic
ggtttttctttgtcggggtat

SEQ ID NO: 27036 - DNA, 21 bp, Artificial Sequence
  Synthetic
tgggatttggggggttctagg

SEQ ID NO: 27037 - DNA, 21 bp, Artificial Sequence
  Synthetic
tgggctgggatggggtcttcg

SEQ ID NO: 27038 - DNA, 21 bp, Artificial Sequence
  Synthetic
acggcggagtggaagtatggt

SEQ ID NO: 27039 - DNA, 21 bp, Artificial Sequence
  Synthetic
caggcgcctatgcggtatact

SEQ ID NO: 27040 - DNA, 21 bp, Artificial Sequence
  Synthetic
ttgtatattagtgggagtttg

SEQ ID NO: 27041 - DNA, 21 bp, Artificial Sequence
  Synthetic
aggagggatgtgtcggctgcg

SEQ ID NO: 27042 - DNA, 21 bp, Artificial Sequence
  Synthetic
agttggggggcgttggagcgt

SEQ ID NO: 27043 - DNA, 21 bp, Artificial Sequence
  Synthetic
ccgcctgttgttctgcgggat

SEQ ID NO: 27044 - DNA, 21 bp, Artificial Sequence
  Synthetic
agtgatcctgagaagaggtat

SEQ ID NO: 27045 - DNA, 21 bp, Artificial Sequence
  Synthetic
gatgcgggtgggagtcggtgg

SEQ ID NO: 27046 - DNA, 21 bp, Artificial Sequence
  Synthetic
tggggtgtggctcggatgggt

SEQ ID NO: 27047 - DNA, 21 bp, Artificial Sequence
  Synthetic
tctcgtatggggtatagtgct

SEQ ID NO: 27048 - DNA, 21 bp, Artificial Sequence
  Synthetic
ccgatgaatcctcatagggct

SEQ ID NO: 27049 - DNA, 21 bp, Artificial Sequence
  Synthetic
gtgcaggtgcgtctgattaat

SEQ ID NO: 27050 - DNA, 21 bp, Artificial Sequence
  Synthetic
gaggggcatccgggtgcgtgg

SEQ ID NO: 27051 - DNA, 21 bp, Artificial Sequence
  Synthetic
gagattaagtggcagagtagt

SEQ ID NO: 27052 - DNA, 21 bp, Artificial Sequence
  Synthetic
acgtggcatggtagtgcggcg

SEQ ID NO: 27053 - DNA, 21 bp, Artificial Sequence
  Synthetic
aagttttttggtgatcattcg

SEQ ID NO: 27054 - DNA, 21 bp, Artificial Sequence
  Synthetic
gcgtttagtattaggcaggtt

SEQ ID NO: 27055 - DNA, 21 bp, Artificial Sequence
  Synthetic
aataggcctgggttttctcag

SEQ ID NO: 27056 - DNA, 21 bp, Artificial Sequence
  Synthetic
gctccgattcataatacttgg

SEQ ID NO: 27057 - DNA, 21 bp, Artificial Sequence
  Synthetic
gattgggtgaggggttcgacg

SEQ ID NO: 27058 - DNA, 21 bp, Artificial Sequence
  Synthetic
ctgattaggaatatgtcttcg

SEQ ID NO: 27059 - DNA, 21 bp, Artificial Sequence
  Synthetic
gagattcttgcggggtttcgt

SEQ ID NO: 27060 - DNA, 21 bp, Artificial Sequence
  Synthetic
tatgcttcttgggtggagggt

SEQ ID NO: 27061 - DNA, 21 bp, Artificial Sequence
  Synthetic
gagaaggctcatcttctgagg

SEQ ID NO: 27062 - DNA, 21 bp, Artificial Sequence
  Synthetic
gaggtgggttcgtctcggtgg

SEQ ID NO: 27063 - DNA, 21 bp, Artificial Sequence
  Synthetic
gtttatattggtttgagtagt

SEQ ID NO: 27064 - DNA, 21 bp, Artificial Sequence
  Synthetic
ccgtatttgccggcggttcat

SEQ ID NO: 27065 - DNA, 21 bp, Artificial Sequence
  Synthetic
ctgttggcgggtatggctcag

SEQ ID NO: 27066 - DNA, 21 bp, Artificial Sequence
  Synthetic
tggtcgccgcagagtcctcgt

SEQ ID NO: 27067 - DNA, 21 bp, Artificial Sequence
  Synthetic
agtgcgattggttatagtact

SEQ ID NO: 27068 - DNA, 21 bp, Artificial Sequence
  Synthetic
gcgggtgatccggggcgttgg

SEQ ID NO: 27069 - DNA, 21 bp, Artificial Sequence
  Synthetic
cagttttatgagggggcgagg

SEQ ID NO: 27070 - DNA, 21 bp, Artificial Sequence
  Synthetic
gctcagagggatagtctgagg

SEQ ID NO: 27071 - DNA, 21 bp, Artificial Sequence
  Synthetic
cggatgccgagtgggcgggat

SEQ ID NO: 27072 - DNA, 21 bp, Artificial Sequence
  Synthetic
catgggattggtggggtgaag

SEQ ID NO: 27073 - DNA, 21 bp, Artificial Sequence
  Synthetic
gattcgggtgtgtcgcgttgg

SEQ ID NO: 27074 - DNA, 21 bp, Artificial Sequence
  Synthetic
attgaggcgtggacggcggct

SEQ ID NO: 27075 - DNA, 21 bp, Artificial Sequence
  Synthetic
gcgcattctctgtcgtcgtgg

SEQ ID NO: 27076 - DNA, 21 bp, Artificial Sequence
  Synthetic
ctgtggagtggtggtgcgatg

SEQ ID NO: 27077 - DNA, 21 bp, Artificial Sequence
  Synthetic
atgcgtgcgaatgctcattct

SEQ ID NO: 27078 - DNA, 21 bp, Artificial Sequence
  Synthetic
tggatgcaggcttatagtgat

SEQ ID NO: 27079 - DNA, 21 bp, Artificial Sequence
  Synthetic
tggatgcttgggggttctggg

SEQ ID NO: 27080 - DNA, 21 bp, Artificial Sequence
  Synthetic
cagtttgcggggtttagtacg

SEQ ID NO: 27081 - DNA, 21 bp, Artificial Sequence
  Synthetic
tcgactccgtttctgagtagt

SEQ ID NO: 27082 - DNA, 21 bp, Artificial Sequence
  Synthetic
tttgggtcggggtggtctcat

SEQ ID NO: 27083 - DNA, 21 bp, Artificial Sequence
  Synthetic
gatcctaatgttgcgcgttgg

SEQ ID NO: 27084 - DNA, 21 bp, Artificial Sequence
  Synthetic
gtgccgcggatggaggcgcgt

SEQ ID NO: 27085 - DNA, 21 bp, Artificial Sequence
  Synthetic
ttgcttcgtcatgatggtaag

SEQ ID NO: 27086 - DNA, 21 bp, Artificial Sequence
  Synthetic
atgatgcgtatgagtgctcat

SEQ ID NO: 27087 - DNA, 21 bp, Artificial Sequence
  Synthetic
catgctggtatgatgaataag

SEQ ID NO: 27088 - DNA, 21 bp, Artificial Sequence
  Synthetic
gtgtttcatgtgcaggcgatt

SEQ ID NO: 27089 - DNA, 21 bp, Artificial Sequence
  Synthetic
cgggggggtagttgggcggcg

SEQ ID NO: 27090 - DNA, 21 bp, Artificial Sequence
  Synthetic
cgttggcggggtggggaggag

SEQ ID NO: 27091 - DNA, 21 bp, Artificial Sequence
  Synthetic
atgcgggttcctatggcttcg

SEQ ID NO: 27092 - DNA, 21 bp, Artificial Sequence
  Synthetic
cgtggtgttatggtgagtcat

SEQ ID NO: 27093 - DNA, 21 bp, Artificial Sequence
  Synthetic
gagctgcattggggtagttcg

SEQ ID NO: 27094 - DNA, 21 bp, Artificial Sequence
  Synthetic
acgattgtggggcgtatgtgt

SEQ ID NO: 27095 - DNA, 21 bp, Artificial Sequence
  Synthetic
gcgcctcattcgggggcgtgg

SEQ ID NO: 27096 - DNA, 21 bp, Artificial Sequence
  Synthetic
agtaggtgggggatgggtgag

SEQ ID NO: 27097 - DNA, 21 bp, Artificial Sequence
  Synthetic
cgtgagtttgagattccgtat

SEQ ID NO: 27098 - DNA, 21 bp, Artificial Sequence
  Synthetic
catgagaggttgtatagttcg

SEQ ID NO: 27099 - DNA, 21 bp, Artificial Sequence
  Synthetic
gcttattcttatgggagtagt

SEQ ID NO: 27100 - DNA, 21 bp, Artificial Sequence
  Synthetic
attaattatagtgctagtctt

SEQ ID NO: 27101 - DNA, 21 bp, Artificial Sequence
  Synthetic
catatgctgcatgggagtgcg

SEQ ID NO: 27102 - DNA, 21 bp, Artificial Sequence
  Synthetic
gatgttccttggcagattagg

SEQ ID NO: 27103 - DNA, 21 bp, Artificial Sequence
  Synthetic
ggtgctgtggctcagttttgg

SEQ ID NO: 27104 - DNA, 21 bp, Artificial Sequence
  Synthetic
gttgcggtgaattggcatgtg

SEQ ID NO: 27105 - DNA, 21 bp, Artificial Sequence
  Synthetic
gatttgaagtatgcggggtgg

SEQ ID NO: 27106 - DNA, 21 bp, Artificial Sequence
  Synthetic
catcgtactaatccgggggtt

SEQ ID NO: 27107 - DNA, 21 bp, Artificial Sequence
  Synthetic
tggcttgtgccttcggatcgg

SEQ ID NO: 27108 - DNA, 21 bp, Artificial Sequence
  Synthetic
ttgcgggctgggactagtcag

SEQ ID NO: 27109 - DNA, 21 bp, Artificial Sequence
  Synthetic
cgtatggggccttctgctgtt

SEQ ID NO: 27110 - DNA, 21 bp, Artificial Sequence
  Synthetic
actggggagcggtcggggcgt

SEQ ID NO: 27111 - DNA, 21 bp, Artificial Sequence
  Synthetic
catcgtgagaggcctagtctg

SEQ ID NO: 27112 - DNA, 21 bp, Artificial Sequence
  Synthetic
aataattttggggctcagagg

SEQ ID NO: 27113 - DNA, 21 bp, Artificial Sequence
  Synthetic
ccgttgccgcagtatgggtgg

SEQ ID NO: 27114 - DNA, 21 bp, Artificial Sequence
  Synthetic
agtgcgctgtttctgtcttct

SEQ ID NO: 27115 - DNA, 21 bp, Artificial Sequence
  Synthetic
cagcggcatctggggagtacg

SEQ ID NO: 27116 - DNA, 21 bp, Artificial Sequence
  Synthetic
tcgggtgtgactgcgtattgg

SEQ ID NO: 27117 - DNA, 21 bp, Artificial Sequence
  Synthetic
aatgtgtggggtgggtctgtt

SEQ ID NO: 27118 - DNA, 21 bp, Artificial Sequence
  Synthetic
tggggtttgatgattaagact

SEQ ID NO: 27119 - DNA, 21 bp, Artificial Sequence
  Synthetic
ggggataatcgggggacttgg

SEQ ID NO: 27120 - DNA, 21 bp, Artificial Sequence
  Synthetic
ccttggcatagtgggtctgct

SEQ ID NO: 27121 - DNA, 21 bp, Artificial Sequence
  Synthetic
catcagcggcatgctgtggct

SEQ ID NO: 27122 - DNA, 21 bp, Artificial Sequence
  Synthetic
aatatgagggaggcgatgcgg

SEQ ID NO: 27123 - DNA, 21 bp, Artificial Sequence
  Synthetic
ggtgggaatagtcttccgcgt

SEQ ID NO: 27124 - DNA, 21 bp, Artificial Sequence
  Synthetic
ccgcctattattcttgctaag

SEQ ID NO: 27125 - DNA, 21 bp, Artificial Sequence
  Synthetic
tctccttcttgggctattggg

SEQ ID NO: 27126 - DNA, 21 bp, Artificial Sequence
  Synthetic
gattttaggatgggtgcttcg

SEQ ID NO: 27127 - DNA, 21 bp, Artificial Sequence
  Synthetic
gagaggtatagtttggatcgg

SEQ ID NO: 27128 - DNA, 21 bp, Artificial Sequence
  Synthetic
ctggggtctctggagttttat

SEQ ID NO: 27129 - DNA, 21 bp, Artificial Sequence
  Synthetic
aatgcgatggggcggcatatt

SEQ ID NO: 27130 - DNA, 21 bp, Artificial Sequence
  Synthetic
atgtatgagggttcgtggagt

SEQ ID NO: 27131 - DNA, 21 bp, Artificial Sequence
  Synthetic
tctattacgatgcatggttgg

SEQ ID NO: 27132 - DNA, 21 bp, Artificial Sequence
  Synthetic
aagaagggggatagggatggg

SEQ ID NO: 27133 - DNA, 21 bp, Artificial Sequence
  Synthetic
gagtggaagaggaatctgcct

SEQ ID NO: 27134 - DNA, 21 bp, Artificial Sequence
  Synthetic
tttctgcatcgtgaggttctt

SEQ ID NO: 27135 - DNA, 21 bp, Artificial Sequence
  Synthetic
catggggctgttccgcagaag

SEQ ID NO: 27136 - DNA, 21 bp, Artificial Sequence
  Synthetic
ttggtgcagcatgggtataat

SEQ ID NO: 27137 - DNA, 21 bp, Artificial Sequence
  Synthetic
gttccgaattcgagtcgttgg

SEQ ID NO: 27138 - DNA, 21 bp, Artificial Sequence
  Synthetic
aatttgaagggttgtacgaag

SEQ ID NO: 27139 - DNA, 21 bp, Artificial Sequence
  Synthetic
aggaatggtggtgaggctagg

SEQ ID NO: 27140 - DNA, 21 bp, Artificial Sequence
  Synthetic
cgttattctctggggcctgtt

SEQ ID NO: 27141 - DNA, 21 bp, Artificial Sequence
  Synthetic
aaggctttgggtttttcgatg

SEQ ID NO: 27142 - DNA, 21 bp, Artificial Sequence
  Synthetic
tggtcggcgttgggttctgcg

SEQ ID NO: 27143 - DNA, 21 bp, Artificial Sequence
  Synthetic
cgtcaggagcagctggtgcgt

SEQ ID NO: 27144 - DNA, 21 bp, Artificial Sequence
  Synthetic
ccgcgtattgctggtcggaat

SEQ ID NO: 27145 - DNA, 21 bp, Artificial Sequence
  Synthetic
ggtggtgggcttaatcagaag

SEQ ID NO: 27146 - DNA, 21 bp, Artificial Sequence
  Synthetic
ccgagggttggtgctatttat

SEQ ID NO: 27147 - DNA, 21 bp, Artificial Sequence
  Synthetic
actattgttgggtttagtacg

SEQ ID NO: 27148 - DNA, 21 bp, Artificial Sequence
  Synthetic
gctaagggtcagcattctatt

SEQ ID NO: 27149 - DNA, 21 bp, Artificial Sequence
  Synthetic
aagctgggtccgcattcgggt

SEQ ID NO: 27150 - DNA, 21 bp, Artificial Sequence
  Synthetic
ttggcgtttcggggggcttcg

SEQ ID NO: 27151 - DNA, 21 bp, Artificial Sequence
  Synthetic
tcgcgtgtggttggtgagctg

SEQ ID NO: 27152 - DNA, 21 bp, Artificial Sequence
  Synthetic
gatacggatagggctcgttgg

SEQ ID NO: 27153 - DNA, 21 bp, Artificial Sequence
  Synthetic
tttgtttttggtgagacgctt

SEQ ID NO: 27154 - DNA, 21 bp, Artificial Sequence
  Synthetic
gatgcttggcatgggagttcg

SEQ ID NO: 27155 - DNA, 21 bp, Artificial Sequence
  Synthetic
gggctgattaattggagtttt

SEQ ID NO: 27156 - DNA, 21 bp, Artificial Sequence
  Synthetic
ggtgcgtcgaaggggccttgg

SEQ ID NO: 27157 - DNA, 21 bp, Artificial Sequence
  Synthetic
agtaagtgggaggtgcagttt

SEQ ID NO: 27158 - DNA, 21 bp, Artificial Sequence
  Synthetic
atgtggggtgggatgagtacg

SEQ ID NO: 27159 - DNA, 21 bp, Artificial Sequence
  Synthetic
cgtgttgttggtgattctgct

SEQ ID NO: 27160 - DNA, 21 bp, Artificial Sequence
  Synthetic
cttcagacgtgggcgagtagt

SEQ ID NO: 27161 - DNA, 21 bp, Artificial Sequence
  Synthetic
cttttgacggttgctgtggag

SEQ ID NO: 27162 - DNA, 21 bp, Artificial Sequence
  Synthetic
atttctgtgagttctagtggg

SEQ ID NO: 27163 - DNA, 21 bp, Artificial Sequence
  Synthetic
cataggctgctgggtgctgct

SEQ ID NO: 27164 - DNA, 21 bp, Artificial Sequence
  Synthetic
aggcctcagttgctgccgtat

SEQ ID NO: 27165 - DNA, 21 bp, Artificial Sequence
  Synthetic
attcttagtggttatagtctg

SEQ ID NO: 27166 - DNA, 21 bp, Artificial Sequence
  Synthetic
gctatgtatactggtcagtgg

SEQ ID NO: 27167 - DNA, 21 bp, Artificial Sequence
  Synthetic
gtttggcctgctgggagtact

SEQ ID NO: 27168 - DNA, 21 bp, Artificial Sequence
  Synthetic
tcttttaattataaggtttct

SEQ ID NO: 27169 - DNA, 21 bp, Artificial Sequence
  Synthetic
cctgctccttatgtgagtgcg

SEQ ID NO: 27170 - DNA, 21 bp, Artificial Sequence
  Synthetic
ttgtatcttaatttttctgct

SEQ ID NO: 27171 - DNA, 21 bp, Artificial Sequence
  Synthetic
catgctgggtttgctggttgg

SEQ ID NO: 27172 - DNA, 21 bp, Artificial Sequence
  Synthetic
ttgaagcatacggatgggcgt

SEQ ID NO: 27173 - DNA, 21 bp, Artificial Sequence
  Synthetic
ctgcggccggtgagtgatagg

SEQ ID NO: 27174 - DNA, 21 bp, Artificial Sequence
  Synthetic
cgtgttatgggtaatgagcgt

SEQ ID NO: 27175 - DNA, 21 bp, Artificial Sequence
  Synthetic
cgtcgtgttgatatgtctggt

SEQ ID NO: 27176 - DNA, 21 bp, Artificial Sequence
  Synthetic
gcgattccgctgtatggtgcg

SEQ ID NO: 27177 - DNA, 21 bp, Artificial Sequence
  Synthetic
agttggaagctgggtttggat

SEQ ID NO: 27178 - DNA, 21 bp, Artificial Sequence
  Synthetic
tttgagtatttgcgtggggtg

SEQ ID NO: 27179 - DNA, 21 bp, Artificial Sequence
  Synthetic
ttggttgggcatgggtcttcg

SEQ ID NO: 27180 - DNA, 21 bp, Artificial Sequence
  Synthetic
ggtgtttgggggtcgctggct

SEQ ID NO: 27181 - DNA, 21 bp, Artificial Sequence
  Synthetic
cagtttcatggggctgcgtcg

SEQ ID NO: 27182 - DNA, 21 bp, Artificial Sequence
  Synthetic
tttgatactctgcctgctggg

SEQ ID NO: 27183 - DNA, 21 bp, Artificial Sequence
  Synthetic
ccgcataattctgcgtattat

SEQ ID NO: 27184 - DNA, 21 bp, Artificial Sequence
  Synthetic
cagtggcgggatgctcagctt

SEQ ID NO: 27185 - DNA, 21 bp, Artificial Sequence
  Synthetic
ggttggggtactgggcatcat

SEQ ID NO: 27186 - DNA, 21 bp, Artificial Sequence
  Synthetic
tgggggtatcatcctaattcg

SEQ ID NO: 27187 - DNA, 21 bp, Artificial Sequence
  Synthetic
ggtggtaagcatttggcgaat

SEQ ID NO: 27188 - DNA, 21 bp, Artificial Sequence
  Synthetic
gattatcagggtttttcggtt

SEQ ID NO: 27189 - DNA, 21 bp, Artificial Sequence
  Synthetic
aataggaatgaggcgctgaag

SEQ ID NO: 27190 - DNA, 21 bp, Artificial Sequence
  Synthetic
caggctgtttatggtagtgct

SEQ ID NO: 27191 - DNA, 21 bp, Artificial Sequence
  Synthetic
cttaagcagcatggttctact

SEQ ID NO: 27192 - DNA, 21 bp, Artificial Sequence
  Synthetic
aatcatcgtttgttgggtcat

SEQ ID NO: 27193 - DNA, 21 bp, Artificial Sequence
  Synthetic
acgcatcgtccgaatgtgtgt

SEQ ID NO: 27194 - DNA, 21 bp, Artificial Sequence
  Synthetic
ggtcattcgttttggaaggag

SEQ ID NO: 27195 - DNA, 21 bp, Artificial Sequence
  Synthetic
tctgagtatcatgggagttct

SEQ ID NO: 27196 - DNA, 21 bp, Artificial Sequence
  Synthetic
gtgacgcggacgtatcctgtt

SEQ ID NO: 27197 - DNA, 21 bp, Artificial Sequence
  Synthetic
atgactgatcttcagcgttgg

SEQ ID NO: 27198 - DNA, 21 bp, Artificial Sequence
  Synthetic
cgtgttttggatgcttcgcgt

SEQ ID NO: 27199 - DNA, 21 bp, Artificial Sequence
  Synthetic
ccgattgatgctgcgaggtat

SEQ ID NO: 27200 - DNA, 21 bp, Artificial Sequence
  Synthetic
gagcgggttggttattcggtt

SEQ ID NO: 27201 - DNA, 21 bp, Artificial Sequence
  Synthetic
attggtaattatgcggggtgg

SEQ ID NO: 27202 - DNA, 21 bp, Artificial Sequence
  Synthetic
aagaattctaatcaggagagg

SEQ ID NO: 27203 - DNA, 21 bp, Artificial Sequence
  Synthetic
tttcctcaggggagttggaat

SEQ ID NO: 27204 - DNA, 21 bp, Artificial Sequence
  Synthetic
tggagggataatcatcagtgg

SEQ ID NO: 27205 - DNA, 21 bp, Artificial Sequence
  Synthetic
gggttgaggcagtttggtcag

SEQ ID NO: 27206 - DNA, 21 bp, Artificial Sequence
  Synthetic
tggacgctgggtggggggcat

SEQ ID NO: 27207 - DNA, 21 bp, Artificial Sequence
  Synthetic
tggcgtgagcattttagttct

SEQ ID NO: 27208 - DNA, 21 bp, Artificial Sequence
  Synthetic
aggaatgttgggtctatttat

SEQ ID NO: 27209 - DNA, 21 bp, Artificial Sequence
  Synthetic
agttataatttgaaggtgttt

SEQ ID NO: 27210 - DNA, 21 bp, Artificial Sequence
  Synthetic
gggctgtcgcagacgatgtgg

SEQ ID NO: 27211 - DNA, 21 bp, Artificial Sequence
  Synthetic
tgggggcttgatactgggtgg

SEQ ID NO: 27212 - DNA, 21 bp, Artificial Sequence
  Synthetic
tctcctcatgagtctcgttgg

SEQ ID NO: 27213 - DNA, 21 bp, Artificial Sequence
  Synthetic
tcggctatgcattatagttcg

SEQ ID NO: 27214 - DNA, 21 bp, Artificial Sequence
  Synthetic
ggttatgggggttggtcgatg

SEQ ID NO: 27215 - DNA, 21 bp, Artificial Sequence
  Synthetic
actattatgaggcagtgggat

SEQ ID NO: 27216 - DNA, 21 bp, Artificial Sequence
  Synthetic
atgacgtataaggggtgggag

SEQ ID NO: 27217 - DNA, 21 bp, Artificial Sequence
  Synthetic
aaggagtttaggcttccgcag

SEQ ID NO: 27218 - DNA, 21 bp, Artificial Sequence
  Synthetic
ttgctgaagtatgggagtacg

SEQ ID NO: 27219 - DNA, 21 bp, Artificial Sequence
  Synthetic
tttgctgtggagggttcgcgg

SEQ ID NO: 27220 - DNA, 21 bp, Artificial Sequence
  Synthetic
gagaagtgggggcagtcgcag

SEQ ID NO: 27221 - DNA, 21 bp, Artificial Sequence
  Synthetic
cggtttgatttgaggtgggat

SEQ ID NO: 27222 - DNA, 21 bp, Artificial Sequence
  Synthetic
gatgtggctcatggtagttcg

SEQ ID NO: 27223 - DNA, 21 bp, Artificial Sequence
  Synthetic
cttacgcaggggtatagtcag

SEQ ID NO: 27224 - DNA, 21 bp, Artificial Sequence
  Synthetic
gttccttatcgggtgaatgtg

SEQ ID NO: 27225 - DNA, 21 bp, Artificial Sequence
  Synthetic
gtgtatgttccggctgctcag

SEQ ID NO: 27226 - DNA, 21 bp, Artificial Sequence
  Synthetic
ccgcataagaatcctcctggg

SEQ ID NO: 27227 - DNA, 21 bp, Artificial Sequence
  Synthetic
gatggggcgagtatgcgtttt

SEQ ID NO: 27228 - DNA, 21 bp, Artificial Sequence
  Synthetic
ttgtttgttgggcatagtagt

SEQ ID NO: 27229 - DNA, 21 bp, Artificial Sequence
  Synthetic
cagtgggatcggagtttgcat

SEQ ID NO: 27230 - DNA, 21 bp, Artificial Sequence
  Synthetic
ttgcatgcgcagcgtaattgt

SEQ ID NO: 27231 - DNA, 21 bp, Artificial Sequence
  Synthetic
agtcgtcctgcgtggcatgag

SEQ ID NO: 27232 - DNA, 21 bp, Artificial Sequence
  Synthetic
tgggttcttggtacgcctcat

SEQ ID NO: 27233 - DNA, 21 bp, Artificial Sequence
  Synthetic
cgtcgggtgggggatgcgtct

SEQ ID NO: 27234 - DNA, 21 bp, Artificial Sequence
  Synthetic
agtaatgattttgctcgttat

SEQ ID NO: 27235 - DNA, 21 bp, Artificial Sequence
  Synthetic
atgactggtgagtataggtgg

SEQ ID NO: 27236 - DNA, 21 bp, Artificial Sequence
  Synthetic
atttttccggggggttcgatg

SEQ ID NO: 27237 - DNA, 21 bp, Artificial Sequence
  Synthetic
gaggagtggagggggtcgcag

SEQ ID NO: 27238 - DNA, 21 bp, Artificial Sequence
  Synthetic
gttctgcaggttatgtcgctg

SEQ ID NO: 27239 - DNA, 21 bp, Artificial Sequence
  Synthetic
gagcggttgatgggggcggcg

SEQ ID NO: 27240 - DNA, 21 bp, Artificial Sequence
  Synthetic
cgtaggcaggatggggctggt

SEQ ID NO: 27241 - DNA, 21 bp, Artificial Sequence
  Synthetic
gggcctacgtggaatcatacg

SEQ ID NO: 27242 - DNA, 21 bp, Artificial Sequence
  Synthetic
cggtctgttaatgagtctagg

SEQ ID NO: 27243 - DNA, 21 bp, Artificial Sequence
  Synthetic
atggcgcctaggcatcttttt

SEQ ID NO: 27244 - DNA, 21 bp, Artificial Sequence
  Synthetic
aagccgggtagggattatgtt

SEQ ID NO: 27245 - DNA, 21 bp, Artificial Sequence
  Synthetic
gcgaggaatcatcagaatcct

SEQ ID NO: 27246 - DNA, 21 bp, Artificial Sequence
  Synthetic
atggggctgcatattgttagg

SEQ ID NO: 27247 - DNA, 21 bp, Artificial Sequence
  Synthetic
tctcagggtattaaggggcat

SEQ ID NO: 27248 - DNA, 21 bp, Artificial Sequence
  Synthetic
tctaggcatgtgctgccttcg

SEQ ID NO: 27249 - DNA, 21 bp, Artificial Sequence
  Synthetic
gaggagtatcgtttgccgatg

SEQ ID NO: 27250 - DNA, 21 bp, Artificial Sequence
  Synthetic
aataggtggcatgaggttggg

SEQ ID NO: 27251 - DNA, 21 bp, Artificial Sequence
  Synthetic
gggccgtggggttatgctaat

SEQ ID NO: 27252 - DNA, 21 bp, Artificial Sequence
  Synthetic
agttattatgggagttcgagt

SEQ ID NO: 27253 - DNA, 21 bp, Artificial Sequence
  Synthetic
gatcataagtttcattttagt

SEQ ID NO: 27254 - DNA, 21 bp, Artificial Sequence
  Synthetic
gctttttttactgggtcgagt

SEQ ID NO: 27255 - DNA, 21 bp, Artificial Sequence
  Synthetic
caggctatggcgttgcttggt

SEQ ID NO: 27256 - DNA, 21 bp, Artificial Sequence
  Synthetic
ctggagacgggtagtgctgtg

SEQ ID NO: 27257 - DNA, 21 bp, Artificial Sequence
  Synthetic
aggaggcttgtggaggcgggg

SEQ ID NO: 27258 - DNA, 21 bp, Artificial Sequence
  Synthetic
cggcatatgattcattcgggg

SEQ ID NO: 27259 - DNA, 21 bp, Artificial Sequence
  Synthetic
gggcatgggaatagggggttg

SEQ ID NO: 27260 - DNA, 21 bp, Artificial Sequence
  Synthetic
catgggaatccggggaggctt

SEQ ID NO: 27261 - DNA, 21 bp, Artificial Sequence
  Synthetic
atggatcttactaatcgttgg

SEQ ID NO: 27262 - DNA, 21 bp, Artificial Sequence
  Synthetic
attcggcaggtggagactaag

SEQ ID NO: 27263 - DNA, 21 bp, Artificial Sequence
  Synthetic
agtacgattgcggcgcattgg

SEQ ID NO: 27264 - DNA, 21 bp, Artificial Sequence
  Synthetic
catatgatgccggcggcgcgt

SEQ ID NO: 27265 - DNA, 21 bp, Artificial Sequence
  Synthetic
ggtggttatttgttgagttct

SEQ ID NO: 27266 - DNA, 21 bp, Artificial Sequence
  Synthetic
atgtggactagtggggcgagt

SEQ ID NO: 27267 - DNA, 21 bp, Artificial Sequence
  Synthetic
gttcgtccgactggggtgtgg

SEQ ID NO: 27268 - DNA, 21 bp, Artificial Sequence
  Synthetic
ccttatcatggggcggctgcg

SEQ ID NO: 27269 - DNA, 21 bp, Artificial Sequence
  Synthetic
cctaagattgcggcgtcttgg

SEQ ID NO: 27270 - DNA, 21 bp, Artificial Sequence
  Synthetic
attgtgtcgtatggttctgct

SEQ ID NO: 27271 - DNA, 21 bp, Artificial Sequence
  Synthetic
ccttatgttaatttttcggct

SEQ ID NO: 27272 - DNA, 21 bp, Artificial Sequence
  Synthetic
gagaatcgtgcttggagtgtt

SEQ ID NO: 27273 - DNA, 21 bp, Artificial Sequence
  Synthetic
gcttatgagaggtttccgaag

SEQ ID NO: 27274 - DNA, 21 bp, Artificial Sequence
  Synthetic
ggggttccgtgggatagggcg

SEQ ID NO: 27275 - DNA, 21 bp, Artificial Sequence
  Synthetic
tatgttaatttgtatggtatt

SEQ ID NO: 27276 - DNA, 21 bp, Artificial Sequence
  Synthetic
gattcgcaggttgggcgttgg

SEQ ID NO: 27277 - DNA, 21 bp, Artificial Sequence
  Synthetic
gggatttgggggtcggtttcg

SEQ ID NO: 27278 - DNA, 21 bp, Artificial Sequence
  Synthetic
tggggttttccggagcatggg

SEQ ID NO: 27279 - DNA, 21 bp, Artificial Sequence
  Synthetic
tgggatctgcgttatagtgtg

SEQ ID NO: 27280 - DNA, 21 bp, Artificial Sequence
  Synthetic
aatggggggcattctccgagg

SEQ ID NO: 27281 - DNA, 21 bp, Artificial Sequence
  Synthetic
aataatcggcctctgcatttg

SEQ ID NO: 27282 - DNA, 21 bp, Artificial Sequence
  Synthetic
cgtcctccttcgatttcgtgg

SEQ ID NO: 27283 - DNA, 21 bp, Artificial Sequence
  Synthetic
cggcagggtggtcataatgtg

SEQ ID NO: 27284 - DNA, 21 bp, Artificial Sequence
  Synthetic
ggtactcgtatggcttcgtgt

SEQ ID NO: 27285 - DNA, 21 bp, Artificial Sequence
  Synthetic
catacgaatgtggtggggcgt

SEQ ID NO: 27286 - DNA, 21 bp, Artificial Sequence
  Synthetic
gaggcgtggcgtagggatggg

SEQ ID NO: 27287 - DNA, 21 bp, Artificial Sequence
  Synthetic
tgtcagcggcttgggtcttcg

SEQ ID NO: 27288 - DNA, 21 bp, Artificial Sequence
  Synthetic
cgttttcttggggatacggcg

SEQ ID NO: 27289 - DNA, 21 bp, Artificial Sequence
  Synthetic
ctgggtaagccgcattctcag

SEQ ID NO: 27290 - DNA, 21 bp, Artificial Sequence
  Synthetic
tggggtatgctgaataatggt

SEQ ID NO: 27291 - DNA, 21 bp, Artificial Sequence
  Synthetic
catcttcagaagcatgggcag

SEQ ID NO: 27292 - DNA, 21 bp, Artificial Sequence
  Synthetic
aataattttcatgaggctagg

SEQ ID NO: 27293 - DNA, 21 bp, Artificial Sequence
  Synthetic
tggaagatgaggcttgatggg

SEQ ID NO: 27294 - DNA, 21 bp, Artificial Sequence
  Synthetic
tcgcgtgagggttggtctacg

SEQ ID NO: 27295 - DNA, 21 bp, Artificial Sequence
  Synthetic
cggggtcattcggcggatcat

SEQ ID NO: 27296 - DNA, 21 bp, Artificial Sequence
  Synthetic
ggttggaatttgcggacgccg

SEQ ID NO: 27297 - DNA, 21 bp, Artificial Sequence
  Synthetic
ttggttccgagttggagttct

SEQ ID NO: 27298 - DNA, 21 bp, Artificial Sequence
  Synthetic
ggggctgattggagttctcgt

SEQ ID NO: 27299 - DNA, 21 bp, Artificial Sequence
  Synthetic
attcaggttggggagtattgg

SEQ ID NO: 27300 - DNA, 21 bp, Artificial Sequence
  Synthetic
cgtgcttttgatttgaatttt

SEQ ID NO: 27301 - DNA, 21 bp, Artificial Sequence
  Synthetic
ctgcctacgagttggtctccg

SEQ ID NO: 27302 - DNA, 21 bp, Artificial Sequence
  Synthetic
ctttatgttcctcagagtgct

SEQ ID NO: 27303 - DNA, 21 bp, Artificial Sequence
  Synthetic
tttagttataatggggctcag

SEQ ID NO: 27304 - DNA, 21 bp, Artificial Sequence
  Synthetic
gttccgcgtggggatggttgg

SEQ ID NO: 27305 - DNA, 21 bp, Artificial Sequence
  Synthetic
catgcgaatattgtgagtcgg

SEQ ID NO: 27306 - DNA, 21 bp, Artificial Sequence
  Synthetic
ccggcgaatggtgggcggtgg

SEQ ID NO: 27307 - DNA, 21 bp, Artificial Sequence
  Synthetic
acttgggatcgtggtgcgagt

SEQ ID NO: 27308 - DNA, 21 bp, Artificial Sequence
  Synthetic
ggtctgacggcgagtctgtgg

SEQ ID NO: 27309 - DNA, 21 bp, Artificial Sequence
  Synthetic
agtattactatggggtcgtgg

SEQ ID NO: 27310 - DNA, 21 bp, Artificial Sequence
  Synthetic
tatctgaatttttatggggcg

SEQ ID NO: 27311 - DNA, 21 bp, Artificial Sequence
  Synthetic
gagtcgtataagatggcgttt

SEQ ID NO: 27312 - DNA, 21 bp, Artificial Sequence
  Synthetic
attaagcatcttgttggggct

SEQ ID NO: 27313 - DNA, 21 bp, Artificial Sequence
  Synthetic
cagcatacttgggataggccg

SEQ ID NO: 27314 - DNA, 21 bp, Artificial Sequence
  Synthetic
tcgcggcctagtcttactgtg

SEQ ID NO: 27315 - DNA, 21 bp, Artificial Sequence
  Synthetic
ttgccttattctcttcctgtg

SEQ ID NO: 27316 - DNA, 21 bp, Artificial Sequence
  Synthetic
gagcttacgggttctcggtgg

SEQ ID NO: 27317 - DNA, 21 bp, Artificial Sequence
  Synthetic
gtgccggtgtggcgtttgccg

SEQ ID NO: 27318 - DNA, 21 bp, Artificial Sequence
  Synthetic
ccttatgtgccgagtgctcat

SEQ ID NO: 27319 - DNA, 21 bp, Artificial Sequence
  Synthetic
cttcgtcaggggatgagtcag

SEQ ID NO: 27320 - DNA, 21 bp, Artificial Sequence
  Synthetic
cttgctcatacgggttggaat

SEQ ID NO: 27321 - DNA, 21 bp, Artificial Sequence
  Synthetic
ttggtgagtactcagacgtgg

SEQ ID NO: 27322 - DNA, 21 bp, Artificial Sequence
  Synthetic
gggcgtgcggagggtcgttgg

SEQ ID NO: 27323 - DNA, 21 bp, Artificial Sequence
  Synthetic
acgtattatggtggtagtcat

SEQ ID NO: 27324 - DNA, 21 bp, Artificial Sequence
  Synthetic
gttactagggggtttagtact

SEQ ID NO: 27325 - DNA, 21 bp, Artificial Sequence
  Synthetic
gataagccgtggatgagtact

SEQ ID NO: 27326 - DNA, 21 bp, Artificial Sequence
  Synthetic
atgttttatcagggtcaggct

SEQ ID NO: 27327 - DNA, 21 bp, Artificial Sequence
  Synthetic
gagtggccgggggatgctagt

SEQ ID NO: 27328 - DNA, 21 bp, Artificial Sequence
  Synthetic
tgttatcctgctggtgcgtgt

SEQ ID NO: 27329 - DNA, 21 bp, Artificial Sequence
  Synthetic
tgggagtttcatggttctagt

SEQ ID NO: 27330 - DNA, 21 bp, Artificial Sequence
  Synthetic
caggcttcgaattggcataat

SEQ ID NO: 27331 - DNA, 21 bp, Artificial Sequence
  Synthetic
gtggggacgcctgggcgttgg

SEQ ID NO: 27332 - DNA, 21 bp, Artificial Sequence
  Synthetic
ggtggggtgaatcaggggcgt

SEQ ID NO: 27333 - DNA, 21 bp, Artificial Sequence
  Synthetic
aagcgggatgttgagcggaat

SEQ ID NO: 27334 - DNA, 21 bp, Artificial Sequence
  Synthetic
tggtatgctacgaatcttggg

SEQ ID NO: 27335 - DNA, 21 bp, Artificial Sequence
  Synthetic
gagaggcagcggattattgcg

SEQ ID NO: 27336 - DNA, 21 bp, Artificial Sequence
  Synthetic
aagtgggttacgactgatcat

SEQ ID NO: 27337 - DNA, 21 bp, Artificial Sequence
  Synthetic
gggtggcgggttcagcatgat

SEQ ID NO: 27338 - DNA, 21 bp, Artificial Sequence
  Synthetic
acggagacgcctaagcctcgt

SEQ ID NO: 27339 - DNA, 21 bp, Artificial Sequence
  Synthetic
ggttcgcagggtagggcgtgg

SEQ ID NO: 27340 - DNA, 21 bp, Artificial Sequence
  Synthetic
agggggaatgatgtgactcgg

SEQ ID NO: 27341 - DNA, 21 bp, Artificial Sequence
  Synthetic
gggttgaggcaggagttgagg

SEQ ID NO: 27342 - DNA, 21 bp, Artificial Sequence
  Synthetic
cggctggttcgtgttgatcat

SEQ ID NO: 27343 - DNA, 21 bp, Artificial Sequence
  Synthetic
aagacgcatgggcttagtagt

SEQ ID NO: 27344 - DNA, 21 bp, Artificial Sequence
  Synthetic
tatcttgtgcgtgggttgggt

SEQ ID NO: 27345 - DNA, 21 bp, Artificial Sequence
  Synthetic
tcgcatatttattctagtagt

SEQ ID NO: 27346 - DNA, 21 bp, Artificial Sequence
  Synthetic
gggattaatgagaagccgtcg

SEQ ID NO: 27347 - DNA, 21 bp, Artificial Sequence
  Synthetic
tctgagtctattggtaggtgg

SEQ ID NO: 27348 - DNA, 21 bp, Artificial Sequence
  Synthetic
ttttatgatggttattcgagt

SEQ ID NO: 27349 - DNA, 21 bp, Artificial Sequence
  Synthetic
cctgctcatgctgggccttgg

SEQ ID NO: 27350 - DNA, 21 bp, Artificial Sequence
  Synthetic
cttcagaggtgggagagtatg

SEQ ID NO: 27351 - DNA, 21 bp, Artificial Sequence
  Synthetic
acttttattccggcggtgcat

SEQ ID NO: 27352 - DNA, 21 bp, Artificial Sequence
  Synthetic
cgttatcctgggcattcttct

SEQ ID NO: 27353 - DNA, 21 bp, Artificial Sequence
  Synthetic
ctgtatccggggcagagtagt

SEQ ID NO: 27354 - DNA, 21 bp, Artificial Sequence
  Synthetic
aggtttcttggtgatatgctt

SEQ ID NO: 27355 - DNA, 21 bp, Artificial Sequence
  Synthetic
cgtgctactggtcagaattgg

SEQ ID NO: 27356 - DNA, 21 bp, Artificial Sequence
  Synthetic
gggatggggattcataatcgt

SEQ ID NO: 27357 - DNA, 21 bp, Artificial Sequence
  Synthetic
attcggattggtggtgctagt

SEQ ID NO: 27358 - DNA, 21 bp, Artificial Sequence
  Synthetic
ggtgcgcatgtgggtggtcgt

SEQ ID NO: 27359 - DNA, 21 bp, Artificial Sequence
  Synthetic
tttgttctgggttatagtagt

SEQ ID NO: 27360 - DNA, 21 bp, Artificial Sequence
  Synthetic
aagggtcatggtatggttccg

SEQ ID NO: 27361 - DNA, 21 bp, Artificial Sequence
  Synthetic
ccgattattcctgcgggttgg

SEQ ID NO: 27362 - DNA, 21 bp, Artificial Sequence
  Synthetic
gggtggcgtcatgctctggat

SEQ ID NO: 27363 - DNA, 21 bp, Artificial Sequence
  Synthetic
aggggtattgagagtgttagg

SEQ ID NO: 27364 - DNA, 21 bp, Artificial Sequence
  Synthetic
cattttgtgaatcagggtaag

SEQ ID NO: 27365 - DNA, 21 bp, Artificial Sequence
  Synthetic
ggggctctgcttcatattaag

SEQ ID NO: 27366 - DNA, 21 bp, Artificial Sequence
  Synthetic
gagttttttcttggtgcgacg

SEQ ID NO: 27367 - DNA, 21 bp, Artificial Sequence
  Synthetic
tttgcttcttgggtgcagaag

SEQ ID NO: 27368 - DNA, 21 bp, Artificial Sequence
  Synthetic
tttggtgctctggctggttat

SEQ ID NO: 27369 - DNA, 21 bp, Artificial Sequence
  Synthetic
gctagggtgattttgtcggct

SEQ ID NO: 27370 - DNA, 21 bp, Artificial Sequence
  Synthetic
cagtttcatggtggggctgcg

SEQ ID NO: 27371 - DNA, 21 bp, Artificial Sequence
  Synthetic
tttggggttctggaggggctt

SEQ ID NO: 27372 - DNA, 21 bp, Artificial Sequence
  Synthetic
ttgaagagttatggttcgagt

SEQ ID NO: 27373 - DNA, 21 bp, Artificial Sequence
  Synthetic
gatgttagttcgagtaggtgg

SEQ ID NO: 27374 - DNA, 21 bp, Artificial Sequence
  Synthetic
gcggcggttattcagcattgg

SEQ ID NO: 27375 - DNA, 21 bp, Artificial Sequence
  Synthetic
gctagggttaatcctgagtgg

SEQ ID NO: 27376 - DNA, 21 bp, Artificial Sequence
  Synthetic
aagccggcgcggcctatgggt

SEQ ID NO: 27377 - DNA, 21 bp, Artificial Sequence
  Synthetic
ggtcgtacttcgaattgttgt

SEQ ID NO: 27378 - DNA, 21 bp, Artificial Sequence
  Synthetic
cgtcagaataatgctcataat

SEQ ID NO: 27379 - DNA, 21 bp, Artificial Sequence
  Synthetic
cagcgtgggggtggggttaat

SEQ ID NO: 27380 - DNA, 21 bp, Artificial Sequence
  Synthetic
ttggtttatagtcaggttacg

SEQ ID NO: 27381 - DNA, 21 bp, Artificial Sequence
  Synthetic
cgtcttcagcatggtcctgtg

SEQ ID NO: 27382 - DNA, 21 bp, Artificial Sequence
  Synthetic
gtgtgggttcatggtgctgcg

SEQ ID NO: 27383 - DNA, 21 bp, Artificial Sequence
  Synthetic
cgtgggttgcctgagaatcgt

SEQ ID NO: 27384 - DNA, 21 bp, Artificial Sequence
  Synthetic
aagccgcagaggattgatgtg

SEQ ID NO: 27385 - DNA, 21 bp, Artificial Sequence
  Synthetic
cttgtgtttcagggggctagt

SEQ ID NO: 27386 - DNA, 21 bp, Artificial Sequence
  Synthetic
gtgatgaggggtatgtcgtcg

SEQ ID NO: 27387 - DNA, 21 bp, Artificial Sequence
  Synthetic
atggcgtggaatggttcttcg

SEQ ID NO: 27388 - DNA, 21 bp, Artificial Sequence
  Synthetic
cggtggacgggggaggcgtcg

SEQ ID NO: 27389 - DNA, 21 bp, Artificial Sequence
  Synthetic
aattcttatcttgggagtact

SEQ ID NO: 27390 - DNA, 21 bp, Artificial Sequence
  Synthetic
gctaatagttggaatagttgg

SEQ ID NO: 27391 - DNA, 21 bp, Artificial Sequence
  Synthetic
agggcgggttttggtgattgg

SEQ ID NO: 27392 - DNA, 21 bp, Artificial Sequence
  Synthetic
agttttgatttgcggttggtg

SEQ ID NO: 27393 - DNA, 21 bp, Artificial Sequence
  Synthetic
gtgcttgttggtcggtcgggg

SEQ ID NO: 27394 - DNA, 21 bp, Artificial Sequence
  Synthetic
gcgtgggggacttttggtgag

SEQ ID NO: 27395 - DNA, 21 bp, Artificial Sequence
  Synthetic
tatggtctgtatattagtact

SEQ ID NO: 27396 - DNA, 21 bp, Artificial Sequence
  Synthetic
aggactgctgctgcggatcgg

SEQ ID NO: 27397 - DNA, 21 bp, Artificial Sequence
  Synthetic
aatccgggggggcgtgcgcat

SEQ ID NO: 27398 - DNA, 21 bp, Artificial Sequence
  Synthetic
gttcatgggacttggcatgcg

SEQ ID NO: 27399 - DNA, 21 bp, Artificial Sequence
  Synthetic
cgtacgcatatgccgagtgtg

SEQ ID NO: 27400 - DNA, 21 bp, Artificial Sequence
  Synthetic
gctcatcctcagcatccgcgg

SEQ ID NO: 27401 - DNA, 21 bp, Artificial Sequence
  Synthetic
tctagtccttcgcatactttt

SEQ ID NO: 27402 - DNA, 21 bp, Artificial Sequence
  Synthetic
tcgactgtgcgtaatggttgg

SEQ ID NO: 27403 - DNA, 21 bp, Artificial Sequence
  Synthetic
cggtgggagggtgaggggcgt

SEQ ID NO: 27404 - DNA, 21 bp, Artificial Sequence
  Synthetic
tggttggcgggtttttcggcg

SEQ ID NO: 27405 - DNA, 21 bp, Artificial Sequence
  Synthetic
agtaatgctaatatggttcgg

SEQ ID NO: 27406 - DNA, 21 bp, Artificial Sequence
  Synthetic
gtggcggagcgggcgcggctg

SEQ ID NO: 27407 - DNA, 21 bp, Artificial Sequence
  Synthetic
catttgctgagggggtatgct

SEQ ID NO: 27408 - DNA, 21 bp, Artificial Sequence
  Synthetic
tcttttaatgctgctcgtttg

SEQ ID NO: 27409 - DNA, 21 bp, Artificial Sequence
  Synthetic
tggtatgagcatggttcttcg

SEQ ID NO: 27410 - DNA, 21 bp, Artificial Sequence
  Synthetic
tggagtgtttcggcgggttat

SEQ ID NO: 27411 - DNA, 21 bp, Artificial Sequence
  Synthetic
tggtctgctgtgcatggttat

SEQ ID NO: 27412 - DNA, 21 bp, Artificial Sequence
  Synthetic
tggccgaggagtgttagttcg

SEQ ID NO: 27413 - DNA, 21 bp, Artificial Sequence
  Synthetic
aggatgctgtatccgggtggg

SEQ ID NO: 27414 - DNA, 21 bp, Artificial Sequence
  Synthetic
ctgtttgttgctatgagttcg

SEQ ID NO: 27415 - DNA, 21 bp, Artificial Sequence
  Synthetic
agggtgacgatggggtttaat

SEQ ID NO: 27416 - DNA, 21 bp, Artificial Sequence
  Synthetic
ggttcgtctcctggggtgtgg

SEQ ID NO: 27417 - DNA, 21 bp, Artificial Sequence
  Synthetic
gttgatagttggaatcggatt

SEQ ID NO: 27418 - DNA, 21 bp, Artificial Sequence
  Synthetic
gagcatcatagtcctggttgg

SEQ ID NO: 27419 - DNA, 21 bp, Artificial Sequence
  Synthetic
agtcttcattggaaggcggat

SEQ ID NO: 27420 - DNA, 21 bp, Artificial Sequence
  Synthetic
gcgttttattcgggttctcat

SEQ ID NO: 27421 - DNA, 21 bp, Artificial Sequence
  Synthetic
gggggtgatgtgtctaggtgg

SEQ ID NO: 27422 - DNA, 21 bp, Artificial Sequence
  Synthetic
aagtatgagcgggagattgtt

SEQ ID NO: 27423 - DNA, 21 bp, Artificial Sequence
  Synthetic
gggtatgggtctagtagttgg

SEQ ID NO: 27424 - DNA, 21 bp, Artificial Sequence
  Synthetic
ctgtggagtggtgcgtctacg

SEQ ID NO: 27425 - DNA, 21 bp, Artificial Sequence
  Synthetic
cttatggagtatgggagttct

SEQ ID NO: 27426 - DNA, 21 bp, Artificial Sequence
  Synthetic
gtggaggtgggttcggtttat

SEQ ID NO: 27427 - DNA, 21 bp, Artificial Sequence
  Synthetic
ttgatgatggggtatgctagt

SEQ ID NO: 27428 - DNA, 21 bp, Artificial Sequence
  Synthetic
ttgtatcagttgggttcgact

SEQ ID NO: 27429 - DNA, 21 bp, Artificial Sequence
  Synthetic
acggattattctcgttggtcg

SEQ ID NO: 27430 - DNA, 21 bp, Artificial Sequence
  Synthetic
tatatgcttccgggtcctgct

SEQ ID NO: 27431 - DNA, 21 bp, Artificial Sequence
  Synthetic
cagttttatggtagtgctatg

SEQ ID NO: 27432 - DNA, 21 bp, Artificial Sequence
  Synthetic
ttgtatcttaatggtagtacg

SEQ ID NO: 27433 - DNA, 21 bp, Artificial Sequence
  Synthetic
tcggagcgtctgctgccgtat

SEQ ID NO: 27434 - DNA, 21 bp, Artificial Sequence
  Synthetic
tgggggacgttggaggtgtat

SEQ ID NO: 27435 - DNA, 21 bp, Artificial Sequence
  Synthetic
cggttgacggtgacggattgg

SEQ ID NO: 27436 - DNA, 21 bp, Artificial Sequence
  Synthetic
actcagccgagtatttgggct

SEQ ID NO: 27437 - DNA, 21 bp, Artificial Sequence
  Synthetic
ctttctcggggtttgagtcag

SEQ ID NO: 27438 - DNA, 21 bp, Artificial Sequence
  Synthetic
ctgaattattcgttgagtatg

SEQ ID NO: 27439 - DNA, 21 bp, Artificial Sequence
  Synthetic
ctgactatggctaatcataag

SEQ ID NO: 27440 - DNA, 21 bp, Artificial Sequence
  Synthetic
gcgggggtggggtggtctact

SEQ ID NO: 27441 - DNA, 21 bp, Artificial Sequence
  Synthetic
ccgcctaatagtggtgcgtgg

SEQ ID NO: 27442 - DNA, 21 bp, Artificial Sequence
  Synthetic
cggcttgcgaataatggttgg

SEQ ID NO: 27443 - DNA, 21 bp, Artificial Sequence
  Synthetic
tggtcggggcagactttgagg

SEQ ID NO: 27444 - DNA, 21 bp, Artificial Sequence
  Synthetic
tggaatcgggtgggtagtgtg

SEQ ID NO: 27445 - DNA, 21 bp, Artificial Sequence
  Synthetic
atttcggatcctcctcggaag

SEQ ID NO: 27446 - DNA, 21 bp, Artificial Sequence
  Synthetic
catcgtacgaagattgagctt

SEQ ID NO: 27447 - DNA, 21 bp, Artificial Sequence
  Synthetic
gttggtcagtttcttatgcgt

SEQ ID NO: 27448 - DNA, 21 bp, Artificial Sequence
  Synthetic
atgagtcatggtaggattatt

SEQ ID NO: 27449 - DNA, 21 bp, Artificial Sequence
  Synthetic
catgagcttcgtgctattaag

SEQ ID NO: 27450 - DNA, 21 bp, Artificial Sequence
  Synthetic
agggggattatggcgagtgtt

SEQ ID NO: 27451 - DNA, 21 bp, Artificial Sequence
  Synthetic
ggtctgcgggttgagggtagg

SEQ ID NO: 27452 - DNA, 21 bp, Artificial Sequence
  Synthetic
cctttgcatatgggttattcg

SEQ ID NO: 27453 - DNA, 21 bp, Artificial Sequence
  Synthetic
ggtggggtggcggggcattgg

SEQ ID NO: 27454 - DNA, 21 bp, Artificial Sequence
  Synthetic
gaggagcataggtttccgagg

SEQ ID NO: 27455 - DNA, 21 bp, Artificial Sequence
  Synthetic
tcggttgagtctcgttgggcg

SEQ ID NO: 27456 - DNA, 21 bp, Artificial Sequence
  Synthetic
gatcctcctattacgtggcgt

SEQ ID NO: 27457 - DNA, 21 bp, Artificial Sequence
  Synthetic
catcttactgcttgtgttggt

SEQ ID NO: 27458 - DNA, 21 bp, Artificial Sequence
  Synthetic
cggtatgtgggggattcgtcg

SEQ ID NO: 27459 - DNA, 21 bp, Artificial Sequence
  Synthetic
tctcaggttgggtttagttct

SEQ ID NO: 27460 - DNA, 21 bp, Artificial Sequence
  Synthetic
tggcggcgtgttgatgatccg

SEQ ID NO: 27461 - DNA, 21 bp, Artificial Sequence
  Synthetic
cagccgccgtatacgacttgg

SEQ ID NO: 27462 - DNA, 21 bp, Artificial Sequence
  Synthetic
ttgcatttgggtcagtcttcg

SEQ ID NO: 27463 - DNA, 21 bp, Artificial Sequence
  Synthetic
gcggttcgtaatccggagcgt

SEQ ID NO: 27464 - DNA, 21 bp, Artificial Sequence
  Synthetic
cataatgagaataagaataag

SEQ ID NO: 27465 - DNA, 21 bp, Artificial Sequence
  Synthetic
tttcttcatggttattcggag

SEQ ID NO: 27466 - DNA, 21 bp, Artificial Sequence
  Synthetic
ggtggtgtttttatgtcgtct

SEQ ID NO: 27467 - DNA, 21 bp, Artificial Sequence
  Synthetic
gtggtggattatacggggtgg

SEQ ID NO: 27468 - DNA, 21 bp, Artificial Sequence
  Synthetic
gttgggatgcggcttgggtat

SEQ ID NO: 27469 - DNA, 21 bp, Artificial Sequence
  Synthetic
aggaatgatacgtctactcgt

SEQ ID NO: 27470 - DNA, 21 bp, Artificial Sequence
  Synthetic
gagtttatgcgtggttcgagt

SEQ ID NO: 27471 - DNA, 21 bp, Artificial Sequence
  Synthetic
aggggtggtgctggtagggag

SEQ ID NO: 27472 - DNA, 21 bp, Artificial Sequence
  Synthetic
attaggggtggtcatcctcct

SEQ ID NO: 27473 - DNA, 21 bp, Artificial Sequence
  Synthetic
gctccgttgcatcaggggaag

SEQ ID NO: 27474 - DNA, 21 bp, Artificial Sequence
  Synthetic
tggacggcgcatgggagtatg

SEQ ID NO: 27475 - DNA, 21 bp, Artificial Sequence
  Synthetic
tggagtttggataatggtcat

SEQ ID NO: 27476 - DNA, 21 bp, Artificial Sequence
  Synthetic
cttcgtgttgggtgggctagt

SEQ ID NO: 27477 - DNA, 21 bp, Artificial Sequence
  Synthetic
ggtcgtgctagtaatgataag

SEQ ID NO: 27478 - DNA, 21 bp, Artificial Sequence
  Synthetic
aataggactggtgttgagagg

SEQ ID NO: 27479 - DNA, 21 bp, Artificial Sequence
  Synthetic
ttgtcgcatggtcagtctcgt

SEQ ID NO: 27480 - DNA, 21 bp, Artificial Sequence
  Synthetic
tttgttcctgggttttcgagt

SEQ ID NO: 27481 - DNA, 21 bp, Artificial Sequence
  Synthetic
agtcattttggtggggcttcg

SEQ ID NO: 27482 - DNA, 21 bp, Artificial Sequence
  Synthetic
tctgttgcgaattatcatacg

SEQ ID NO: 27483 - DNA, 21 bp, Artificial Sequence
  Synthetic
aggcattgtggtgctccttgt

SEQ ID NO: 27484 - DNA, 21 bp, Artificial Sequence
  Synthetic
aatccgactgtttatcatgtt

SEQ ID NO: 27485 - DNA, 21 bp, Artificial Sequence
  Synthetic
agtggtgcgattaggtgggat

SEQ ID NO: 27486 - DNA, 21 bp, Artificial Sequence
  Synthetic
ctggcgtgggcgggggctcag

SEQ ID NO: 27487 - DNA, 21 bp, Artificial Sequence
  Synthetic
gattataagtgggttgcgcag

SEQ ID NO: 27488 - DNA, 21 bp, Artificial Sequence
  Synthetic
gggtttgggacgtttgcttat

SEQ ID NO: 27489 - DNA, 21 bp, Artificial Sequence
  Synthetic
tatactgttcttacgtttcct

SEQ ID NO: 27490 - DNA, 21 bp, Artificial Sequence
  Synthetic
agggtggattcgcagttttgg

SEQ ID NO: 27491 - DNA, 21 bp, Artificial Sequence
  Synthetic
ccggtgcggcctgggccttgg

SEQ ID NO: 27492 - DNA, 21 bp, Artificial Sequence
  Synthetic
tttggtgttttgagtatggtg

SEQ ID NO: 27493 - DNA, 21 bp, Artificial Sequence
  Synthetic
tatgggtctctgagtatgtat

SEQ ID NO: 27494 - DNA, 21 bp, Artificial Sequence
  Synthetic
gagcattggggtgctgcgcgt

SEQ ID NO: 27495 - DNA, 21 bp, Artificial Sequence
  Synthetic
acgatggctcagtggtcttcg

SEQ ID NO: 27496 - DNA, 21 bp, Artificial Sequence
  Synthetic
ccgagttgggggacgagtagt

SEQ ID NO: 27497 - DNA, 21 bp, Artificial Sequence
  Synthetic
gagaggtataatcagtcgatg

SEQ ID NO: 27498 - DNA, 21 bp, Artificial Sequence
  Synthetic
ggtgggcagaaggttcatggg

SEQ ID NO: 27499 - DNA, 21 bp, Artificial Sequence
  Synthetic
ttgattccggggttttcgttg

SEQ ID NO: 27500 - DNA, 21 bp, Artificial Sequence
  Synthetic
gatggggctgcgagtcggttt

SEQ ID NO: 27501 - DNA, 21 bp, Artificial Sequence
  Synthetic
ctgcattatagtggtgctcag

SEQ ID NO: 27502 - DNA, 21 bp, Artificial Sequence
  Synthetic
tggcctgtgctttcggctaat

SEQ ID NO: 27503 - DNA, 21 bp, Artificial Sequence
  Synthetic
cctcagcatgggggggtgtgg

SEQ ID NO: 27504 - DNA, 21 bp, Artificial Sequence
  Synthetic
gcgagggggtcgccgcgtgat

SEQ ID NO: 27505 - DNA, 21 bp, Artificial Sequence
  Synthetic
ggtaattttaatactgcgaag

SEQ ID NO: 27506 - DNA, 21 bp, Artificial Sequence
  Synthetic
gttgtgcggggttatgctagt

SEQ ID NO: 27507 - DNA, 21 bp, Artificial Sequence
  Synthetic
gaggtgacgggtagtctgtgg

SEQ ID NO: 27508 - DNA, 21 bp, Artificial Sequence
  Synthetic
aggacggatatggcgcattgg

SEQ ID NO: 27509 - DNA, 21 bp, Artificial Sequence
  Synthetic
atgcgtcgggatggtcgggag

SEQ ID NO: 27510 - DNA, 21 bp, Artificial Sequence
  Synthetic
aataatcgggcttatcagggg

SEQ ID NO: 27511 - DNA, 21 bp, Artificial Sequence
  Synthetic
gttgagcggccgcttgggcgt

SEQ ID NO: 27512 - DNA, 21 bp, Artificial Sequence
  Synthetic
gggcgtgggttggggttggcg

SEQ ID NO: 27513 - DNA, 21 bp, Artificial Sequence
  Synthetic
cttggggctgggcttctgcgt

SEQ ID NO: 27514 - DNA, 21 bp, Artificial Sequence
  Synthetic
cggagtgaggcgaatccgaag

SEQ ID NO: 27515 - DNA, 21 bp, Artificial Sequence
  Synthetic
gcggggaggcctgctcgtgag

SEQ ID NO: 27516 - DNA, 21 bp, Artificial Sequence
  Synthetic
tggtctgagtatagtcgtggt

SEQ ID NO: 27517 - DNA, 21 bp, Artificial Sequence
  Synthetic
acgatgtatcgtgggtctatt

SEQ ID NO: 27518 - DNA, 21 bp, Artificial Sequence
  Synthetic
ttgattgggcgggggtttcag

SEQ ID NO: 27519 - DNA, 21 bp, Artificial Sequence
  Synthetic
cagtctcctgataagccttgg

SEQ ID NO: 27520 - DNA, 21 bp, Artificial Sequence
  Synthetic
aggtttgagggtgggaagaat

SEQ ID NO: 27521 - DNA, 21 bp, Artificial Sequence
  Synthetic
tattcgggtgcggttcttcgg

SEQ ID NO: 27522 - DNA, 21 bp, Artificial Sequence
  Synthetic
gatcttcatggtcatgttttt

SEQ ID NO: 27523 - DNA, 21 bp, Artificial Sequence
  Synthetic
ggttggcgtacggatcctgct

SEQ ID NO: 27524 - DNA, 21 bp, Artificial Sequence
  Synthetic
ccgacttggggtgctacgagt

SEQ ID NO: 27525 - DNA, 21 bp, Artificial Sequence
  Synthetic
ctgccttttcatgtgggtgat

SEQ ID NO: 27526 - DNA, 21 bp, Artificial Sequence
  Synthetic
atttatgcgggttatgctgat

SEQ ID NO: 27527 - DNA, 21 bp, Artificial Sequence
  Synthetic
gggtctacgaggcatatgagt

SEQ ID NO: 27528 - DNA, 21 bp, Artificial Sequence
  Synthetic
cataggcttggtgggagtact

SEQ ID NO: 27529 - DNA, 21 bp, Artificial Sequence
  Synthetic
tgggggttggttacgggttat

SEQ ID NO: 27530 - DNA, 21 bp, Artificial Sequence
  Synthetic
gagcggagtgggatgagtcag

SEQ ID NO: 27531 - DNA, 21 bp, Artificial Sequence
  Synthetic
tttcggagtccttcgggtgcg

SEQ ID NO: 27532 - DNA, 21 bp, Artificial Sequence
  Synthetic
ccgcatacgccgggtgcttgg

SEQ ID NO: 27533 - DNA, 21 bp, Artificial Sequence
  Synthetic
aaggatgattatagttattat

SEQ ID NO: 27534 - DNA, 21 bp, Artificial Sequence
  Synthetic
tattcggttgcttcggggtat

SEQ ID NO: 27535 - DNA, 21 bp, Artificial Sequence
  Synthetic
gagcgtcttggtcaggcgcgg

SEQ ID NO: 27536 - DNA, 21 bp, Artificial Sequence
  Synthetic
atggttcatggttattcttct

SEQ ID NO: 27537 - DNA, 21 bp, Artificial Sequence
  Synthetic
cggattgcggagggtatgcgg

SEQ ID NO: 27538 - DNA, 21 bp, Artificial Sequence
  Synthetic
cgttatgttacggcgggtccg

SEQ ID NO: 27539 - DNA, 21 bp, Artificial Sequence
  Synthetic
gagcataagacggcgtattgg

SEQ ID NO: 27540 - DNA, 21 bp, Artificial Sequence
  Synthetic
tcgcgtgttgggtatgctgcg

SEQ ID NO: 27541 - DNA, 21 bp, Artificial Sequence
  Synthetic
aggcaggcgaatgtgatgcat

SEQ ID NO: 27542 - DNA, 21 bp, Artificial Sequence
  Synthetic
tctgataatggtctttggtat

SEQ ID NO: 27543 - DNA, 21 bp, Artificial Sequence
  Synthetic
ttggcttcggagattcggtgg

SEQ ID NO: 27544 - DNA, 21 bp, Artificial Sequence
  Synthetic
aataagtttgcgggtgctcat

SEQ ID NO: 27545 - DNA, 21 bp, Artificial Sequence
  Synthetic
gcgcgtgagattatggctagg

SEQ ID NO: 27546 - DNA, 21 bp, Artificial Sequence
  Synthetic
cgggatatgactactccgagg

SEQ ID NO: 27547 - DNA, 21 bp, Artificial Sequence
  Synthetic
tcgactcatagttcttattgg

SEQ ID NO: 27548 - DNA, 21 bp, Artificial Sequence
  Synthetic
gggcatagttggagtgcttct

SEQ ID NO: 27549 - DNA, 21 bp, Artificial Sequence
  Synthetic
tatggttcgcttatgattcat

SEQ ID NO: 27550 - DNA, 21 bp, Artificial Sequence
  Synthetic
gagaagttttctggggtttgg

SEQ ID NO: 27551 - DNA, 21 bp, Artificial Sequence
  Synthetic
cctattgtgcggcttctgaat

SEQ ID NO: 27552 - DNA, 21 bp, Artificial Sequence
  Synthetic
gatcatgtggggtttgcgtat

SEQ ID NO: 27553 - DNA, 21 bp, Artificial Sequence
  Synthetic
atgccttggaggcctgtgcct

SEQ ID NO: 27554 - DNA, 21 bp, Artificial Sequence
  Synthetic
cggatgagtactgctgagcgt

SEQ ID NO: 27555 - DNA, 21 bp, Artificial Sequence
  Synthetic
ttgttgaggggttatgcggct

SEQ ID NO: 27556 - DNA, 21 bp, Artificial Sequence
  Synthetic
aggcttcagggtgctcgtgat

SEQ ID NO: 27557 - DNA, 21 bp, Artificial Sequence
  Synthetic
gctgggagggggtttagttcg

SEQ ID NO: 27558 - DNA, 21 bp, Artificial Sequence
  Synthetic
cgggatatgacgcgttttgtt

SEQ ID NO: 27559 - DNA, 21 bp, Artificial Sequence
  Synthetic
gggtggaatggtaggggtcct

SEQ ID NO: 27560 - DNA, 21 bp, Artificial Sequence
  Synthetic
aagtttaaggttgagattatt

SEQ ID NO: 27561 - DNA, 21 bp, Artificial Sequence
  Synthetic
agggattggcatcctaatgct

SEQ ID NO: 27562 - DNA, 21 bp, Artificial Sequence
  Synthetic
catggtggtaagagtatgagt

SEQ ID NO: 27563 - DNA, 21 bp, Artificial Sequence
  Synthetic
aattatgttcctagtgggtct

SEQ ID NO: 27564 - DNA, 21 bp, Artificial Sequence
  Synthetic
tatcctcatacggcgacgaag

SEQ ID NO: 27565 - DNA, 21 bp, Artificial Sequence
  Synthetic
aagaatcaggtttggggtccg

SEQ ID NO: 27566 - DNA, 21 bp, Artificial Sequence
  Synthetic
aagaatttgcatgcggtgcag

SEQ ID NO: 27567 - DNA, 21 bp, Artificial Sequence
  Synthetic
catggtcgtaatatgattgct

SEQ ID NO: 27568 - DNA, 21 bp, Artificial Sequence
  Synthetic
gagcgggcgcttgggagtgct

SEQ ID NO: 27569 - DNA, 21 bp, Artificial Sequence
  Synthetic
tatgtggggcttccggcggtg

SEQ ID NO: 27570 - DNA, 21 bp, Artificial Sequence
  Synthetic
atgcagtgggcgagtgctcag

SEQ ID NO: 27571 - DNA, 21 bp, Artificial Sequence
  Synthetic
atggagcattctgggcggtgg

SEQ ID NO: 27572 - DNA, 21 bp, Artificial Sequence
  Synthetic
tatcttgctggttttcatgcg

SEQ ID NO: 27573 - DNA, 21 bp, Artificial Sequence
  Synthetic
cgtgtgccgggttttagttcg

SEQ ID NO: 27574 - DNA, 21 bp, Artificial Sequence
  Synthetic
ggtgcggatacgggtcggtgg

SEQ ID NO: 27575 - DNA, 21 bp, Artificial Sequence
  Synthetic
atgagtcataagttggatcgg

SEQ ID NO: 27576 - DNA, 21 bp, Artificial Sequence
  Synthetic
ctgtatgcgagttgggcgagt

SEQ ID NO: 27577 - DNA, 21 bp, Artificial Sequence
  Synthetic
ttggggtatactagttttaat

SEQ ID NO: 27578 - DNA, 21 bp, Artificial Sequence
  Synthetic
cattctttgcttgggagtacg

SEQ ID NO: 27579 - DNA, 21 bp, Artificial Sequence
  Synthetic
tggaagcttgggagtgggttt

SEQ ID NO: 27580 - DNA, 21 bp, Artificial Sequence
  Synthetic
tggggttatcctgttgtggat

SEQ ID NO: 27581 - DNA, 21 bp, Artificial Sequence
  Synthetic
atgtttagttatgcgtcgtct

SEQ ID NO: 27582 - DNA, 21 bp, Artificial Sequence
  Synthetic
ccgattacgcggcatcatgat

SEQ ID NO: 27583 - DNA, 21 bp, Artificial Sequence
  Synthetic
gggaatcgtaattggggggct

SEQ ID NO: 27584 - DNA, 21 bp, Artificial Sequence
  Synthetic
tggacgatgagggggagtgct

SEQ ID NO: 27585 - DNA, 21 bp, Artificial Sequence
  Synthetic
actcatcatggttatagtgtg

SEQ ID NO: 27586 - DNA, 21 bp, Artificial Sequence
  Synthetic
gggcttcagcggcagtgggat

SEQ ID NO: 27587 - DNA, 21 bp, Artificial Sequence
  Synthetic
atttgggatcatgggcctgcg

SEQ ID NO: 27588 - DNA, 21 bp, Artificial Sequence
  Synthetic
gcttttcttgggggggcggcg

SEQ ID NO: 27589 - DNA, 21 bp, Artificial Sequence
  Synthetic
catcatgtggcgtcggggaag

SEQ ID NO: 27590 - DNA, 21 bp, Artificial Sequence
  Synthetic
cataataggactggtgctggg

SEQ ID NO: 27591 - DNA, 21 bp, Artificial Sequence
  Synthetic
ggggattatcggaatctgttg

SEQ ID NO: 27592 - DNA, 21 bp, Artificial Sequence
  Synthetic
gtgtcgtattcgaggggtctt

SEQ ID NO: 27593 - DNA, 21 bp, Artificial Sequence
  Synthetic
ggtgagtatagggcgtttcat

SEQ ID NO: 27594 - DNA, 21 bp, Artificial Sequence
  Synthetic
ttggcgcatactcatagttgg

SEQ ID NO: 27595 - DNA, 21 bp, Artificial Sequence
  Synthetic
tatggtgttttgtcgatgacg

SEQ ID NO: 27596 - DNA, 21 bp, Artificial Sequence
  Synthetic
tttgttaattgggggcgtgat

SEQ ID NO: 27597 - DNA, 21 bp, Artificial Sequence
  Synthetic
ccgggttttaatgtgatgtgg

SEQ ID NO: 27598 - DNA, 21 bp, Artificial Sequence
  Synthetic
gttgattatactgggaattgg

SEQ ID NO: 27599 - DNA, 21 bp, Artificial Sequence
  Synthetic
acgatggttggttggagtgct

SEQ ID NO: 27600 - DNA, 21 bp, Artificial Sequence
  Synthetic
cttcagtttcgtggggcgact

SEQ ID NO: 27601 - DNA, 21 bp, Artificial Sequence
  Synthetic
cgtgctactgatggtactcgt

SEQ ID NO: 27602 - DNA, 21 bp, Artificial Sequence
  Synthetic
cgggttcaggcgcgtgataat

SEQ ID NO: 27603 - DNA, 21 bp, Artificial Sequence
  Synthetic
cgtgagcttcataataattgg

SEQ ID NO: 27604 - DNA, 21 bp, Artificial Sequence
  Synthetic
tcggctgttgggtattctagt

SEQ ID NO: 27605 - DNA, 21 bp, Artificial Sequence
  Synthetic
aatagggctgatcttgctcgg

SEQ ID NO: 27606 - DNA, 21 bp, Artificial Sequence
  Synthetic
gcttggtctcgggatcatggt

SEQ ID NO: 27607 - DNA, 21 bp, Artificial Sequence
  Synthetic
ggtcgggagactggtgtgtgg

SEQ ID NO: 27608 - DNA, 21 bp, Artificial Sequence
  Synthetic
cataggagtgctcagcagctt

SEQ ID NO: 27609 - DNA, 21 bp, Artificial Sequence
  Synthetic
cggtttgctgatggggttaag

SEQ ID NO: 27610 - DNA, 21 bp, Artificial Sequence
  Synthetic
gagacgggtaggttgacgtgg

SEQ ID NO: 27611 - DNA, 21 bp, Artificial Sequence
  Synthetic
ggtgagcataatggtcgttgg

SEQ ID NO: 27612 - DNA, 21 bp, Artificial Sequence
  Synthetic
agtatgtttaagggttcgact

SEQ ID NO: 27613 - DNA, 21 bp, Artificial Sequence
  Synthetic
gagtgggttccgtcggctagt

SEQ ID NO: 27614 - DNA, 21 bp, Artificial Sequence
  Synthetic
gtgcgtagttttggttcggcg

SEQ ID NO: 27615 - DNA, 21 bp, Artificial Sequence
  Synthetic
gcgcctgtgtggaagcttgat

SEQ ID NO: 27616 - DNA, 21 bp, Artificial Sequence
  Synthetic
tttgagaggttttatagttct

SEQ ID NO: 27617 - DNA, 21 bp, Artificial Sequence
  Synthetic
tttgggtctttgtcggctgtt

SEQ ID NO: 27618 - DNA, 21 bp, Artificial Sequence
  Synthetic
tgggagttgtatgagaggatt

SEQ ID NO: 27619 - DNA, 21 bp, Artificial Sequence
  Synthetic
ggggcttgggctgggtctagt

SEQ ID NO: 27620 - DNA, 21 bp, Artificial Sequence
  Synthetic
catcttggttcgggtcctaag

SEQ ID NO: 27621 - DNA, 21 bp, Artificial Sequence
  Synthetic
cgtgggcatggtaatgcgggg

SEQ ID NO: 27622 - DNA, 21 bp, Artificial Sequence
  Synthetic
atggagcgtatggtgcggttg

SEQ ID NO: 27623 - DNA, 21 bp, Artificial Sequence
  Synthetic
tttgggaaggctgggatgggt

SEQ ID NO: 27624 - DNA, 21 bp, Artificial Sequence
  Synthetic
gggggggagccgcgttggagt

SEQ ID NO: 27625 - DNA, 21 bp, Artificial Sequence
  Synthetic
aggggttatacggattcgtgg

SEQ ID NO: 27626 - DNA, 21 bp, Artificial Sequence
  Synthetic
ggtcttcatgatgggcgttgg

SEQ ID NO: 27627 - DNA, 21 bp, Artificial Sequence
  Synthetic
aagccgatgcatgagcggatg

SEQ ID NO: 27628 - DNA, 21 bp, Artificial Sequence
  Synthetic
tttttgcctaattggtcttct

SEQ ID NO: 27629 - DNA, 21 bp, Artificial Sequence
  Synthetic
tgtaggtatcagggggcgagt

SEQ ID NO: 27630 - DNA, 21 bp, Artificial Sequence
  Synthetic
ccgcggcctgagtttagtgct

SEQ ID NO: 27631 - DNA, 21 bp, Artificial Sequence
  Synthetic
aggtatgctcaggatagttct

SEQ ID NO: 27632 - DNA, 21 bp, Artificial Sequence
  Synthetic
ggtatgcatgcggggtcgtgg

SEQ ID NO: 27633 - DNA, 21 bp, Artificial Sequence
  Synthetic
gtgcattatcaggggtctagt

SEQ ID NO: 27634 - DNA, 21 bp, Artificial Sequence
  Synthetic
atggttcagcattctcattgg

SEQ ID NO: 27635 - DNA, 21 bp, Artificial Sequence
  Synthetic
gaggggttgccgtggacttat

SEQ ID NO: 27636 - DNA, 21 bp, Artificial Sequence
  Synthetic
gctggtgttggttctgtttat

SEQ ID NO: 27637 - DNA, 21 bp, Artificial Sequence
  Synthetic
ggttatattgggggttcgagt

SEQ ID NO: 27638 - DNA, 21 bp, Artificial Sequence
  Synthetic
tatgagaattttcgttattcg

SEQ ID NO: 27639 - DNA, 21 bp, Artificial Sequence
  Synthetic
cgtgcgtatgatctgaatccg

SEQ ID NO: 27640 - DNA, 21 bp, Artificial Sequence
  Synthetic
gagtctgcgtggtcgcatcat

SEQ ID NO: 27641 - DNA, 21 bp, Artificial Sequence
  Synthetic
ggggttaatttgggtaggtgg

SEQ ID NO: 27642 - DNA, 21 bp, Artificial Sequence
  Synthetic
gaggtgggttatggtagtgcg

SEQ ID NO: 27643 - DNA, 21 bp, Artificial Sequence
  Synthetic
acggcgttgctgtattcggcg

SEQ ID NO: 27644 - DNA, 21 bp, Artificial Sequence
  Synthetic
ccgccttatgatgctgggcgg

SEQ ID NO: 27645 - DNA, 21 bp, Artificial Sequence
  Synthetic
cctgattttaatcgtaattgg

SEQ ID NO: 27646 - DNA, 21 bp, Artificial Sequence
  Synthetic
gagtggcctggtagggcgtcg

SEQ ID NO: 27647 - DNA, 21 bp, Artificial Sequence
  Synthetic
cctatgactcatgggacgtgg

SEQ ID NO: 27648 - DNA, 21 bp, Artificial Sequence
  Synthetic
gctttgaatgatgctaggtgg

SEQ ID NO: 27649 - DNA, 21 bp, Artificial Sequence
  Synthetic
gcgcggctggttgagggtagg

SEQ ID NO: 27650 - DNA, 21 bp, Artificial Sequence
  Synthetic
atgagggcgccgtattgggag

SEQ ID NO: 27651 - DNA, 21 bp, Artificial Sequence
  Synthetic
cttttttcgatggggagttct

SEQ ID NO: 27652 - DNA, 21 bp, Artificial Sequence
  Synthetic
tttgataagcagacttttagg

SEQ ID NO: 27653 - DNA, 21 bp, Artificial Sequence
  Synthetic
agtaggcagtttgattttgtg

SEQ ID NO: 27654 - DNA, 21 bp, Artificial Sequence
  Synthetic
agtgcgcgttttatgtcggct

SEQ ID NO: 27655 - DNA, 21 bp, Artificial Sequence
  Synthetic
cctgttattgttctgtcggct

SEQ ID NO: 27656 - DNA, 21 bp, Artificial Sequence
  Synthetic
tggggtccggctcgtcagggt

SEQ ID NO: 27657 - DNA, 21 bp, Artificial Sequence
  Synthetic
tgggcgaattatggtagtagt

SEQ ID NO: 27658 - DNA, 21 bp, Artificial Sequence
  Synthetic
ccgaggtatggtagtagttct

SEQ ID NO: 27659 - DNA, 21 bp, Artificial Sequence
  Synthetic
gattttaggagtccggggtgg

SEQ ID NO: 27660 - DNA, 21 bp, Artificial Sequence
  Synthetic
gctggtggtccttggaagggg

SEQ ID NO: 27661 - DNA, 21 bp, Artificial Sequence
  Synthetic
cgttatagtttgaatggtggg

SEQ ID NO: 27662 - DNA, 21 bp, Artificial Sequence
  Synthetic
gagcatgggtctaatcggtgg

SEQ ID NO: 27663 - DNA, 21 bp, Artificial Sequence
  Synthetic
tgggtggtggggacgcatcat

SEQ ID NO: 27664 - DNA, 21 bp, Artificial Sequence
  Synthetic
tggaattctcatcctgatcgt

SEQ ID NO: 27665 - DNA, 21 bp, Artificial Sequence
  Synthetic
ggtactcatccttcttattat

SEQ ID NO: 27666 - DNA, 21 bp, Artificial Sequence
  Synthetic
cctccggggcatgattggcgg

SEQ ID NO: 27667 - DNA, 21 bp, Artificial Sequence
  Synthetic
actttttcggagcatcgttgg

SEQ ID NO: 27668 - DNA, 21 bp, Artificial Sequence
  Synthetic
atggggcatgctccggctcgt

SEQ ID NO: 27669 - DNA, 21 bp, Artificial Sequence
  Synthetic
gcgggtagtagtaggtgggat

SEQ ID NO: 27670 - DNA, 21 bp, Artificial Sequence
  Synthetic
catccttatcggctgacggat

SEQ ID NO: 27671 - DNA, 21 bp, Artificial Sequence
  Synthetic
ctgatgaggtttgaggcgagt

SEQ ID NO: 27672 - DNA, 21 bp, Artificial Sequence
  Synthetic
agtgggagtcctgggcggtgg

SEQ ID NO: 27673 - DNA, 21 bp, Artificial Sequence
  Synthetic
gagcgttttcaggggagtagt

SEQ ID NO: 27674 - DNA, 21 bp, Artificial Sequence
  Synthetic
gtgtcggagtggagttatcat

SEQ ID NO: 27675 - DNA, 21 bp, Artificial Sequence
  Synthetic
acgactattgggtatagttcg

SEQ ID NO: 27676 - DNA, 21 bp, Artificial Sequence
  Synthetic
tggggttatgttgggagtggt

SEQ ID NO: 27677 - DNA, 21 bp, Artificial Sequence
  Synthetic
ttggagacgtggaatcgggct

SEQ ID NO: 27678 - DNA, 21 bp, Artificial Sequence
  Synthetic
ggtcgtcagggggcggctaat

SEQ ID NO: 27679 - DNA, 21 bp, Artificial Sequence
  Synthetic
tggactcctgagatgaagcgg

SEQ ID NO: 27680 - DNA, 21 bp, Artificial Sequence
  Synthetic
tggacgaagcaggaggggtat

SEQ ID NO: 27681 - DNA, 21 bp, Artificial Sequence
  Synthetic
gcgttgtattctctgcctact

SEQ ID NO: 27682 - DNA, 21 bp, Artificial Sequence
  Synthetic
acggagccttgggcgagttcg

SEQ ID NO: 27683 - DNA, 21 bp, Artificial Sequence
  Synthetic
ggggttaatcgtggtctgttt

SEQ ID NO: 27684 - DNA, 21 bp, Artificial Sequence
  Synthetic
aagactattcatacggagagg

SEQ ID NO: 27685 - DNA, 21 bp, Artificial Sequence
  Synthetic
atgaagggggttcctagtcat

SEQ ID NO: 27686 - DNA, 21 bp, Artificial Sequence
  Synthetic
catggtcagggtcgtcatgag

SEQ ID NO: 27687 - DNA, 21 bp, Artificial Sequence
  Synthetic
atgcatcattatgttagtcag

SEQ ID NO: 27688 - DNA, 21 bp, Artificial Sequence
  Synthetic
aatagggtttttggtgcgtcg

SEQ ID NO: 27689 - DNA, 21 bp, Artificial Sequence
  Synthetic
tatgcttatcttggggcggct

SEQ ID NO: 27690 - DNA, 21 bp, Artificial Sequence
  Synthetic
ggtcgtgtgtgtattgggtgt

SEQ ID NO: 27691 - DNA, 21 bp, Artificial Sequence
  Synthetic
gtgggttataggctggctcct

SEQ ID NO: 27692 - DNA, 21 bp, Artificial Sequence
  Synthetic
ttggtttataagggttcgcag

SEQ ID NO: 27693 - DNA, 21 bp, Artificial Sequence
  Synthetic
cctgtgtgggggggtacgtcg

SEQ ID NO: 27694 - DNA, 21 bp, Artificial Sequence
  Synthetic
ctgtatccggctcatagttct

SEQ ID NO: 27695 - DNA, 21 bp, Artificial Sequence
  Synthetic
atggggtatctgatgtctagt

SEQ ID NO: 27696 - DNA, 21 bp, Artificial Sequence
  Synthetic
atgtggattggtaatgcggcg

SEQ ID NO: 27697 - DNA, 21 bp, Artificial Sequence
  Synthetic
cagctgttgagggggtttggg

SEQ ID NO: 27698 - DNA, 21 bp, Artificial Sequence
  Synthetic
gatggtgtgcattgggcgttt

SEQ ID NO: 27699 - DNA, 21 bp, Artificial Sequence
  Synthetic
actgatcatggttatagtagt

SEQ ID NO: 27700 - DNA, 21 bp, Artificial Sequence
  Synthetic
gagaggcttggttattcgtct

SEQ ID NO: 27701 - DNA, 21 bp, Artificial Sequence
  Synthetic
gtttatcctaatgcttatttt

SEQ ID NO: 27702 - DNA, 21 bp, Artificial Sequence
  Synthetic
gaggtgtggagtggttcggtg

SEQ ID NO: 27703 - DNA, 21 bp, Artificial Sequence
  Synthetic
gatgtgtggcttggtgctagt

SEQ ID NO: 27704 - DNA, 21 bp, Artificial Sequence
  Synthetic
gatgttaatactgcgaggtgg

SEQ ID NO: 27705 - DNA, 21 bp, Artificial Sequence
  Synthetic
ggtactattcggttgattaat

SEQ ID NO: 27706 - DNA, 21 bp, Artificial Sequence
  Synthetic
ccttgtgggacgtgttcttcg

SEQ ID NO: 27707 - DNA, 21 bp, Artificial Sequence
  Synthetic
cgtgattttgatgcgtttcgt

SEQ ID NO: 27708 - DNA, 21 bp, Artificial Sequence
  Synthetic
cttgagtgggggcaggcttat

SEQ ID NO: 27709 - DNA, 21 bp, Artificial Sequence
  Synthetic
tggggtttgtttgcttcgagt

SEQ ID NO: 27710 - DNA, 21 bp, Artificial Sequence
  Synthetic
cagttgcatacgggggcgtgg

SEQ ID NO: 27711 - DNA, 21 bp, Artificial Sequence
  Synthetic
ctttggagtggggcttcgacg

SEQ ID NO: 27712 - DNA, 21 bp, Artificial Sequence
  Synthetic
gcgcagattatgttggtgaag

SEQ ID NO: 27713 - DNA, 21 bp, Artificial Sequence
  Synthetic
cataataattatgctctgtat

SEQ ID NO: 27714 - DNA, 21 bp, Artificial Sequence
  Synthetic
atgcggacgtgggttagtgag

SEQ ID NO: 27715 - DNA, 21 bp, Artificial Sequence
  Synthetic
gtgggtgtgttgtataggtct

SEQ ID NO: 27716 - DNA, 21 bp, Artificial Sequence
  Synthetic
tatctggcgggttttaatggg

SEQ ID NO: 27717 - DNA, 21 bp, Artificial Sequence
  Synthetic
ggtgcgcgggaggcggcgcgt

SEQ ID NO: 27718 - DNA, 21 bp, Artificial Sequence
  Synthetic
tttcgtgctcttgttcagtcg

SEQ ID NO: 27719 - DNA, 21 bp, Artificial Sequence
  Synthetic
aggaagatggagggtgtttat

SEQ ID NO: 27720 - DNA, 21 bp, Artificial Sequence
  Synthetic
cggcagaagcctgatggtgct

SEQ ID NO: 27721 - DNA, 21 bp, Artificial Sequence
  Synthetic
tgggttcatggtggtgcgtcg

SEQ ID NO: 27722 - DNA, 21 bp, Artificial Sequence
  Synthetic
gttgtgctgcagcgttttgcg

SEQ ID NO: 27723 - DNA, 21 bp, Artificial Sequence
  Synthetic
actaatgtgacttcgatgtgg

SEQ ID NO: 27724 - DNA, 21 bp, Artificial Sequence
  Synthetic
atgaagggtccgagggattat

SEQ ID NO: 27725 - DNA, 21 bp, Artificial Sequence
  Synthetic
gtgagtctgggtatgcagtgg

SEQ ID NO: 27726 - DNA, 21 bp, Artificial Sequence
  Synthetic
atggcgattatgggtagttcg

SEQ ID NO: 27727 - DNA, 21 bp, Artificial Sequence
  Synthetic
cctcatggtgcggctatgtgg

SEQ ID NO: 27728 - DNA, 21 bp, Artificial Sequence
  Synthetic
gataggtggcatcttgattct

SEQ ID NO: 27729 - DNA, 21 bp, Artificial Sequence
  Synthetic
ctgatgcggtatgggcagacg

SEQ ID NO: 27730 - DNA, 21 bp, Artificial Sequence
  Synthetic
ctgaggcgggagccgaaggat

SEQ ID NO: 27731 - DNA, 21 bp, Artificial Sequence
  Synthetic
ctgaatcctcattggtcgagt

SEQ ID NO: 27732 - DNA, 21 bp, Artificial Sequence
  Synthetic
atgcgttgggagggtagttcg

SEQ ID NO: 27733 - DNA, 21 bp, Artificial Sequence
  Synthetic
gagtctgtgcggactctgtgg

SEQ ID NO: 27734 - DNA, 21 bp, Artificial Sequence
  Synthetic
gcttatcctggtacgtcttct

SEQ ID NO: 27735 - DNA, 21 bp, Artificial Sequence
  Synthetic
tatgggtctcttgcggctttt

SEQ ID NO: 27736 - DNA, 21 bp, Artificial Sequence
  Synthetic
gtgttggttggttataatgtt

SEQ ID NO: 27737 - DNA, 21 bp, Artificial Sequence
  Synthetic
tttgattctcggtttagtagt

SEQ ID NO: 27738 - DNA, 21 bp, Artificial Sequence
  Synthetic
gatgtgtatcggggttcgagt

SEQ ID NO: 27739 - DNA, 21 bp, Artificial Sequence
  Synthetic
acgaatcaggtttggggtgcg

SEQ ID NO: 27740 - DNA, 21 bp, Artificial Sequence
  Synthetic
actcatcctactgattattat

SEQ ID NO: 27741 - DNA, 21 bp, Artificial Sequence
  Synthetic
atgtatgatttgtatcggccg

SEQ ID NO: 27742 - DNA, 21 bp, Artificial Sequence
  Synthetic
attgctacgtatggtagttct

SEQ ID NO: 27743 - DNA, 21 bp, Artificial Sequence
  Synthetic
ttttctagtttgttttctcat

SEQ ID NO: 27744 - DNA, 21 bp, Artificial Sequence
  Synthetic
tgggcgttgaagacgggtttt

SEQ ID NO: 27745 - DNA, 21 bp, Artificial Sequence
  Synthetic
tggcagggtaatggtcggccg

SEQ ID NO: 27746 - DNA, 21 bp, Artificial Sequence
  Synthetic
tctgggccgagggagtggact

SEQ ID NO: 27747 - DNA, 21 bp, Artificial Sequence
  Synthetic
ctttttgcgcatggttcggct

SEQ ID NO: 27748 - DNA, 21 bp, Artificial Sequence
  Synthetic
agttctggttcgtgggcgtat

SEQ ID NO: 27749 - DNA, 21 bp, Artificial Sequence
  Synthetic
ccgattgggggtagttttcgt

SEQ ID NO: 27750 - DNA, 21 bp, Artificial Sequence
  Synthetic
cctaggtcttttggttcggct

SEQ ID NO: 27751 - DNA, 21 bp, Artificial Sequence
  Synthetic
aggtttgctactacgaataat

SEQ ID NO: 27752 - DNA, 21 bp, Artificial Sequence
  Synthetic
agttggcatggtttggagagg

SEQ ID NO: 27753 - DNA, 21 bp, Artificial Sequence
  Synthetic
agtacgtatgggcagggttgg

SEQ ID NO: 27754 - DNA, 21 bp, Artificial Sequence
  Synthetic
tggtttcctggtggggctagt

SEQ ID NO: 27755 - DNA, 21 bp, Artificial Sequence
  Synthetic
catgctcaggatcttaggcgg

SEQ ID NO: 27756 - DNA, 21 bp, Artificial Sequence
  Synthetic
atggggtctcgtggtggggct

SEQ ID NO: 27757 - DNA, 21 bp, Artificial Sequence
  Synthetic
tgggtttatggtacggatgtt

SEQ ID NO: 27758 - DNA, 21 bp, Artificial Sequence
  Synthetic
tgggttggtctgccgaatctg

SEQ ID NO: 27759 - DNA, 21 bp, Artificial Sequence
  Synthetic
tggaggtcgactggtacgttg

SEQ ID NO: 27760 - DNA, 21 bp, Artificial Sequence
  Synthetic
gagaggcagcataattggatt

SEQ ID NO: 27761 - DNA, 21 bp, Artificial Sequence
  Synthetic
cttcggcagcattgggcggat

SEQ ID NO: 27762 - DNA, 21 bp, Artificial Sequence
  Synthetic
atttatcatcctaatctgggg

SEQ ID NO: 27763 - DNA, 21 bp, Artificial Sequence
  Synthetic
atggtgggttttggtagttct

SEQ ID NO: 27764 - DNA, 21 bp, Artificial Sequence
  Synthetic
cctgtgtggggtactgggact

SEQ ID NO: 27765 - DNA, 21 bp, Artificial Sequence
  Synthetic
ctgcgtggtacggagtgggct

SEQ ID NO: 27766 - DNA, 21 bp, Artificial Sequence
  Synthetic
gaggtgaagttttattctagt

SEQ ID NO: 27767 - DNA, 21 bp, Artificial Sequence
  Synthetic
ggtgatcctccggggaggtgg

SEQ ID NO: 27768 - DNA, 21 bp, Artificial Sequence
  Synthetic
tcgcatcctcattttagtagt

SEQ ID NO: 27769 - DNA, 21 bp, Artificial Sequence
  Synthetic
ttgcattcgttgttgagttcg

SEQ ID NO: 27770 - DNA, 21 bp, Artificial Sequence
  Synthetic
gatcggtcgtggggggcgcat

SEQ ID NO: 27771 - DNA, 21 bp, Artificial Sequence
  Synthetic
gtgtctcctgtttggtcgtcg

SEQ ID NO: 27772 - DNA, 21 bp, Artificial Sequence
  Synthetic
cctcttgtgcctgagcggcgg

SEQ ID NO: 27773 - DNA, 21 bp, Artificial Sequence
  Synthetic
cgtggtgatcggatggtgttt

SEQ ID NO: 27774 - DNA, 21 bp, Artificial Sequence
  Synthetic
gttgctctgagtgggcattgg

SEQ ID NO: 27775 - DNA, 21 bp, Artificial Sequence
  Synthetic
tggaggttggggggttcggcg

SEQ ID NO: 27776 - DNA, 21 bp, Artificial Sequence
  Synthetic
tttaagtatagtattggtggt

SEQ ID NO: 27777 - DNA, 21 bp, Artificial Sequence
  Synthetic
gttaggggttatggtagtagt

SEQ ID NO: 27778 - DNA, 21 bp, Artificial Sequence
  Synthetic
cttgctgagggtctttggaat

SEQ ID NO: 27779 - DNA, 21 bp, Artificial Sequence
  Synthetic
cgtatggatggggataagcgt

SEQ ID NO: 27780 - DNA, 21 bp, Artificial Sequence
  Synthetic
acgttgggtgagacgaggtgg

SEQ ID NO: 27781 - DNA, 21 bp, Artificial Sequence
  Synthetic
tggtatctgggtgggagtggg

SEQ ID NO: 27782 - DNA, 21 bp, Artificial Sequence
  Synthetic
cgttttagtggtcctccgctt

SEQ ID NO: 27783 - DNA, 21 bp, Artificial Sequence
  Synthetic
gtgcgtattcagctgcaggct

SEQ ID NO: 27784 - DNA, 21 bp, Artificial Sequence
  Synthetic
ggtgcggatagtgcgaggtat

SEQ ID NO: 27785 - DNA, 21 bp, Artificial Sequence
  Synthetic
tgggcttctcatactcctaag

SEQ ID NO: 27786 - DNA, 21 bp, Artificial Sequence
  Synthetic
aggcttactattgaggggagg

SEQ ID NO: 27787 - DNA, 21 bp, Artificial Sequence
  Synthetic
cgtctgattaatcatgctatt

SEQ ID NO: 27788 - DNA, 21 bp, Artificial Sequence
  Synthetic
tcgcgtgtgggtctgtctcag

SEQ ID NO: 27789 - DNA, 21 bp, Artificial Sequence
  Synthetic
ttgtattctttggggtatcct

SEQ ID NO: 27790 - DNA, 21 bp, Artificial Sequence
  Synthetic
gttcgtcagtggtctatggat

SEQ ID NO: 27791 - DNA, 21 bp, Artificial Sequence
  Synthetic
ggtcgtattcctagttatagt

SEQ ID NO: 27792 - DNA, 21 bp, Artificial Sequence
  Synthetic
ccgtttactattcgggctatt

SEQ ID NO: 27793 - DNA, 21 bp, Artificial Sequence
  Synthetic
acttcgcatgctacttggaat

SEQ ID NO: 27794 - DNA, 21 bp, Artificial Sequence
  Synthetic
gcgcagcgggcgggtagttgg

SEQ ID NO: 27795 - DNA, 21 bp, Artificial Sequence
  Synthetic
gggactagggagacttattgg

SEQ ID NO: 27796 - DNA, 21 bp, Artificial Sequence
  Synthetic
gtggagtatcatggtagtgcg

SEQ ID NO: 27797 - DNA, 21 bp, Artificial Sequence
  Synthetic
cttgagaggtggcctcgggag

SEQ ID NO: 27798 - DNA, 21 bp, Artificial Sequence
  Synthetic
aagcaggttattttgagtaat

SEQ ID NO: 27799 - DNA, 21 bp, Artificial Sequence
  Synthetic
aatactgtggtgcgttgggag

SEQ ID NO: 27800 - DNA, 21 bp, Artificial Sequence
  Synthetic
ttgacgtttagtgtgggtatg

SEQ ID NO: 27801 - DNA, 21 bp, Artificial Sequence
  Synthetic
cggtgggagcgggaggcttcg

SEQ ID NO: 27802 - DNA, 21 bp, Artificial Sequence
  Synthetic
ggtgggtgggggatgtcgagt

SEQ ID NO: 27803 - DNA, 21 bp, Artificial Sequence
  Synthetic
ccggttgagctgtcttggaag

SEQ ID NO: 27804 - DNA, 21 bp, Artificial Sequence
  Synthetic
actagggcgaagagtgagggg

SEQ ID NO: 27805 - DNA, 21 bp, Artificial Sequence
  Synthetic
cctaggttgacgatggagagg

SEQ ID NO: 27806 - DNA, 21 bp, Artificial Sequence
  Synthetic
cgggcgcataatatgatgact

SEQ ID NO: 27807 - DNA, 21 bp, Artificial Sequence
  Synthetic
gtgatgcttagggggtctgcg

SEQ ID NO: 27808 - DNA, 21 bp, Artificial Sequence
  Synthetic
attgctacgagtgggtggaat

SEQ ID NO: 27809 - DNA, 21 bp, Artificial Sequence
  Synthetic
cgggatgcgcatcatcagtgg

SEQ ID NO: 27810 - DNA, 21 bp, Artificial Sequence
  Synthetic
catccggcgcttcgtaatgtt

SEQ ID NO: 27811 - DNA, 21 bp, Artificial Sequence
  Synthetic
tgggagcgtacttctggttat

SEQ ID NO: 27812 - DNA, 21 bp, Artificial Sequence
  Synthetic
cggatgcattcgacgctggcg

SEQ ID NO: 27813 - DNA, 21 bp, Artificial Sequence
  Synthetic
gcgaggctgcagagggatgct

SEQ ID NO: 27814 - DNA, 21 bp, Artificial Sequence
  Synthetic
aggggggcggagcatccgtgg

SEQ ID NO: 27815 - DNA, 21 bp, Artificial Sequence
  Synthetic
aggaatgtgctgcatcatcct

SEQ ID NO: 27816 - DNA, 21 bp, Artificial Sequence
  Synthetic
atggttgagtggcgtcctgat

SEQ ID NO: 27817 - DNA, 21 bp, Artificial Sequence
  Synthetic
ggtttgcgtcttgatattcgg

SEQ ID NO: 27818 - DNA, 21 bp, Artificial Sequence
  Synthetic
tatatgcggcaggctgggtct

SEQ ID NO: 27819 - DNA, 21 bp, Artificial Sequence
  Synthetic
gttggtagtcattatccgtgg

SEQ ID NO: 27820 - DNA, 21 bp, Artificial Sequence
  Synthetic
gaggcggcgggtgcgcgttat

SEQ ID NO: 27821 - DNA, 21 bp, Artificial Sequence
  Synthetic
aatggttatcaggggggttgg

SEQ ID NO: 27822 - DNA, 21 bp, Artificial Sequence
  Synthetic
cgtaatgagatgcgtgggttg

SEQ ID NO: 27823 - DNA, 21 bp, Artificial Sequence
  Synthetic
agggatgggccgaagccgtgg

SEQ ID NO: 27824 - DNA, 21 bp, Artificial Sequence
  Synthetic
cggggtgatgctcggggtacg

SEQ ID NO: 27825 - DNA, 21 bp, Artificial Sequence
  Synthetic
tggaatattgatagggggtat

SEQ ID NO: 27826 - DNA, 21 bp, Artificial Sequence
  Synthetic
gggcatacggttgggacttgg

SEQ ID NO: 27827 - DNA, 21 bp, Artificial Sequence
  Synthetic
aggctgtttgggatgtcgcag

SEQ ID NO: 27828 - DNA, 21 bp, Artificial Sequence
  Synthetic
ggttatgcgacggattattgg

SEQ ID NO: 27829 - DNA, 21 bp, Artificial Sequence
  Synthetic
gataggactccgagtatgtgg

SEQ ID NO: 27830 - DNA, 21 bp, Artificial Sequence
  Synthetic
gagcgggtttatgcgatttcg

SEQ ID NO: 27831 - DNA, 21 bp, Artificial Sequence
  Synthetic
gagcgggcgggttattctgct

SEQ ID NO: 27832 - DNA, 21 bp, Artificial Sequence
  Synthetic
cgtcagtatgatctggggagt

SEQ ID NO: 27833 - DNA, 21 bp, Artificial Sequence
  Synthetic
atgatttatggtgggtcgctg

SEQ ID NO: 27834 - DNA, 21 bp, Artificial Sequence
  Synthetic
gcgtatccggctcagtcgcag

SEQ ID NO: 27835 - DNA, 21 bp, Artificial Sequence
  Synthetic
ttttctcctggttttagtagt

SEQ ID NO: 27836 - DNA, 21 bp, Artificial Sequence
  Synthetic
cgtcatgctaatcctagtatg

SEQ ID NO: 27837 - DNA, 21 bp, Artificial Sequence
  Synthetic
cttaggtcgaatgctcatccg

SEQ ID NO: 27838 - DNA, 21 bp, Artificial Sequence
  Synthetic
ggtgcgaagggttgggtgatg

SEQ ID NO: 27839 - DNA, 21 bp, Artificial Sequence
  Synthetic
gtgagggatcatccttctcgt

SEQ ID NO: 27840 - DNA, 21 bp, Artificial Sequence
  Synthetic
ttgatggttcggggttcttcg

SEQ ID NO: 27841 - DNA, 21 bp, Artificial Sequence
  Synthetic
ggtgtttatatggggtcgagt

SEQ ID NO: 27842 - DNA, 21 bp, Artificial Sequence
  Synthetic
aatgatgcttggcgtagggat

SEQ ID NO: 27843 - DNA, 21 bp, Artificial Sequence
  Synthetic
cagcatgtgggttatagttct

SEQ ID NO: 27844 - DNA, 21 bp, Artificial Sequence
  Synthetic
attgggagtcctggtgcttgg

SEQ ID NO: 27845 - DNA, 21 bp, Artificial Sequence
  Synthetic
gatcggactgttggttcgtgg

SEQ ID NO: 27846 - DNA, 21 bp, Artificial Sequence
  Synthetic
cgtgtgtatgatcttcgtccg

SEQ ID NO: 27847 - DNA, 21 bp, Artificial Sequence
  Synthetic
ttgaagtttgggttgtcgtct

SEQ ID NO: 27848 - DNA, 21 bp, Artificial Sequence
  Synthetic
gtgccggttactgttcgttat

SEQ ID NO: 27849 - DNA, 21 bp, Artificial Sequence
  Synthetic
gatccggttaataggtggcat

SEQ ID NO: 27850 - DNA, 21 bp, Artificial Sequence
  Synthetic
agttggcttgggagtgctact

SEQ ID NO: 27851 - DNA, 21 bp, Artificial Sequence
  Synthetic
ccggttattgtgctgacggcg

SEQ ID NO: 27852 - DNA, 21 bp, Artificial Sequence
  Synthetic
gtgcagtatacgcgttttgat

SEQ ID NO: 27853 - DNA, 21 bp, Artificial Sequence
  Synthetic
gaggggagtgttgtgcgttgg

SEQ ID NO: 27854 - DNA, 21 bp, Artificial Sequence
  Synthetic
cgtgggctgtctgagggtaag

SEQ ID NO: 27855 - DNA, 21 bp, Artificial Sequence
  Synthetic
tcgctgaaggggctgacggag

SEQ ID NO: 27856 - DNA, 21 bp, Artificial Sequence
  Synthetic
aggccgccgaattcttttcat

SEQ ID NO: 27857 - DNA, 21 bp, Artificial Sequence
  Synthetic
agggagtctcgtgggctttat

SEQ ID NO: 27858 - DNA, 21 bp, Artificial Sequence
  Synthetic
cggttgcctgagaagcatcat

SEQ ID NO: 27859 - DNA, 21 bp, Artificial Sequence
  Synthetic
gttaagaattttcctgtgatt

SEQ ID NO: 27860 - DNA, 21 bp, Artificial Sequence
  Synthetic
tttaagtctttggttcatggt

SEQ ID NO: 27861 - DNA, 21 bp, Artificial Sequence
  Synthetic
aggtatgcgggtactggtcct

SEQ ID NO: 27862 - DNA, 21 bp, Artificial Sequence
  Synthetic
atggataattcttcgcgttgg

SEQ ID NO: 27863 - DNA, 21 bp, Artificial Sequence
  Synthetic
ttgcttggtgaggctaggtgg

SEQ ID NO: 27864 - DNA, 21 bp, Artificial Sequence
  Synthetic
atggtggtggtgcggagtatg

SEQ ID NO: 27865 - DNA, 21 bp, Artificial Sequence
  Synthetic
tttggttctctgagtcgggtg

SEQ ID NO: 27866 - DNA, 21 bp, Artificial Sequence
  Synthetic
tctactaatgatgggaggtgg

SEQ ID NO: 27867 - DNA, 21 bp, Artificial Sequence
  Synthetic
tggggtagtcttcatggtggt

SEQ ID NO: 27868 - DNA, 21 bp, Artificial Sequence
  Synthetic
ctgccgattgtgcttactaat

SEQ ID NO: 27869 - DNA, 21 bp, Artificial Sequence
  Synthetic
cataatggtaagggtcatgcg

SEQ ID NO: 27870 - DNA, 21 bp, Artificial Sequence
  Synthetic
ggggctcggttgacggatcgt

SEQ ID NO: 27871 - DNA, 21 bp, Artificial Sequence
  Synthetic
aagcatatgggtcatttgatg

SEQ ID NO: 27872 - DNA, 21 bp, Artificial Sequence
  Synthetic
actgtttctacgggtaggtgg

SEQ ID NO: 27873 - DNA, 21 bp, Artificial Sequence
  Synthetic
tggtcttctcttggtagtgcg

SEQ ID NO: 27874 - DNA, 21 bp, Artificial Sequence
  Synthetic
aggggtgcgcatttgttgacg

SEQ ID NO: 27875 - DNA, 21 bp, Artificial Sequence
  Synthetic
gtggatggggtgtatcgttgg

SEQ ID NO: 27876 - DNA, 21 bp, Artificial Sequence
  Synthetic
acttatcgtgggtcgtctact

SEQ ID NO: 27877 - DNA, 21 bp, Artificial Sequence
  Synthetic
gttaatctgagtttgcgggag

SEQ ID NO: 27878 - DNA, 21 bp, Artificial Sequence
  Synthetic
gtgcttgtttctactttgggg

SEQ ID NO: 27879 - DNA, 21 bp, Artificial Sequence
  Synthetic
agggagcgtcatcaggctggg

SEQ ID NO: 27880 - DNA, 21 bp, Artificial Sequence
  Synthetic
ggggatcgttcttggtcggtt

SEQ ID NO: 27881 - DNA, 21 bp, Artificial Sequence
  Synthetic
ggggagaggccgggtctgtgg

SEQ ID NO: 27882 - DNA, 21 bp, Artificial Sequence
  Synthetic
cttatgcataatttttcgatg

SEQ ID NO: 27883 - DNA, 21 bp, Artificial Sequence
  Synthetic
cctcatggggcgccgaagctt

SEQ ID NO: 27884 - DNA, 21 bp, Artificial Sequence
  Synthetic
ccggttcgtacgtctggttgg

SEQ ID NO: 27885 - DNA, 21 bp, Artificial Sequence
  Synthetic
tttaagggtgagatggggcgg

SEQ ID NO: 27886 - DNA, 21 bp, Artificial Sequence
  Synthetic
gggatggagattggtcggtgg

SEQ ID NO: 27887 - DNA, 21 bp, Artificial Sequence
  Synthetic
gatcatctggctgcgcggtgg

SEQ ID NO: 27888 - DNA, 21 bp, Artificial Sequence
  Synthetic
tatacgctgtcgccgtggaat

SEQ ID NO: 27889 - DNA, 21 bp, Artificial Sequence
  Synthetic
tatactgtttcggcggggtgg

SEQ ID NO: 27890 - DNA, 21 bp, Artificial Sequence
  Synthetic
cgtgttgatactcagcattgg

SEQ ID NO: 27891 - DNA, 21 bp, Artificial Sequence
  Synthetic
gagctggggacggggcgttgg

SEQ ID NO: 27892 - DNA, 21 bp, Artificial Sequence
  Synthetic
gcttcgtatgtgaatcagtgg

SEQ ID NO: 27893 - DNA, 21 bp, Artificial Sequence
  Synthetic
cagaagcttggggattgggcg

SEQ ID NO: 27894 - DNA, 21 bp, Artificial Sequence
  Synthetic
ggtaggggggctgtgcctaat

SEQ ID NO: 27895 - DNA, 21 bp, Artificial Sequence
  Synthetic
tttactaagcaggttcatggt

SEQ ID NO: 27896 - DNA, 21 bp, Artificial Sequence
  Synthetic
tggggtaatccggctaagggt

SEQ ID NO: 27897 - DNA, 21 bp, Artificial Sequence
  Synthetic
agtaatcagtggagttctagt

SEQ ID NO: 27898 - DNA, 21 bp, Artificial Sequence
  Synthetic
cggggtcataattatcaggat

SEQ ID NO: 27899 - DNA, 21 bp, Artificial Sequence
  Synthetic
catcggagtgttgatcgtgtg

SEQ ID NO: 27900 - DNA, 21 bp, Artificial Sequence
  Synthetic
tgtggtgggaaggttcattct

SEQ ID NO: 27901 - DNA, 21 bp, Artificial Sequence
  Synthetic
ctttggaatggtatggatctg

SEQ ID NO: 27902 - DNA, 21 bp, Artificial Sequence
  Synthetic
gagccgtggaataggcattcg

SEQ ID NO: 27903 - DNA, 21 bp, Artificial Sequence
  Synthetic
gcgcatagggaggggtctcgt

SEQ ID NO: 27904 - DNA, 21 bp, Artificial Sequence
  Synthetic
aagggtggtccgctgcgtgat

SEQ ID NO: 27905 - DNA, 21 bp, Artificial Sequence
  Synthetic
gtgcatgagattaatcatccg

SEQ ID NO: 27906 - DNA, 21 bp, Artificial Sequence
  Synthetic
aggatgagtgagaagggtgcg

SEQ ID NO: 27907 - DNA, 21 bp, Artificial Sequence
  Synthetic
gagtatggtaggggttttagt

SEQ ID NO: 27908 - DNA, 21 bp, Artificial Sequence
  Synthetic
tcgtttcgtgggggttctagt

SEQ ID NO: 27909 - DNA, 21 bp, Artificial Sequence
  Synthetic
gatatgcgggtgggttcttgg

SEQ ID NO: 27910 - DNA, 21 bp, Artificial Sequence
  Synthetic
gagattcgttggggggcgtcg

SEQ ID NO: 27911 - DNA, 21 bp, Artificial Sequence
  Synthetic
tattggggtggtgtgtctcag

SEQ ID NO: 27912 - DNA, 21 bp, Artificial Sequence
  Synthetic
gatgcgaataggcaggcgcgg

SEQ ID NO: 27913 - DNA, 21 bp, Artificial Sequence
  Synthetic
acttggcgtgagcatgggacg

SEQ ID NO: 27914 - DNA, 21 bp, Artificial Sequence
  Synthetic
tatgcgtatggggcgaagctg

SEQ ID NO: 27915 - DNA, 21 bp, Artificial Sequence
  Synthetic
agttttgggctgcattctgtt

SEQ ID NO: 27916 - DNA, 21 bp, Artificial Sequence
  Synthetic
ctgtatgattcgagtaggtgg

SEQ ID NO: 27917 - DNA, 21 bp, Artificial Sequence
  Synthetic
atgcctgtgttgaggctgccg

SEQ ID NO: 27918 - DNA, 21 bp, Artificial Sequence
  Synthetic
acgcgtacttgtactccttgt

SEQ ID NO: 27919 - DNA, 21 bp, Artificial Sequence
  Synthetic
gagcattatcggaaggagtat

SEQ ID NO: 27920 - DNA, 21 bp, Artificial Sequence
  Synthetic
gatcgtcctattcgtggtacg

SEQ ID NO: 27921 - DNA, 21 bp, Artificial Sequence
  Synthetic
gataaggtttggggtgttgtt

SEQ ID NO: 27922 - DNA, 21 bp, Artificial Sequence
  Synthetic
atgatggcgtatgatagggct

SEQ ID NO: 27923 - DNA, 21 bp, Artificial Sequence
  Synthetic
tttcatcatgataagccgaag

SEQ ID NO: 27924 - DNA, 21 bp, Artificial Sequence
  Synthetic
aggcagaatgcgagtcattct

SEQ ID NO: 27925 - DNA, 21 bp, Artificial Sequence
  Synthetic
agtcgggttgagcatgggtgg

SEQ ID NO: 27926 - DNA, 21 bp, Artificial Sequence
  Synthetic
attaggggtgctacgggtcct

SEQ ID NO: 27927 - DNA, 21 bp, Artificial Sequence
  Synthetic
catatgattcgtcctctggct

SEQ ID NO: 27928 - DNA, 21 bp, Artificial Sequence
  Synthetic
cgtggtctggggtatagttct

SEQ ID NO: 27929 - DNA, 21 bp, Artificial Sequence
  Synthetic
gagcctatgtattcttatagt

SEQ ID NO: 27930 - DNA, 21 bp, Artificial Sequence
  Synthetic
cagcatacgaatacttggacg

SEQ ID NO: 27931 - DNA, 21 bp, Artificial Sequence
  Synthetic
cggcctgagtggcggagtgat

SEQ ID NO: 27932 - DNA, 21 bp, Artificial Sequence
  Synthetic
cagtttcatggttcgtctcag

SEQ ID NO: 27933 - DNA, 21 bp, Artificial Sequence
  Synthetic
tcttcgagttgggatcgtgtg

SEQ ID NO: 27934 - DNA, 21 bp, Artificial Sequence
  Synthetic
tttgtgattggggcgaagtat

SEQ ID NO: 27935 - DNA, 21 bp, Artificial Sequence
  Synthetic
gagaggaatgggtggtcttcg

SEQ ID NO: 27936 - DNA, 21 bp, Artificial Sequence
  Synthetic
tgggaggcgcggcatgggtat

SEQ ID NO: 27937 - DNA, 21 bp, Artificial Sequence
  Synthetic
gggtcgtcgccggggttgtgg

SEQ ID NO: 27938 - DNA, 21 bp, Artificial Sequence
  Synthetic
gtgtataatgggtcggtttat

SEQ ID NO: 27939 - DNA, 21 bp, Artificial Sequence
  Synthetic
gattttagtcatccgcatcgg

SEQ ID NO: 27940 - DNA, 21 bp, Artificial Sequence
  Synthetic
aggggtaatccgggtgctcct

SEQ ID NO: 27941 - DNA, 21 bp, Artificial Sequence
  Synthetic
aatcatggtggtcgtacgggt

SEQ ID NO: 27942 - protein, 7 aa, Artificial Sequence
  Synthetic
YGSLQGW

SEQ ID NO: 27943 - protein, 7 aa, Artificial Sequence
  Synthetic
YDVGLGW

SEQ ID NO: 27944 - protein, 7 aa, Artificial Sequence
  Synthetic
YSVSGGW

SEQ ID NO: 27945 - protein, 7 aa, Artificial Sequence
  Synthetic
YENPGMW

SEQ ID NO: 27946 - protein, 7 aa, Artificial Sequence
  Synthetic
YTGALSW

SEQ ID NO: 27947 - protein, 7 aa, Artificial Sequence
  Synthetic
YGALSSW

SEQ ID NO: 27948 - protein, 7 aa, Artificial Sequence
  Synthetic
YKIETGW

SEQ ID NO: 27949 - protein, 7 aa, Artificial Sequence
  Synthetic
YDTIRGW

SEQ ID NO: 27950 - protein, 7 aa, Artificial Sequence
  Synthetic
YGAVGPW

SEQ ID NO: 27951 - protein, 7 aa, Artificial Sequence
  Synthetic
YGSLHGW

SEQ ID NO: 27952 - protein, 7 aa, Artificial Sequence
  Synthetic
YTVPGGW

SEQ ID NO: 27953 - protein, 7 aa, Artificial Sequence
  Synthetic
KSVGSVY

SEQ ID NO: 27954 - protein, 7 aa, Artificial Sequence
  Synthetic
KSAGSIY

SEQ ID NO: 27955 - protein, 7 aa, Artificial Sequence
  Synthetic
KDDYSYY

SEQ ID NO: 27956 - protein, 7 aa, Artificial Sequence
  Synthetic
KGPHDFY

SEQ ID NO: 27957 - protein, 7 aa, Artificial Sequence
  Synthetic
KWQNDMY

SEQ ID NO: 27958 - protein, 7 aa, Artificial Sequence
  Synthetic
KSIGTIY

SEQ ID NO: 27959 - protein, 7 aa, Artificial Sequence
  Synthetic
KEVGHIY

SEQ ID NO: 27960 - protein, 7 aa, Artificial Sequence
  Synthetic
KSMGTVY

SEQ ID NO: 27961 - protein, 7 aa, Artificial Sequence
  Synthetic
KHPAAIY

SEQ ID NO: 27962 - protein, 7 aa, Artificial Sequence
  Synthetic
KTDYTYY

SEQ ID NO: 27963 - protein, 7 aa, Artificial Sequence
  Synthetic
KLDHAYY

SEQ ID NO: 27964 - protein, 7 aa, Artificial Sequence
  Synthetic
KFSLVGY

SEQ ID NO: 27965 - protein, 7 aa, Artificial Sequence
  Synthetic
KSEWGSY

SEQ ID NO: 27966 - protein, 7 aa, Artificial Sequence
  Synthetic
KDVNWSY

SEQ ID NO: 27967 - protein, 7 aa, Artificial Sequence
  Synthetic
KTYEIPY

SEQ ID NO: 27968 - protein, 7 aa, Artificial Sequence
  Synthetic
RFAGDSV

SEQ ID NO: 27969 - protein, 7 aa, Artificial Sequence
  Synthetic
RFLGEPS

SEQ ID NO: 27970 - protein, 7 aa, Artificial Sequence
  Synthetic
RYMGDSV

SEQ ID NO: 27971 - protein, 7 aa, Artificial Sequence
  Synthetic
RYTGEST

SEQ ID NO: 27972 - protein, 7 aa, Artificial Sequence
  Synthetic
RFAGDAS

SEQ ID NO: 27973 - protein, 7 aa, Artificial Sequence
  Synthetic
RYLGDNI

SEQ ID NO: 27974 - protein, 7 aa, Artificial Sequence
  Synthetic
RYMGDAS

SEQ ID NO: 27975 - protein, 7 aa, Artificial Sequence
  Synthetic
RYSGDAA

SEQ ID NO: 27976 - protein, 7 aa, Artificial Sequence
  Synthetic
RYGGDSS

SEQ ID NO: 27977 - protein, 7 aa, Artificial Sequence
  Synthetic
RYQADAQ

SEQ ID NO: 27978 - protein, 7 aa, Artificial Sequence
  Synthetic
RFAGDSS

SEQ ID NO: 27979 - protein, 7 aa, Artificial Sequence
  Synthetic
RYIGDSA

SEQ ID NO: 27980 - protein, 7 aa, Artificial Sequence
  Synthetic
RFTGDPA

SEQ ID NO: 27981 - protein, 7 aa, Artificial Sequence
  Synthetic
RFIADQA

SEQ ID NO: 27982 - protein, 7 aa, Artificial Sequence
  Synthetic
RFIADHA

SEQ ID NO: 27983 - protein, 7 aa, Artificial Sequence
  Synthetic
RFLGDIS

SEQ ID NO: 27984 - protein, 7 aa, Artificial Sequence
  Synthetic
RYIGDNV

SEQ ID NO: 27985 - protein, 7 aa, Artificial Sequence
  Synthetic
RYQGDSA

SEQ ID NO: 27986 - protein, 7 aa, Artificial Sequence
  Synthetic
RFVSDAT

SEQ ID NO: 27987 - protein, 7 aa, Artificial Sequence
  Synthetic
RYAGDST

SEQ ID NO: 27988 - protein, 7 aa, Artificial Sequence
  Synthetic
RYHSDAS

SEQ ID NO: 27989 - protein, 7 aa, Artificial Sequence
  Synthetic
RYEADAA

SEQ ID NO: 27990 - protein, 7 aa, Artificial Sequence
  Synthetic
RFVGDFG

SEQ ID NO: 27991 - protein, 7 aa, Artificial Sequence
  Synthetic
RFPGDGA

SEQ ID NO: 27992 - protein, 7 aa, Artificial Sequence
  Synthetic
RFTNDSS

SEQ ID NO: 27993 - protein, 7 aa, Artificial Sequence
  Synthetic
RYVHEAS

SEQ ID NO: 27994 - protein, 7 aa, Artificial Sequence
  Synthetic
RFPGDGS

SEQ ID NO: 27995 - protein, 7 aa, Artificial Sequence
  Synthetic
RFTADST

SEQ ID NO: 27996 - protein, 7 aa, Artificial Sequence
  Synthetic
RYPGESM

SEQ ID NO: 27997 - protein, 7 aa, Artificial Sequence
  Synthetic
RYMGELL

SEQ ID NO: 27998 - protein, 7 aa, Artificial Sequence
  Synthetic
RYPGDPS

SEQ ID NO: 27999 - protein, 7 aa, Artificial Sequence
  Synthetic
RYSGDSV

SEQ ID NO: 28000 - protein, 7 aa, Artificial Sequence
  Synthetic
RYHSDSA

SEQ ID NO: 28001 - protein, 7 aa, Artificial Sequence
  Synthetic
RYVNDAS

SEQ ID NO: 28002 - protein, 7 aa, Artificial Sequence
  Synthetic
RYAGEAA

SEQ ID NO: 28003 - protein, 7 aa, Artificial Sequence
  Synthetic
RFPADRI

SEQ ID NO: 28004 - protein, 7 aa, Artificial Sequence
  Synthetic
RYLADAS

SEQ ID NO: 28005 - protein, 7 aa, Artificial Sequence
  Synthetic
RYVGDNT

SEQ ID NO: 28006 - protein, 7 aa, Artificial Sequence
  Synthetic
RYAGESA

SEQ ID NO: 28007 - protein, 7 aa, Artificial Sequence
  Synthetic
RYAHDSM

SEQ ID NO: 28008 - protein, 7 aa, Artificial Sequence
  Synthetic
RFASDSS

SEQ ID NO: 28009 - protein, 7 aa, Artificial Sequence
  Synthetic
RYSGDSA

SEQ ID NO: 28010 - protein, 7 aa, Artificial Sequence
  Synthetic
RYVHEIA

SEQ ID NO: 28011 - protein, 7 aa, Artificial Sequence
  Synthetic
RYLGDTK

SEQ ID NO: 28012 - protein, 7 aa, Artificial Sequence
  Synthetic
RYNGESQ

SEQ ID NO: 28013 - protein, 7 aa, Artificial Sequence
  Synthetic
RFRPDPG

SEQ ID NO: 28014 - protein, 7 aa, Artificial Sequence
  Synthetic
RYPAEAM

SEQ ID NO: 28015 - protein, 7 aa, Artificial Sequence
  Synthetic
RYPAEAT

SEQ ID NO: 28016 - protein, 7 aa, Artificial Sequence
  Synthetic
RYAHDAS

SEQ ID NO: 28017 - protein, 7 aa, Artificial Sequence
  Synthetic
RYLSDSS

SEQ ID NO: 28018 - protein, 7 aa, Artificial Sequence
  Synthetic
RFIPEPS

SEQ ID NO: 28019 - protein, 7 aa, Artificial Sequence
  Synthetic
RFSGDPS

SEQ ID NO: 28020 - protein, 7 aa, Artificial Sequence
  Synthetic
RYQMDSA

SEQ ID NO: 28021 - protein, 7 aa, Artificial Sequence
  Synthetic
RFSADSS

SEQ ID NO: 28022 - protein, 7 aa, Artificial Sequence
  Synthetic
RYAGDAV

SEQ ID NO: 28023 - protein, 7 aa, Artificial Sequence
  Synthetic
RFHGDAS

SEQ ID NO: 28024 - protein, 7 aa, Artificial Sequence
  Synthetic
RYPGENS

SEQ ID NO: 28025 - protein, 7 aa, Artificial Sequence
  Synthetic
RFIAESA

SEQ ID NO: 28026 - protein, 7 aa, Artificial Sequence
  Synthetic
RYVGDPS

SEQ ID NO: 28027 - protein, 7 aa, Artificial Sequence
  Synthetic
RFHADAA

SEQ ID NO: 28028 - protein, 7 aa, Artificial Sequence
  Synthetic
RFVVDSA

SEQ ID NO: 28029 - protein, 7 aa, Artificial Sequence
  Synthetic
RFANDSS

SEQ ID NO: 28030 - protein, 7 aa, Artificial Sequence
  Synthetic
RFSGDAS

SEQ ID NO: 28031 - protein, 7 aa, Artificial Sequence
  Synthetic
RYSPDAA

SEQ ID NO: 28032 - protein, 7 aa, Artificial Sequence
  Synthetic
RYSMDSS

SEQ ID NO: 28033 - protein, 7 aa, Artificial Sequence
  Synthetic
RYSLDAA

SEQ ID NO: 28034 - protein, 7 aa, Artificial Sequence
  Synthetic
RFGGDST

SEQ ID NO: 28035 - protein, 7 aa, Artificial Sequence
  Synthetic
RYPHDSA

SEQ ID NO: 28036 - protein, 7 aa, Artificial Sequence
  Synthetic
RYLGETS

SEQ ID NO: 28037 - protein, 7 aa, Artificial Sequence
  Synthetic
RYVAELT

SEQ ID NO: 28038 - protein, 7 aa, Artificial Sequence
  Synthetic
RFVSDFA

SEQ ID NO: 28039 - protein, 7 aa, Artificial Sequence
  Synthetic
RYPGDSV

SEQ ID NO: 28040 - protein, 7 aa, Artificial Sequence
  Synthetic
RFIRDQA

SEQ ID NO: 28041 - protein, 7 aa, Artificial Sequence
  Synthetic
RFHSDAS

SEQ ID NO: 28042 - protein, 7 aa, Artificial Sequence
  Synthetic
RFTGDNS

SEQ ID NO: 28043 - protein, 7 aa, Artificial Sequence
  Synthetic
RYASDAA

SEQ ID NO: 28044 - protein, 7 aa, Artificial Sequence
  Synthetic
RFHMDAT

SEQ ID NO: 28045 - protein, 7 aa, Artificial Sequence
  Synthetic
RFSGDAS

SEQ ID NO: 28046 - protein, 7 aa, Artificial Sequence
  Synthetic
RFEADSA

SEQ ID NO: 28047 - protein, 7 aa, Artificial Sequence
  Synthetic
RFSPDAA

SEQ ID NO: 28048 - protein, 7 aa, Artificial Sequence
  Synthetic
RFDHDAA

SEQ ID NO: 28049 - protein, 7 aa, Artificial Sequence
  Synthetic
RYIPEAS

SEQ ID NO: 28050 - protein, 7 aa, Artificial Sequence
  Synthetic
RFELDSA

SEQ ID NO: 28051 - protein, 7 aa, Artificial Sequence
  Synthetic
RYLGELS

SEQ ID NO: 28052 - protein, 7 aa, Artificial Sequence
  Synthetic
RYPADAI

SEQ ID NO: 28053 - protein, 7 aa, Artificial Sequence
  Synthetic
RFPGDNS

SEQ ID NO: 28054 - protein, 7 aa, Artificial Sequence
  Synthetic
RYMGDSQ

SEQ ID NO: 28055 - protein, 7 aa, Artificial Sequence
  Synthetic
RYPHDAS

SEQ ID NO: 28056 - protein, 7 aa, Artificial Sequence
  Synthetic
RFMPDAA

SEQ ID NO: 28057 - protein, 7 aa, Artificial Sequence
  Synthetic
RFTNDSS

SEQ ID NO: 28058 - protein, 7 aa, Artificial Sequence
  Synthetic
RFLNDAA

SEQ ID NO: 28059 - protein, 7 aa, Artificial Sequence
  Synthetic
RFTGDPS

SEQ ID NO: 28060 - protein, 7 aa, Artificial Sequence
  Synthetic
RYIPDAS

SEQ ID NO: 28061 - protein, 7 aa, Artificial Sequence
  Synthetic
RFLSDHA

SEQ ID NO: 28062 - protein, 7 aa, Artificial Sequence
  Synthetic
RYNGDAA

SEQ ID NO: 28063 - protein, 7 aa, Artificial Sequence
  Synthetic
RFLGDTA

SEQ ID NO: 28064 - protein, 7 aa, Artificial Sequence
  Synthetic
RFLGDML

SEQ ID NO: 28065 - protein, 7 aa, Artificial Sequence
  Synthetic
RYVGDSS

SEQ ID NO: 28066 - protein, 7 aa, Artificial Sequence
  Synthetic
RYAQDSS

SEQ ID NO: 28067 - protein, 7 aa, Artificial Sequence
  Synthetic
PRIGYSA

SEQ ID NO: 28068 - protein, 7 aa, Artificial Sequence
  Synthetic
LKLGYST

SEQ ID NO: 28069 - protein, 7 aa, Artificial Sequence
  Synthetic
RAPGYSM

SEQ ID NO: 28070 - protein, 7 aa, Artificial Sequence
  Synthetic
LRAGYSV

SEQ ID NO: 28071 - protein, 7 aa, Artificial Sequence
  Synthetic
LSMGFSQ

SEQ ID NO: 28072 - protein, 7 aa, Artificial Sequence
  Synthetic
PFPGFSA

SEQ ID NO: 28073 - protein, 7 aa, Artificial Sequence
  Synthetic
EARGWST

SEQ ID NO: 28074 - protein, 7 aa, Artificial Sequence
  Synthetic
FSHGYST

SEQ ID NO: 28075 - protein, 7 aa, Artificial Sequence
  Synthetic
IDRGYSV

SEQ ID NO: 28076 - protein, 7 aa, Artificial Sequence
  Synthetic
TKLGFSQ

SEQ ID NO: 28077 - protein, 7 aa, Artificial Sequence
  Synthetic
PMRGFSS

SEQ ID NO: 28078 - protein, 7 aa, Artificial Sequence
  Synthetic
QAAGWSS

SEQ ID NO: 28079 - protein, 7 aa, Artificial Sequence
  Synthetic
SREGWST

SEQ ID NO: 28080 - protein, 7 aa, Artificial Sequence
  Synthetic
DYRGYST

SEQ ID NO: 28081 - protein, 7 aa, Artificial Sequence
  Synthetic
PRAGYSM

SEQ ID NO: 28082 - protein, 7 aa, Artificial Sequence
  Synthetic
PAPGWSS

SEQ ID NO: 28083 - protein, 7 aa, Artificial Sequence
  Synthetic
IAKGYSQ

SEQ ID NO: 28084 - protein, 7 aa, Artificial Sequence
  Synthetic
QRVGFSS

SEQ ID NO: 28085 - protein, 7 aa, Artificial Sequence
  Synthetic
LKSGFSM

SEQ ID NO: 28086 - protein, 7 aa, Artificial Sequence
  Synthetic
VALGYSS

SEQ ID NO: 28087 - protein, 7 aa, Artificial Sequence
  Synthetic
MATGWSS

SEQ ID NO: 28088 - protein, 7 aa, Artificial Sequence
  Synthetic
ERAGYSS

SEQ ID NO: 28089 - protein, 7 aa, Artificial Sequence
  Synthetic
VARGYSS

SEQ ID NO: 28090 - protein, 7 aa, Artificial Sequence
  Synthetic
PRVGFSS

SEQ ID NO: 28091 - protein, 7 aa, Artificial Sequence
  Synthetic
LRPGYSS

SEQ ID NO: 28092 - protein, 7 aa, Artificial Sequence
  Synthetic
HGLGFSS

SEQ ID NO: 28093 - protein, 7 aa, Artificial Sequence
  Synthetic
VRSGYSS

SEQ ID NO: 28094 - protein, 7 aa, Artificial Sequence
  Synthetic
SRPGFSM

SEQ ID NO: 28095 - protein, 7 aa, Artificial Sequence
  Synthetic
LKTGFSS

SEQ ID NO: 28096 - protein, 7 aa, Artificial Sequence
  Synthetic
LKQGWSA

SEQ ID NO: 28097 - protein, 7 aa, Artificial Sequence
  Synthetic
YLRGWSE

SEQ ID NO: 28098 - protein, 7 aa, Artificial Sequence
  Synthetic
TKTGYSS

SEQ ID NO: 28099 - protein, 7 aa, Artificial Sequence
  Synthetic
IALGYSA

SEQ ID NO: 28100 - protein, 7 aa, Artificial Sequence
  Synthetic
AQIGWSS

SEQ ID NO: 28101 - protein, 7 aa, Artificial Sequence
  Synthetic
SVPGWSA

SEQ ID NO: 28102 - protein, 7 aa, Artificial Sequence
  Synthetic
LHAGFSS

SEQ ID NO: 28103 - protein, 7 aa, Artificial Sequence
  Synthetic
LSIGWSS

SEQ ID NO: 28104 - protein, 7 aa, Artificial Sequence
  Synthetic
VHLGFSS

SEQ ID NO: 28105 - protein, 7 aa, Artificial Sequence
  Synthetic
LGHGWSQ

SEQ ID NO: 28106 - protein, 7 aa, Artificial Sequence
  Synthetic
SRAGYSM

SEQ ID NO: 28107 - protein, 7 aa, Artificial Sequence
  Synthetic
RVPGFSS

SEQ ID NO: 28108 - protein, 7 aa, Artificial Sequence
  Synthetic
VIPGWSS

SEQ ID NO: 28109 - protein, 7 aa, Artificial Sequence
  Synthetic
LMRGFST

SEQ ID NO: 28110 - protein, 7 aa, Artificial Sequence
  Synthetic
LQPGWST

SEQ ID NO: 28111 - protein, 7 aa, Artificial Sequence
  Synthetic
TIVGFSS

SEQ ID NO: 28112 - protein, 7 aa, Artificial Sequence
  Synthetic
VRAGFSS

SEQ ID NO: 28113 - protein, 7 aa, Artificial Sequence
  Synthetic
NYAGYST

SEQ ID NO: 28114 - protein, 7 aa, Artificial Sequence
  Synthetic
KSPGFSS

SEQ ID NO: 28115 - protein, 7 aa, Artificial Sequence
  Synthetic
MAAGFSQ

SEQ ID NO: 28116 - protein, 7 aa, Artificial Sequence
  Synthetic
LRAGYSV

SEQ ID NO: 28117 - protein, 7 aa, Artificial Sequence
  Synthetic
PRSGFSS

SEQ ID NO: 28118 - protein, 7 aa, Artificial Sequence
  Synthetic
MAVGFSS

SEQ ID NO: 28119 - protein, 7 aa, Artificial Sequence
  Synthetic
NRPGFSS

SEQ ID NO: 28120 - protein, 7 aa, Artificial Sequence
  Synthetic
GGLGWSS

SEQ ID NO: 28121 - protein, 7 aa, Artificial Sequence
  Synthetic
WSHGYST

SEQ ID NO: 28122 - protein, 7 aa, Artificial Sequence
  Synthetic
VRSGFSS

SEQ ID NO: 28123 - protein, 7 aa, Artificial Sequence
  Synthetic
VRSGFSM

SEQ ID NO: 28124 - protein, 7 aa, Artificial Sequence
  Synthetic
VMHGFSS

SEQ ID NO: 28125 - protein, 7 aa, Artificial Sequence
  Synthetic
SKVGYSS

SEQ ID NO: 28126 - protein, 7 aa, Artificial Sequence
  Synthetic
TYPGYSV

SEQ ID NO: 28127 - protein, 7 aa, Artificial Sequence
  Synthetic
LREGFSQ

SEQ ID NO: 28128 - protein, 7 aa, Artificial Sequence
  Synthetic
VMPGWSS

SEQ ID NO: 28129 - protein, 7 aa, Artificial Sequence
  Synthetic
AMRGYSS

SEQ ID NO: 28130 - protein, 7 aa, Artificial Sequence
  Synthetic
LQTGYSQ

SEQ ID NO: 28131 - protein, 7 aa, Artificial Sequence
  Synthetic
KHTGFSQ

SEQ ID NO: 28132 - protein, 7 aa, Artificial Sequence
  Synthetic
GFPGFST

SEQ ID NO: 28133 - protein, 7 aa, Artificial Sequence
  Synthetic
MHPGYSM

SEQ ID NO: 28134 - protein, 7 aa, Artificial Sequence
  Synthetic
WREGWST

SEQ ID NO: 28135 - protein, 7 aa, Artificial Sequence
  Synthetic
MKAGYSS

SEQ ID NO: 28136 - protein, 7 aa, Artificial Sequence
  Synthetic
LFAGYST

SEQ ID NO: 28137 - protein, 7 aa, Artificial Sequence
  Synthetic
RIPGFSA

SEQ ID NO: 28138 - protein, 7 aa, Artificial Sequence
  Synthetic
LLKGWSA

SEQ ID NO: 28139 - protein, 7 aa, Artificial Sequence
  Synthetic
SVPGWSS

SEQ ID NO: 28140 - protein, 7 aa, Artificial Sequence
  Synthetic
VVPGFSY

SEQ ID NO: 28141 - protein, 7 aa, Artificial Sequence
  Synthetic
MNHGYSM

SEQ ID NO: 28142 - protein, 7 aa, Artificial Sequence
  Synthetic
VLSGFSQ

SEQ ID NO: 28143 - protein, 7 aa, Artificial Sequence
  Synthetic
KVQGFSS

SEQ ID NO: 28144 - protein, 7 aa, Artificial Sequence
  Synthetic
SHPGFSS

SEQ ID NO: 28145 - protein, 7 aa, Artificial Sequence
  Synthetic
VFSGYSS

SEQ ID NO: 28146 - protein, 7 aa, Artificial Sequence
  Synthetic
LLRGYSN

SEQ ID NO: 28147 - protein, 7 aa, Artificial Sequence
  Synthetic
WKIGFSS

SEQ ID NO: 28148 - protein, 7 aa, Artificial Sequence
  Synthetic
DRPGFSY

SEQ ID NO: 28149 - protein, 7 aa, Artificial Sequence
  Synthetic
VHQGYSS

SEQ ID NO: 28150 - protein, 7 aa, Artificial Sequence
  Synthetic
KVPGYSA

SEQ ID NO: 28151 - protein, 7 aa, Artificial Sequence
  Synthetic
AKAGWSS

SEQ ID NO: 28152 - protein, 7 aa, Artificial Sequence
  Synthetic
TRAGYSS

SEQ ID NO: 28153 - protein, 7 aa, Artificial Sequence
  Synthetic
FMAGYSN

SEQ ID NO: 28154 - protein, 7 aa, Artificial Sequence
  Synthetic
SAPGWST

SEQ ID NO: 28155 - protein, 7 aa, Artificial Sequence
  Synthetic
LIAGYSS

SEQ ID NO: 28156 - protein, 7 aa, Artificial Sequence
  Synthetic
SYQGYSS

SEQ ID NO: 28157 - protein, 7 aa, Artificial Sequence
  Synthetic
VAHGFSM

SEQ ID NO: 28158 - protein, 7 aa, Artificial Sequence
  Synthetic
LYAGFSS

SEQ ID NO: 28159 - protein, 7 aa, Artificial Sequence
  Synthetic
GMAGWSS

SEQ ID NO: 28160 - protein, 7 aa, Artificial Sequence
  Synthetic
LNLGYSQ

SEQ ID NO: 28161 - protein, 7 aa, Artificial Sequence
  Synthetic
EFPGWSS

SEQ ID NO: 28162 - protein, 7 aa, Artificial Sequence
  Synthetic
LSIGFSV

SEQ ID NO: 28163 - protein, 7 aa, Artificial Sequence
  Synthetic
YDRGYST

SEQ ID NO: 28164 - protein, 7 aa, Artificial Sequence
  Synthetic
TAHGYSS

SEQ ID NO: 28165 - protein, 7 aa, Artificial Sequence
  Synthetic
WLHGYSS

SEQ ID NO: 28166 - protein, 7 aa, Artificial Sequence
  Synthetic
MQKGFST

SEQ ID NO: 28167 - protein, 7 aa, Artificial Sequence
  Synthetic
TMPGYSA

SEQ ID NO: 28168 - protein, 7 aa, Artificial Sequence
  Synthetic
SSPGWSS

SEQ ID NO: 28169 - protein, 7 aa, Artificial Sequence
  Synthetic
KQMGFSS

SEQ ID NO: 28170 - protein, 7 aa, Artificial Sequence
  Synthetic
KAPGFSQ

SEQ ID NO: 28171 - protein, 7 aa, Artificial Sequence
  Synthetic
VRAGFSS

SEQ ID NO: 28172 - protein, 7 aa, Artificial Sequence
  Synthetic
LEIGWSS

SEQ ID NO: 28173 - protein, 7 aa, Artificial Sequence
  Synthetic
VRSGYSA

SEQ ID NO: 28174 - protein, 7 aa, Artificial Sequence
  Synthetic
THAGFST

SEQ ID NO: 28175 - protein, 7 aa, Artificial Sequence
  Synthetic
MHSGYSS

SEQ ID NO: 28176 - protein, 7 aa, Artificial Sequence
  Synthetic
LRDGWSQ

SEQ ID NO: 28177 - protein, 7 aa, Artificial Sequence
  Synthetic
ERTGYSM

SEQ ID NO: 28178 - protein, 7 aa, Artificial Sequence
  Synthetic
VVPGFSS

SEQ ID NO: 28179 - protein, 7 aa, Artificial Sequence
  Synthetic
LRPGWSQ

SEQ ID NO: 28180 - protein, 7 aa, Artificial Sequence
  Synthetic
VNLGYSS

SEQ ID NO: 28181 - protein, 7 aa, Artificial Sequence
  Synthetic
PHAGYSA

SEQ ID NO: 28182 - protein, 7 aa, Artificial Sequence
  Synthetic
LSHGYSS

SEQ ID NO: 28183 - protein, 7 aa, Artificial Sequence
  Synthetic
QAAGWSS

SEQ ID NO: 28184 - protein, 7 aa, Artificial Sequence
  Synthetic
GAPGWST

SEQ ID NO: 28185 - protein, 7 aa, Artificial Sequence
  Synthetic
LSKGFST

SEQ ID NO: 28186 - protein, 7 aa, Artificial Sequence
  Synthetic
LREGYST

SEQ ID NO: 28187 - protein, 7 aa, Artificial Sequence
  Synthetic
HLHGYSD

SEQ ID NO: 28188 - protein, 7 aa, Artificial Sequence
  Synthetic
FSIGFSS

SEQ ID NO: 28189 - protein, 7 aa, Artificial Sequence
  Synthetic
LLKGWST

SEQ ID NO: 28190 - protein, 7 aa, Artificial Sequence
  Synthetic
IIKGYSS

SEQ ID NO: 28191 - protein, 7 aa, Artificial Sequence
  Synthetic
VVSGWSS

SEQ ID NO: 28192 - protein, 7 aa, Artificial Sequence
  Synthetic
IREGYSS

SEQ ID NO: 28193 - protein, 7 aa, Artificial Sequence
  Synthetic
SREGWST

SEQ ID NO: 28194 - protein, 7 aa, Artificial Sequence
  Synthetic
ERAGWSA

SEQ ID NO: 28195 - protein, 7 aa, Artificial Sequence
  Synthetic
MDLGWSS

SEQ ID NO: 28196 - protein, 7 aa, Artificial Sequence
  Synthetic
VMKGYSS

SEQ ID NO: 28197 - protein, 7 aa, Artificial Sequence
  Synthetic
TRTGYSV

SEQ ID NO: 28198 - protein, 7 aa, Artificial Sequence
  Synthetic
VAAGWST

SEQ ID NO: 28199 - protein, 7 aa, Artificial Sequence
  Synthetic
AYLGYSA

SEQ ID NO: 28200 - protein, 7 aa, Artificial Sequence
  Synthetic
TGHGYSS

SEQ ID NO: 28201 - protein, 7 aa, Artificial Sequence
  Synthetic
SRTGFST

SEQ ID NO: 28202 - protein, 7 aa, Artificial Sequence
  Synthetic
ILSGYSM

SEQ ID NO: 28203 - protein, 7 aa, Artificial Sequence
  Synthetic
LDVGWSS

SEQ ID NO: 28204 - protein, 7 aa, Artificial Sequence
  Synthetic
GVPGWSS

SEQ ID NO: 28205 - protein, 7 aa, Artificial Sequence
  Synthetic
SAPGWSH

SEQ ID NO: 28206 - protein, 7 aa, Artificial Sequence
  Synthetic
LNPGWST

SEQ ID NO: 28207 - protein, 7 aa, Artificial Sequence
  Synthetic
VTHGFSS

SEQ ID NO: 28208 - protein, 7 aa, Artificial Sequence
  Synthetic
AMRGFST

SEQ ID NO: 28209 - protein, 7 aa, Artificial Sequence
  Synthetic
SLIGYSS

SEQ ID NO: 28210 - protein, 7 aa, Artificial Sequence
  Synthetic
SDPGWSS

SEQ ID NO: 28211 - protein, 7 aa, Artificial Sequence
  Synthetic
NSPGWSS

SEQ ID NO: 28212 - protein, 7 aa, Artificial Sequence
  Synthetic
DRTGWST

SEQ ID NO: 28213 - protein, 7 aa, Artificial Sequence
  Synthetic
QRAGFSQ

SEQ ID NO: 28214 - protein, 7 aa, Artificial Sequence
  Synthetic
TQRGYSS

SEQ ID NO: 28215 - protein, 7 aa, Artificial Sequence
  Synthetic
HLVGFSS

SEQ ID NO: 28216 - protein, 7 aa, Artificial Sequence
  Synthetic
LGKGYST

SEQ ID NO: 28217 - protein, 7 aa, Artificial Sequence
  Synthetic
FMPGYSA

SEQ ID NO: 28218 - protein, 7 aa, Artificial Sequence
  Synthetic
SVIGYSQ

SEQ ID NO: 28219 - protein, 7 aa, Artificial Sequence
  Synthetic
TAMGFSS

SEQ ID NO: 28220 - protein, 7 aa, Artificial Sequence
  Synthetic
QGLGFSS

SEQ ID NO: 28221 - protein, 7 aa, Artificial Sequence
  Synthetic
ANHGYSM

SEQ ID NO: 28222 - protein, 7 aa, Artificial Sequence
  Synthetic
GGIGWSS

SEQ ID NO: 28223 - protein, 7 aa, Artificial Sequence
  Synthetic
QHPGFSV

SEQ ID NO: 28224 - protein, 7 aa, Artificial Sequence
  Synthetic
ERMGYSV

SEQ ID NO: 28225 - protein, 7 aa, Artificial Sequence
  Synthetic
VHVGFSS

SEQ ID NO: 28226 - protein, 7 aa, Artificial Sequence
  Synthetic
VRAGYSA

SEQ ID NO: 28227 - protein, 7 aa, Artificial Sequence
  Synthetic
LERGYSQ

SEQ ID NO: 28228 - protein, 7 aa, Artificial Sequence
  Synthetic
TGHGYST

SEQ ID NO: 28229 - protein, 7 aa, Artificial Sequence
  Synthetic
LTKGYST

SEQ ID NO: 28230 - protein, 7 aa, Artificial Sequence
  Synthetic
LNLGYSQ

SEQ ID NO: 28231 - protein, 7 aa, Artificial Sequence
  Synthetic
FLAGYST

SEQ ID NO: 28232 - protein, 7 aa, Artificial Sequence
  Synthetic
THTGFST

SEQ ID NO: 28233 - protein, 7 aa, Artificial Sequence
  Synthetic
FSKGYST

SEQ ID NO: 28234 - protein, 7 aa, Artificial Sequence
  Synthetic
YKSGWSS

SEQ ID NO: 28235 - protein, 7 aa, Artificial Sequence
  Synthetic
VHLGFSS

SEQ ID NO: 28236 - protein, 7 aa, Artificial Sequence
  Synthetic
LLGGYSQ

SEQ ID NO: 28237 - protein, 7 aa, Artificial Sequence
  Synthetic
MAVGWSA

SEQ ID NO: 28238 - protein, 7 aa, Artificial Sequence
  Synthetic
AGYGYSS

SEQ ID NO: 28239 - protein, 7 aa, Artificial Sequence
  Synthetic
MFQGYSV

SEQ ID NO: 28240 - protein, 7 aa, Artificial Sequence
  Synthetic
VMTGYSA

SEQ ID NO: 28241 - protein, 7 aa, Artificial Sequence
  Synthetic
LNVGFST

SEQ ID NO: 28242 - protein, 7 aa, Artificial Sequence
  Synthetic
TGLGFSS

SEQ ID NO: 28243 - protein, 7 aa, Artificial Sequence
  Synthetic
VERGWSS

SEQ ID NO: 28244 - protein, 7 aa, Artificial Sequence
  Synthetic
FPVGWSA

SEQ ID NO: 28245 - protein, 7 aa, Artificial Sequence
  Synthetic
TVAGFSS

SEQ ID NO: 28246 - protein, 7 aa, Artificial Sequence
  Synthetic
SSRGYSS

SEQ ID NO: 28247 - protein, 7 aa, Artificial Sequence
  Synthetic
FGVGFSS

SEQ ID NO: 28248 - protein, 7 aa, Artificial Sequence
  Synthetic
PHAGFSS

SEQ ID NO: 28249 - protein, 7 aa, Artificial Sequence
  Synthetic
IKAGYSS

SEQ ID NO: 28250 - protein, 7 aa, Artificial Sequence
  Synthetic
LMAGYSA

SEQ ID NO: 28251 - protein, 7 aa, Artificial Sequence
  Synthetic
QIPGFSA

SEQ ID NO: 28252 - protein, 7 aa, Artificial Sequence
  Synthetic
LIRGYSS

SEQ ID NO: 28253 - protein, 7 aa, Artificial Sequence
  Synthetic
EKSGYSS

SEQ ID NO: 28254 - protein, 7 aa, Artificial Sequence
  Synthetic
EMPGFSA

SEQ ID NO: 28255 - protein, 7 aa, Artificial Sequence
  Synthetic
PKVGFSA

SEQ ID NO: 28256 - protein, 7 aa, Artificial Sequence
  Synthetic
ARSGFSS

SEQ ID NO: 28257 - protein, 7 aa, Artificial Sequence
  Synthetic
MVHGFSS

SEQ ID NO: 28258 - protein, 7 aa, Artificial Sequence
  Synthetic
WMKGYSM

SEQ ID NO: 28259 - protein, 7 aa, Artificial Sequence
  Synthetic
ERTGWSV

SEQ ID NO: 28260 - protein, 7 aa, Artificial Sequence
  Synthetic
ARLGYST

SEQ ID NO: 28261 - protein, 7 aa, Artificial Sequence
  Synthetic
SKAGYSA

SEQ ID NO: 28262 - protein, 7 aa, Artificial Sequence
  Synthetic
WKSGFSS

SEQ ID NO: 28263 - protein, 7 aa, Artificial Sequence
  Synthetic
LLHGYSV

SEQ ID NO: 28264 - protein, 7 aa, Artificial Sequence
  Synthetic
AYPGYSS

SEQ ID NO: 28265 - protein, 7 aa, Artificial Sequence
  Synthetic
IATGYSS

SEQ ID NO: 28266 - protein, 7 aa, Artificial Sequence
  Synthetic
PVRGFSA

SEQ ID NO: 28267 - protein, 7 aa, Artificial Sequence
  Synthetic
LVPGWSV

SEQ ID NO: 28268 - protein, 7 aa, Artificial Sequence
  Synthetic
PAVGFSA

SEQ ID NO: 28269 - protein, 7 aa, Artificial Sequence
  Synthetic
LGLGFSV

SEQ ID NO: 28270 - protein, 7 aa, Artificial Sequence
  Synthetic
ISVGWSS

SEQ ID NO: 28271 - protein, 7 aa, Artificial Sequence
  Synthetic
VGHGFSQ

SEQ ID NO: 28272 - protein, 7 aa, Artificial Sequence
  Synthetic
SRVGYST

SEQ ID NO: 28273 - protein, 7 aa, Artificial Sequence
  Synthetic
SVAGYSQ

SEQ ID NO: 28274 - protein, 7 aa, Artificial Sequence
  Synthetic
ELPGWSV

SEQ ID NO: 28275 - protein, 7 aa, Artificial Sequence
  Synthetic
RSPGYSQ

SEQ ID NO: 28276 - protein, 7 aa, Artificial Sequence
  Synthetic
FIPGFSQ

SEQ ID NO: 28277 - protein, 7 aa, Artificial Sequence
  Synthetic
LFGGYST

SEQ ID NO: 28278 - protein, 7 aa, Artificial Sequence
  Synthetic
VRDGWSS

SEQ ID NO: 28279 - protein, 7 aa, Artificial Sequence
  Synthetic
MDRGFSS

SEQ ID NO: 28280 - protein, 7 aa, Artificial Sequence
  Synthetic
LSIGWSQ

SEQ ID NO: 28281 - protein, 7 aa, Artificial Sequence
  Synthetic
AQVGWSA

SEQ ID NO: 28282 - protein, 7 aa, Artificial Sequence
  Synthetic
VTRGYSM

SEQ ID NO: 28283 - protein, 7 aa, Artificial Sequence
  Synthetic
RVPGYSM

SEQ ID NO: 28284 - protein, 7 aa, Artificial Sequence
  Synthetic
TVHGYST

SEQ ID NO: 28285 - protein, 7 aa, Artificial Sequence
  Synthetic
RWEGFSQ

SEQ ID NO: 28286 - protein, 7 aa, Artificial Sequence
  Synthetic
TVTGFSQ

SEQ ID NO: 28287 - protein, 7 aa, Artificial Sequence
  Synthetic
RSAGFSS

SEQ ID NO: 28288 - protein, 7 aa, Artificial Sequence
  Synthetic
SFPGWSA

SEQ ID NO: 28289 - protein, 7 aa, Artificial Sequence
  Synthetic
GLIGWSS

SEQ ID NO: 28290 - protein, 7 aa, Artificial Sequence
  Synthetic
SGVGWSS

SEQ ID NO: 28291 - protein, 7 aa, Artificial Sequence
  Synthetic
QMTGWSS

SEQ ID NO: 28292 - protein, 7 aa, Artificial Sequence
  Synthetic
TSRGYSM

SEQ ID NO: 28293 - protein, 7 aa, Artificial Sequence
  Synthetic
ARPGFSS

SEQ ID NO: 28294 - protein, 7 aa, Artificial Sequence
  Synthetic
GFPGYSS

SEQ ID NO: 28295 - protein, 7 aa, Artificial Sequence
  Synthetic
TYAGYSA

SEQ ID NO: 28296 - protein, 7 aa, Artificial Sequence
  Synthetic
LDRGFSS

SEQ ID NO: 28297 - protein, 7 aa, Artificial Sequence
  Synthetic
SSPGFSS

SEQ ID NO: 28298 - protein, 7 aa, Artificial Sequence
  Synthetic
KMPGWST

SEQ ID NO: 28299 - protein, 7 aa, Artificial Sequence
  Synthetic
VARGYSM

SEQ ID NO: 28300 - protein, 7 aa, Artificial Sequence
  Synthetic
AGVGFSS

SEQ ID NO: 28301 - protein, 7 aa, Artificial Sequence
  Synthetic
AVRGFSS

SEQ ID NO: 28302 - protein, 7 aa, Artificial Sequence
  Synthetic
MLSGYSM

SEQ ID NO: 28303 - protein, 7 aa, Artificial Sequence
  Synthetic
DWRGYSS

SEQ ID NO: 28304 - protein, 7 aa, Artificial Sequence
  Synthetic
WAAGYSY

SEQ ID NO: 28305 - protein, 7 aa, Artificial Sequence
  Synthetic
VHQGYST

SEQ ID NO: 28306 - protein, 7 aa, Artificial Sequence
  Synthetic
LGSGWST

SEQ ID NO: 28307 - protein, 7 aa, Artificial Sequence
  Synthetic
FVPGFSQ

SEQ ID NO: 28308 - protein, 7 aa, Artificial Sequence
  Synthetic
DNRGWST

SEQ ID NO: 28309 - protein, 7 aa, Artificial Sequence
  Synthetic
ERSGFSS

SEQ ID NO: 28310 - protein, 7 aa, Artificial Sequence
  Synthetic
TGIGYSQ

SEQ ID NO: 28311 - protein, 7 aa, Artificial Sequence
  Synthetic
HLRGYSE

SEQ ID NO: 28312 - protein, 7 aa, Artificial Sequence
  Synthetic
GGIGWSS

SEQ ID NO: 28313 - protein, 7 aa, Artificial Sequence
  Synthetic
LHVGYSA

SEQ ID NO: 28314 - protein, 7 aa, Artificial Sequence
  Synthetic
SWSGYSA

SEQ ID NO: 28315 - protein, 7 aa, Artificial Sequence
  Synthetic
VFAGFSA

SEQ ID NO: 28316 - protein, 7 aa, Artificial Sequence
  Synthetic
ITIGYSQ

SEQ ID NO: 28317 - protein, 7 aa, Artificial Sequence
  Synthetic
EKVGWSQ

SEQ ID NO: 28318 - protein, 7 aa, Artificial Sequence
  Synthetic
LAIGWSS

SEQ ID NO: 28319 - protein, 7 aa, Artificial Sequence
  Synthetic
SHAGYST

SEQ ID NO: 28320 - protein, 7 aa, Artificial Sequence
  Synthetic
VRVGFSS

SEQ ID NO: 28321 - protein, 7 aa, Artificial Sequence
  Synthetic
TAKGWSS

SEQ ID NO: 28322 - protein, 7 aa, Artificial Sequence
  Synthetic
ERTGWSA

SEQ ID NO: 28323 - protein, 7 aa, Artificial Sequence
  Synthetic
LERGYST

SEQ ID NO: 28324 - protein, 7 aa, Artificial Sequence
  Synthetic
GYPGFST

SEQ ID NO: 28325 - protein, 7 aa, Artificial Sequence
  Synthetic
MRTGFSQ

SEQ ID NO: 28326 - protein, 7 aa, Artificial Sequence
  Synthetic
IARGYSV

SEQ ID NO: 28327 - protein, 7 aa, Artificial Sequence
  Synthetic
DIPGWSH

SEQ ID NO: 28328 - protein, 7 aa, Artificial Sequence
  Synthetic
TIRGFSV

SEQ ID NO: 28329 - protein, 7 aa, Artificial Sequence
  Synthetic
LMVGYSV

SEQ ID NO: 28330 - protein, 7 aa, Artificial Sequence
  Synthetic
TRTGYST

SEQ ID NO: 28331 - protein, 7 aa, Artificial Sequence
  Synthetic
SHVGWSQ

SEQ ID NO: 28332 - protein, 7 aa, Artificial Sequence
  Synthetic
DLPGWSS

SEQ ID NO: 28333 - protein, 7 aa, Artificial Sequence
  Synthetic
LEQGWST

SEQ ID NO: 28334 - protein, 7 aa, Artificial Sequence
  Synthetic
IAQGYST

SEQ ID NO: 28335 - protein, 7 aa, Artificial Sequence
  Synthetic
DKTGWSS

SEQ ID NO: 28336 - protein, 7 aa, Artificial Sequence
  Synthetic
HFSGYST

SEQ ID NO: 28337 - protein, 7 aa, Artificial Sequence
  Synthetic
LEVGWST

SEQ ID NO: 28338 - protein, 7 aa, Artificial Sequence
  Synthetic
MMIGWSA

SEQ ID NO: 28339 - protein, 7 aa, Artificial Sequence
  Synthetic
LVHGFSV

SEQ ID NO: 28340 - protein, 7 aa, Artificial Sequence
  Synthetic
EIPGYSQ

SEQ ID NO: 28341 - protein, 7 aa, Artificial Sequence
  Synthetic
EAPGYSS

SEQ ID NO: 28342 - protein, 7 aa, Artificial Sequence
  Synthetic
MGVGFSS

SEQ ID NO: 28343 - protein, 7 aa, Artificial Sequence
  Synthetic
QVAGWSA

SEQ ID NO: 28344 - protein, 7 aa, Artificial Sequence
  Synthetic
LKPGFSS

SEQ ID NO: 28345 - protein, 7 aa, Artificial Sequence
  Synthetic
LQIGFST

SEQ ID NO: 28346 - protein, 7 aa, Artificial Sequence
  Synthetic
SFVGFSA

SEQ ID NO: 28347 - protein, 7 aa, Artificial Sequence
  Synthetic
YSHGYSQ

SEQ ID NO: 28348 - protein, 7 aa, Artificial Sequence
  Synthetic
VMLGYSA

SEQ ID NO: 28349 - protein, 7 aa, Artificial Sequence
  Synthetic
YHIGYSA

SEQ ID NO: 28350 - protein, 7 aa, Artificial Sequence
  Synthetic
GFPGFST

SEQ ID NO: 28351 - protein, 7 aa, Artificial Sequence
  Synthetic
SREGYST

SEQ ID NO: 28352 - protein, 7 aa, Artificial Sequence
  Synthetic
AQPGWSS

SEQ ID NO: 28353 - protein, 7 aa, Artificial Sequence
  Synthetic
IVKGYSA

SEQ ID NO: 28354 - protein, 7 aa, Artificial Sequence
  Synthetic
VAAGWSQ

SEQ ID NO: 28355 - protein, 7 aa, Artificial Sequence
  Synthetic
VMKGYSA

SEQ ID NO: 28356 - protein, 7 aa, Artificial Sequence
  Synthetic
VVSGWSS

SEQ ID NO: 28357 - protein, 7 aa, Artificial Sequence
  Synthetic
PSLGWSS

SEQ ID NO: 28358 - protein, 7 aa, Artificial Sequence
  Synthetic
YHVGWSA

SEQ ID NO: 28359 - protein, 7 aa, Artificial Sequence
  Synthetic
LQSGWSV

SEQ ID NO: 28360 - protein, 7 aa, Artificial Sequence
  Synthetic
LQEGWSH

SEQ ID NO: 28361 - protein, 7 aa, Artificial Sequence
  Synthetic
MQVGWSS

SEQ ID NO: 28362 - protein, 7 aa, Artificial Sequence
  Synthetic
DRSGFSW

SEQ ID NO: 28363 - protein, 7 aa, Artificial Sequence
  Synthetic
MTTGWSS

SEQ ID NO: 28364 - protein, 7 aa, Artificial Sequence
  Synthetic
EPPGWSH

SEQ ID NO: 28365 - protein, 7 aa, Artificial Sequence
  Synthetic
HDYGFSQ

SEQ ID NO: 28366 - protein, 7 aa, Artificial Sequence
  Synthetic
TRVGFSH

SEQ ID NO: 28367 - protein, 7 aa, Artificial Sequence
  Synthetic
LNVGWSS

SEQ ID NO: 28368 - protein, 7 aa, Artificial Sequence
  Synthetic
VDRGYSQ

SEQ ID NO: 28369 - protein, 7 aa, Artificial Sequence
  Synthetic
QRPGYSA

SEQ ID NO: 28370 - protein, 7 aa, Artificial Sequence
  Synthetic
SAQGYST

SEQ ID NO: 28371 - protein, 7 aa, Artificial Sequence
  Synthetic
LKGGWSS

SEQ ID NO: 28372 - protein, 7 aa, Artificial Sequence
  Synthetic
LKLGFST

SEQ ID NO: 28373 - protein, 7 aa, Artificial Sequence
  Synthetic
MHSGFSV

SEQ ID NO: 28374 - protein, 7 aa, Artificial Sequence
  Synthetic
SVVGWSA

SEQ ID NO: 28375 - protein, 7 aa, Artificial Sequence
  Synthetic
VAVGWSA

SEQ ID NO: 28376 - protein, 7 aa, Artificial Sequence
  Synthetic
ERHGFSY

SEQ ID NO: 28377 - protein, 7 aa, Artificial Sequence
  Synthetic
FGVGFST

SEQ ID NO: 28378 - protein, 7 aa, Artificial Sequence
  Synthetic
FIAGWSS

SEQ ID NO: 28379 - protein, 7 aa, Artificial Sequence
  Synthetic
MNAGFSS

SEQ ID NO: 28380 - protein, 7 aa, Artificial Sequence
  Synthetic
DRIGYSY

SEQ ID NO: 28381 - protein, 7 aa, Artificial Sequence
  Synthetic
VKAGYSS

SEQ ID NO: 28382 - protein, 7 aa, Artificial Sequence
  Synthetic
DKLGWSA

SEQ ID NO: 28383 - protein, 7 aa, Artificial Sequence
  Synthetic
IVIGFSS

SEQ ID NO: 28384 - protein, 7 aa, Artificial Sequence
  Synthetic
KMPGWSS

SEQ ID NO: 28385 - protein, 7 aa, Artificial Sequence
  Synthetic
LARGYSS

SEQ ID NO: 28386 - protein, 7 aa, Artificial Sequence
  Synthetic
VFSGFSS

SEQ ID NO: 28387 - protein, 7 aa, Artificial Sequence
  Synthetic
WLPGFSQ

SEQ ID NO: 28388 - protein, 7 aa, Artificial Sequence
  Synthetic
LYVGFSS

SEQ ID NO: 28389 - protein, 7 aa, Artificial Sequence
  Synthetic
ALHGYSI

SEQ ID NO: 28390 - protein, 7 aa, Artificial Sequence
  Synthetic
TLHGWSA

SEQ ID NO: 28391 - protein, 7 aa, Artificial Sequence
  Synthetic
IILGYST

SEQ ID NO: 28392 - protein, 7 aa, Artificial Sequence
  Synthetic
SRVGFST

SEQ ID NO: 28393 - protein, 7 aa, Artificial Sequence
  Synthetic
VATGWSS

SEQ ID NO: 28394 - protein, 7 aa, Artificial Sequence
  Synthetic
MFVGFSA

SEQ ID NO: 28395 - protein, 7 aa, Artificial Sequence
  Synthetic
TFVGYSS

SEQ ID NO: 28396 - protein, 7 aa, Artificial Sequence
  Synthetic
PPGGWSS

SEQ ID NO: 28397 - protein, 7 aa, Artificial Sequence
  Synthetic
PGKGYSS

SEQ ID NO: 28398 - protein, 7 aa, Artificial Sequence
  Synthetic
SHIGFSA

SEQ ID NO: 28399 - protein, 7 aa, Artificial Sequence
  Synthetic
PRAGFSM

SEQ ID NO: 28400 - protein, 7 aa, Artificial Sequence
  Synthetic
TISGYST

SEQ ID NO: 28401 - protein, 7 aa, Artificial Sequence
  Synthetic
AYAGYSL

SEQ ID NO: 28402 - protein, 7 aa, Artificial Sequence
  Synthetic
VNKGYST

SEQ ID NO: 28403 - protein, 7 aa, Artificial Sequence
  Synthetic
LYPGFSA

SEQ ID NO: 28404 - protein, 7 aa, Artificial Sequence
  Synthetic
VSMGYSS

SEQ ID NO: 28405 - protein, 7 aa, Artificial Sequence
  Synthetic
PAGGFSV

SEQ ID NO: 28406 - protein, 7 aa, Artificial Sequence
  Synthetic
VVRGYSA

SEQ ID NO: 28407 - protein, 7 aa, Artificial Sequence
  Synthetic
PGPGFSS

SEQ ID NO: 28408 - protein, 7 aa, Artificial Sequence
  Synthetic
ASYGYSS

SEQ ID NO: 28409 - protein, 7 aa, Artificial Sequence
  Synthetic
IAIGYST

SEQ ID NO: 28410 - protein, 7 aa, Artificial Sequence
  Synthetic
DFRGYSV

SEQ ID NO: 28411 - protein, 7 aa, Artificial Sequence
  Synthetic
QKIGYSA

SEQ ID NO: 28412 - protein, 7 aa, Artificial Sequence
  Synthetic
SLVGYSY

SEQ ID NO: 28413 - protein, 7 aa, Artificial Sequence
  Synthetic
DRHGYSS

SEQ ID NO: 28414 - protein, 7 aa, Artificial Sequence
  Synthetic
YLNGYSI

SEQ ID NO: 28415 - protein, 7 aa, Artificial Sequence
  Synthetic
IVHGFST

SEQ ID NO: 28416 - protein, 7 aa, Artificial Sequence
  Synthetic
CQVGFSS

SEQ ID NO: 28417 - protein, 7 aa, Artificial Sequence
  Synthetic
SGVGWSS

SEQ ID NO: 28418 - protein, 7 aa, Artificial Sequence
  Synthetic
FAQGFSS

SEQ ID NO: 28419 - protein, 7 aa, Artificial Sequence
  Synthetic
EYEGWSS

SEQ ID NO: 28420 - protein, 7 aa, Artificial Sequence
  Synthetic
VSKGYSS

SEQ ID NO: 28421 - protein, 7 aa, Artificial Sequence
  Synthetic
ILPGWST

SEQ ID NO: 28422 - protein, 7 aa, Artificial Sequence
  Synthetic
WVHGYSS

SEQ ID NO: 28423 - protein, 7 aa, Artificial Sequence
  Synthetic
SYQGFSS

SEQ ID NO: 28424 - protein, 7 aa, Artificial Sequence
  Synthetic
SRPGYSA

SEQ ID NO: 28425 - protein, 7 aa, Artificial Sequence
  Synthetic
NRVGYSS

SEQ ID NO: 28426 - protein, 7 aa, Artificial Sequence
  Synthetic
VLTGWSA

SEQ ID NO: 28427 - protein, 7 aa, Artificial Sequence
  Synthetic
ANPGWST

SEQ ID NO: 28428 - protein, 7 aa, Artificial Sequence
  Synthetic
EKAGWSV

SEQ ID NO: 28429 - protein, 7 aa, Artificial Sequence
  Synthetic
EHHGFSM

SEQ ID NO: 28430 - protein, 7 aa, Artificial Sequence
  Synthetic
PAGGFSA

SEQ ID NO: 28431 - protein, 7 aa, Artificial Sequence
  Synthetic
TFAGWSA

SEQ ID NO: 28432 - protein, 7 aa, Artificial Sequence
  Synthetic
VMLGYSS

SEQ ID NO: 28433 - protein, 7 aa, Artificial Sequence
  Synthetic
LLLGYSA

SEQ ID NO: 28434 - protein, 7 aa, Artificial Sequence
  Synthetic
MREGWSS

SEQ ID NO: 28435 - protein, 7 aa, Artificial Sequence
  Synthetic
ERTGFSA

SEQ ID NO: 28436 - protein, 7 aa, Artificial Sequence
  Synthetic
WKTGYSS

SEQ ID NO: 28437 - protein, 7 aa, Artificial Sequence
  Synthetic
LRVGFSM

SEQ ID NO: 28438 - protein, 7 aa, Artificial Sequence
  Synthetic
VERGWSA

SEQ ID NO: 28439 - protein, 7 aa, Artificial Sequence
  Synthetic
SRPGWSV

SEQ ID NO: 28440 - protein, 7 aa, Artificial Sequence
  Synthetic
IIAGYSA

SEQ ID NO: 28441 - protein, 7 aa, Artificial Sequence
  Synthetic
ILVGYSV

SEQ ID NO: 28442 - protein, 7 aa, Artificial Sequence
  Synthetic
SSPGYSS

SEQ ID NO: 28443 - protein, 7 aa, Artificial Sequence
  Synthetic
AAVGWST

SEQ ID NO: 28444 - protein, 7 aa, Artificial Sequence
  Synthetic
RAEGWSS

SEQ ID NO: 28445 - protein, 7 aa, Artificial Sequence
  Synthetic
PIRGFST

SEQ ID NO: 28446 - protein, 7 aa, Artificial Sequence
  Synthetic
SLPGWSA

SEQ ID NO: 28447 - protein, 7 aa, Artificial Sequence
  Synthetic
LSYGYSV

SEQ ID NO: 28448 - protein, 7 aa, Artificial Sequence
  Synthetic
MFTGFSS

SEQ ID NO: 28449 - protein, 7 aa, Artificial Sequence
  Synthetic
QSAGWST

SEQ ID NO: 28450 - protein, 7 aa, Artificial Sequence
  Synthetic
AGVGFSM

SEQ ID NO: 28451 - protein, 7 aa, Artificial Sequence
  Synthetic
VRAGYSS

SEQ ID NO: 28452 - protein, 7 aa, Artificial Sequence
  Synthetic
ERNGWST

SEQ ID NO: 28453 - protein, 7 aa, Artificial Sequence
  Synthetic
VWGGFSE

SEQ ID NO: 28454 - protein, 7 aa, Artificial Sequence
  Synthetic
LTQGYSQ

SEQ ID NO: 28455 - protein, 7 aa, Artificial Sequence
  Synthetic
HERGYSS

SEQ ID NO: 28456 - protein, 7 aa, Artificial Sequence
  Synthetic
FGLGYST

SEQ ID NO: 28457 - protein, 7 aa, Artificial Sequence
  Synthetic
LTAGYSS

SEQ ID NO: 28458 - protein, 7 aa, Artificial Sequence
  Synthetic
LHAGFSH

SEQ ID NO: 28459 - protein, 7 aa, Artificial Sequence
  Synthetic
VTFGYST

SEQ ID NO: 28460 - protein, 7 aa, Artificial Sequence
  Synthetic
AVVGWSS

SEQ ID NO: 28461 - protein, 7 aa, Artificial Sequence
  Synthetic
LIAGYSQ

SEQ ID NO: 28462 - protein, 7 aa, Artificial Sequence
  Synthetic
ESHGFSS

SEQ ID NO: 28463 - protein, 7 aa, Artificial Sequence
  Synthetic
SHVGYSS

SEQ ID NO: 28464 - protein, 7 aa, Artificial Sequence
  Synthetic
EIPGYSS

SEQ ID NO: 28465 - protein, 7 aa, Artificial Sequence
  Synthetic
SHTGFST

SEQ ID NO: 28466 - protein, 7 aa, Artificial Sequence
  Synthetic
LLLGYST

SEQ ID NO: 28467 - protein, 7 aa, Artificial Sequence
  Synthetic
GAFGFSS

SEQ ID NO: 28468 - protein, 7 aa, Artificial Sequence
  Synthetic
VHPGYSM

SEQ ID NO: 28469 - protein, 7 aa, Artificial Sequence
  Synthetic
GYVGFST

SEQ ID NO: 28470 - protein, 7 aa, Artificial Sequence
  Synthetic
PEPGWSA

SEQ ID NO: 28471 - protein, 7 aa, Artificial Sequence
  Synthetic
LHSGYSQ

SEQ ID NO: 28472 - protein, 7 aa, Artificial Sequence
  Synthetic
AIPGWSS

SEQ ID NO: 28473 - protein, 7 aa, Artificial Sequence
  Synthetic
VGHGFSS

SEQ ID NO: 28474 - protein, 7 aa, Artificial Sequence
  Synthetic
SKQGWSS

SEQ ID NO: 28475 - protein, 7 aa, Artificial Sequence
  Synthetic
LSRGFST

SEQ ID NO: 28476 - protein, 7 aa, Artificial Sequence
  Synthetic
VARGFST

SEQ ID NO: 28477 - protein, 7 aa, Artificial Sequence
  Synthetic
FLSGFSQ

SEQ ID NO: 28478 - protein, 7 aa, Artificial Sequence
  Synthetic
VFAGYST

SEQ ID NO: 28479 - protein, 7 aa, Artificial Sequence
  Synthetic
IMMGFSA

SEQ ID NO: 28480 - protein, 7 aa, Artificial Sequence
  Synthetic
ERGGYSS

SEQ ID NO: 28481 - protein, 7 aa, Artificial Sequence
  Synthetic
VYPGFSV

SEQ ID NO: 28482 - protein, 7 aa, Artificial Sequence
  Synthetic
VYAGYSS

SEQ ID NO: 28483 - protein, 7 aa, Artificial Sequence
  Synthetic
KAPGFSV

SEQ ID NO: 28484 - protein, 7 aa, Artificial Sequence
  Synthetic
PVAGWSS

SEQ ID NO: 28485 - protein, 7 aa, Artificial Sequence
  Synthetic
AYSGYSL

SEQ ID NO: 28486 - protein, 7 aa, Artificial Sequence
  Synthetic
QVRGFSS

SEQ ID NO: 28487 - protein, 7 aa, Artificial Sequence
  Synthetic
IAMGYST

SEQ ID NO: 28488 - protein, 7 aa, Artificial Sequence
  Synthetic
QYKGYST

SEQ ID NO: 28489 - protein, 7 aa, Artificial Sequence
  Synthetic
SFMGYSS

SEQ ID NO: 28490 - protein, 7 aa, Artificial Sequence
  Synthetic
SSIGWSA

SEQ ID NO: 28491 - protein, 7 aa, Artificial Sequence
  Synthetic
AVPGWSM

SEQ ID NO: 28492 - protein, 7 aa, Artificial Sequence
  Synthetic
EARGFSQ

SEQ ID NO: 28493 - protein, 7 aa, Artificial Sequence
  Synthetic
DRPGYSS

SEQ ID NO: 28494 - protein, 7 aa, Artificial Sequence
  Synthetic
LVAGYSS

SEQ ID NO: 28495 - protein, 7 aa, Artificial Sequence
  Synthetic
SNPGFSS

SEQ ID NO: 28496 - protein, 7 aa, Artificial Sequence
  Synthetic
EQRGWSA

SEQ ID NO: 28497 - protein, 7 aa, Artificial Sequence
  Synthetic
LVKGWSV

SEQ ID NO: 28498 - protein, 7 aa, Artificial Sequence
  Synthetic
MMVGFSS

SEQ ID NO: 28499 - protein, 7 aa, Artificial Sequence
  Synthetic
HMVGWSS

SEQ ID NO: 28500 - protein, 7 aa, Artificial Sequence
  Synthetic
WVHGYSQ

SEQ ID NO: 28501 - protein, 7 aa, Artificial Sequence
  Synthetic
VDRGYSV

SEQ ID NO: 28502 - protein, 7 aa, Artificial Sequence
  Synthetic
FWEGFSA

SEQ ID NO: 28503 - protein, 7 aa, Artificial Sequence
  Synthetic
EMLGFSS

SEQ ID NO: 28504 - protein, 7 aa, Artificial Sequence
  Synthetic
GSMGWSS

SEQ ID NO: 28505 - protein, 7 aa, Artificial Sequence
  Synthetic
IVKGYSS

SEQ ID NO: 28506 - protein, 7 aa, Artificial Sequence
  Synthetic
ERGGWSA

SEQ ID NO: 28507 - protein, 7 aa, Artificial Sequence
  Synthetic
VGFGYSM

SEQ ID NO: 28508 - protein, 7 aa, Artificial Sequence
  Synthetic
FAHGYSS

SEQ ID NO: 28509 - protein, 7 aa, Artificial Sequence
  Synthetic
VAQGWSQ

SEQ ID NO: 28510 - protein, 7 aa, Artificial Sequence
  Synthetic
PGIGYSS

SEQ ID NO: 28511 - protein, 7 aa, Artificial Sequence
  Synthetic
QSFGYSS

SEQ ID NO: 28512 - protein, 7 aa, Artificial Sequence
  Synthetic
IGPGWSM

SEQ ID NO: 28513 - protein, 7 aa, Artificial Sequence
  Synthetic
VKIGWST

SEQ ID NO: 28514 - protein, 7 aa, Artificial Sequence
  Synthetic
QHQGWSS

SEQ ID NO: 28515 - protein, 7 aa, Artificial Sequence
  Synthetic
SHPGWSA

SEQ ID NO: 28516 - protein, 7 aa, Artificial Sequence
  Synthetic
LAMGFST

SEQ ID NO: 28517 - protein, 7 aa, Artificial Sequence
  Synthetic
VNVGYSS

SEQ ID NO: 28518 - protein, 7 aa, Artificial Sequence
  Synthetic
TTMGYSS

SEQ ID NO: 28519 - protein, 7 aa, Artificial Sequence
  Synthetic
GYPGFSS

SEQ ID NO: 28520 - protein, 7 aa, Artificial Sequence
  Synthetic
RHPGYSV

SEQ ID NO: 28521 - protein, 7 aa, Artificial Sequence
  Synthetic
LIEGWST

SEQ ID NO: 28522 - protein, 7 aa, Artificial Sequence
  Synthetic
MNLGFSS

SEQ ID NO: 28523 - protein, 7 aa, Artificial Sequence
  Synthetic
LAVGWSS

SEQ ID NO: 28524 - protein, 7 aa, Artificial Sequence
  Synthetic
DRMGFSQ

SEQ ID NO: 28525 - protein, 7 aa, Artificial Sequence
  Synthetic
HRSGFSQ

SEQ ID NO: 28526 - protein, 7 aa, Artificial Sequence
  Synthetic
PGHGFSV

SEQ ID NO: 28527 - protein, 7 aa, Artificial Sequence
  Synthetic
NVVGWSS

SEQ ID NO: 28528 - protein, 7 aa, Artificial Sequence
  Synthetic
VLRGYSA

SEQ ID NO: 28529 - protein, 7 aa, Artificial Sequence
  Synthetic
QVPGYSA

SEQ ID NO: 28530 - protein, 7 aa, Artificial Sequence
  Synthetic
VSIGWSS

SEQ ID NO: 28531 - protein, 7 aa, Artificial Sequence
  Synthetic
ALVGYSF

SEQ ID NO: 28532 - protein, 7 aa, Artificial Sequence
  Synthetic
VYHGFSQ

SEQ ID NO: 28533 - protein, 7 aa, Artificial Sequence
  Synthetic
MYEGFSQ

SEQ ID NO: 28534 - protein, 7 aa, Artificial Sequence
  Synthetic
INQGWST

SEQ ID NO: 28535 - protein, 7 aa, Artificial Sequence
  Synthetic
MGVGFSS

SEQ ID NO: 28536 - protein, 7 aa, Artificial Sequence
  Synthetic
FATGFSS

SEQ ID NO: 28537 - protein, 7 aa, Artificial Sequence
  Synthetic
MKPGWST

SEQ ID NO: 28538 - protein, 7 aa, Artificial Sequence
  Synthetic
ARHGFSS

SEQ ID NO: 28539 - protein, 7 aa, Artificial Sequence
  Synthetic
FAQGFST

SEQ ID NO: 28540 - protein, 7 aa, Artificial Sequence
  Synthetic
AMAGWSA

SEQ ID NO: 28541 - protein, 7 aa, Artificial Sequence
  Synthetic
ENKGWSS

SEQ ID NO: 28542 - protein, 7 aa, Artificial Sequence
  Synthetic
LHLGFST

SEQ ID NO: 28543 - protein, 7 aa, Artificial Sequence
  Synthetic
ATIGWSS

SEQ ID NO: 28544 - protein, 7 aa, Artificial Sequence
  Synthetic
SSHGFST

SEQ ID NO: 28545 - protein, 7 aa, Artificial Sequence
  Synthetic
PHLGYSA

SEQ ID NO: 28546 - protein, 7 aa, Artificial Sequence
  Synthetic
AKFGYST

SEQ ID NO: 28547 - protein, 7 aa, Artificial Sequence
  Synthetic
NRPGFSQ

SEQ ID NO: 28548 - protein, 7 aa, Artificial Sequence
  Synthetic
SAIGYST

SEQ ID NO: 28549 - protein, 7 aa, Artificial Sequence
  Synthetic
FGSGWSH

SEQ ID NO: 28550 - protein, 7 aa, Artificial Sequence
  Synthetic
QFAGFST

SEQ ID NO: 28551 - protein, 7 aa, Artificial Sequence
  Synthetic
KALGFSM

SEQ ID NO: 28552 - protein, 7 aa, Artificial Sequence
  Synthetic
TIVGFST

SEQ ID NO: 28553 - protein, 7 aa, Artificial Sequence
  Synthetic
ILSGYSL

SEQ ID NO: 28554 - protein, 7 aa, Artificial Sequence
  Synthetic
DYQGFSV

SEQ ID NO: 28555 - protein, 7 aa, Artificial Sequence
  Synthetic
ERVGYSV

SEQ ID NO: 28556 - protein, 7 aa, Artificial Sequence
  Synthetic
LTQGYSQ

SEQ ID NO: 28557 - protein, 7 aa, Artificial Sequence
  Synthetic
GYGGWSM

SEQ ID NO: 28558 - protein, 7 aa, Artificial Sequence
  Synthetic
SREGWST

SEQ ID NO: 28559 - protein, 7 aa, Artificial Sequence
  Synthetic
VTRGFST

SEQ ID NO: 28560 - protein, 7 aa, Artificial Sequence
  Synthetic
FYDGYSS

SEQ ID NO: 28561 - protein, 7 aa, Artificial Sequence
  Synthetic
FVLGYSS

SEQ ID NO: 28562 - protein, 7 aa, Artificial Sequence
  Synthetic
WLAGFSA

SEQ ID NO: 28563 - protein, 7 aa, Artificial Sequence
  Synthetic
AGVGWST

SEQ ID NO: 28564 - protein, 7 aa, Artificial Sequence
  Synthetic
SQVGFSS

SEQ ID NO: 28565 - protein, 7 aa, Artificial Sequence
  Synthetic
FLHGYSE

SEQ ID NO: 28566 - protein, 7 aa, Artificial Sequence
  Synthetic
FVPGFSS

SEQ ID NO: 28567 - protein, 7 aa, Artificial Sequence
  Synthetic
LIPGFSL

SEQ ID NO: 28568 - protein, 7 aa, Artificial Sequence
  Synthetic
MVHGYSS

SEQ ID NO: 28569 - protein, 7 aa, Artificial Sequence
  Synthetic
AGRGFSS

SEQ ID NO: 28570 - protein, 7 aa, Artificial Sequence
  Synthetic
RVPGFSS

SEQ ID NO: 28571 - protein, 7 aa, Artificial Sequence
  Synthetic
THHGYSV

SEQ ID NO: 28572 - protein, 7 aa, Artificial Sequence
  Synthetic
TMVGWSA

SEQ ID NO: 28573 - protein, 7 aa, Artificial Sequence
  Synthetic
SAVGYSS

SEQ ID NO: 28574 - protein, 7 aa, Artificial Sequence
  Synthetic
TTIGYSS

SEQ ID NO: 28575 - protein, 7 aa, Artificial Sequence
  Synthetic
ERLGYSS

SEQ ID NO: 28576 - protein, 7 aa, Artificial Sequence
  Synthetic
TDHGYSS

SEQ ID NO: 28577 - protein, 7 aa, Artificial Sequence
  Synthetic
ERAGYSA

SEQ ID NO: 28578 - protein, 7 aa, Artificial Sequence
  Synthetic
QHVGYSS

SEQ ID NO: 28579 - protein, 7 aa, Artificial Sequence
  Synthetic
ERNGWSS

SEQ ID NO: 28580 - protein, 7 aa, Artificial Sequence
  Synthetic
RGLGYSS

SEQ ID NO: 28581 - protein, 7 aa, Artificial Sequence
  Synthetic
IGTGWSS

SEQ ID NO: 28582 - protein, 7 aa, Artificial Sequence
  Synthetic
DRYGYSA

SEQ ID NO: 28583 - skipped

SEQ ID NO: 28584 - protein, 7 aa, Artificial Sequence
  Synthetic
GVHPGVW

SEQ ID NO: 28585 - protein, 7 aa, Artificial Sequence
  Synthetic
FDHPGVW

SEQ ID NO: 28586 - protein, 7 aa, Artificial Sequence
  Synthetic
PVNPGVW

SEQ ID NO: 28587 - protein, 7 aa, Artificial Sequence
  Synthetic
NSHPGVW

SEQ ID NO: 28588 - protein, 7 aa, Artificial Sequence
  Synthetic
GGNPGVW

SEQ ID NO: 28589 - protein, 7 aa, Artificial Sequence
  Synthetic
RGSPGVW

SEQ ID NO: 28590 - protein, 7 aa, Artificial Sequence
  Synthetic
ARNPGVW

SEQ ID NO: 28591 - protein, 7 aa, Artificial Sequence
  Synthetic
PGQPGVW

SEQ ID NO: 28592 - protein, 7 aa, Artificial Sequence
  Synthetic
VGKPGVW

SEQ ID NO: 28593 - protein, 7 aa, Artificial Sequence
  Synthetic
AGSPGVW

SEQ ID NO: 28594 - protein, 7 aa, Artificial Sequence
  Synthetic
EGRPGVW

SEQ ID NO: 28595 - protein, 7 aa, Artificial Sequence
  Synthetic
HGQPGVW

SEQ ID NO: 28596 - protein, 7 aa, Artificial Sequence
  Synthetic
GERPGVW

SEQ ID NO: 28597 - protein, 7 aa, Artificial Sequence
  Synthetic
MDHPGVW

SEQ ID NO: 28598 - protein, 7 aa, Artificial Sequence
  Synthetic
GNDPGVW

SEQ ID NO: 28599 - protein, 7 aa, Artificial Sequence
  Synthetic
GISPGVW

SEQ ID NO: 28600 - protein, 7 aa, Artificial Sequence
  Synthetic
DGRPGVW

SEQ ID NO: 28601 - protein, 7 aa, Artificial Sequence
  Synthetic
NSYPGVW

SEQ ID NO: 28602 - protein, 7 aa, Artificial Sequence
  Synthetic
GQQPGVW

SEQ ID NO: 28603 - protein, 7 aa, Artificial Sequence
  Synthetic
GSTPGVW

SEQ ID NO: 28604 - protein, 7 aa, Artificial Sequence
  Synthetic
VKTPGVW

SEQ ID NO: 28605 - protein, 7 aa, Artificial Sequence
  Synthetic
GSSPGVW

SEQ ID NO: 28606 - protein, 7 aa, Artificial Sequence
  Synthetic
GSEIGRW

SEQ ID NO: 28607 - protein, 7 aa, Artificial Sequence
  Synthetic
GVGEGRW

SEQ ID NO: 28608 - protein, 7 aa, Artificial Sequence
  Synthetic
GNDTGRW

SEQ ID NO: 28609 - protein, 7 aa, Artificial Sequence
  Synthetic
GPVEGRW

SEQ ID NO: 28610 - protein, 7 aa, Artificial Sequence
  Synthetic
GDVIGRW

SEQ ID NO: 28611 - protein, 7 aa, Artificial Sequence
  Synthetic
GSEAGRW

SEQ ID NO: 28612 - protein, 7 aa, Artificial Sequence
  Synthetic
GDPAGRW

SEQ ID NO: 28613 - protein, 7 aa, Artificial Sequence
  Synthetic
GESSGRW

SEQ ID NO: 28614 - protein, 7 aa, Artificial Sequence
  Synthetic
GSDLGRW

SEQ ID NO: 28615 - protein, 7 aa, Artificial Sequence
  Synthetic
GDSVGRW

SEQ ID NO: 28616 - protein, 7 aa, Artificial Sequence
  Synthetic
GNDPGRW

SEQ ID NO: 28617 - protein, 7 aa, Artificial Sequence
  Synthetic
GDMTGRW

SEQ ID NO: 28618 - protein, 7 aa, Artificial Sequence
  Synthetic
GESAGRW

SEQ ID NO: 28619 - protein, 7 aa, Artificial Sequence
  Synthetic
GLDNGRW

SEQ ID NO: 28620 - protein, 7 aa, Artificial Sequence
  Synthetic
GADTGRW

SEQ ID NO: 28621 - protein, 7 aa, Artificial Sequence
  Synthetic
GELTGRW

SEQ ID NO: 28622 - protein, 7 aa, Artificial Sequence
  Synthetic
GYESGRW

SEQ ID NO: 28623 - protein, 7 aa, Artificial Sequence
  Synthetic
GTSPGRW

SEQ ID NO: 28624 - protein, 7 aa, Artificial Sequence
  Synthetic
GEMVGRW

SEQ ID NO: 28625 - protein, 7 aa, Artificial Sequence
  Synthetic
GETNGRW

SEQ ID NO: 28626 - protein, 7 aa, Artificial Sequence
  Synthetic
GGETGRW

SEQ ID NO: 28627 - protein, 7 aa, Artificial Sequence
  Synthetic
GAELGRW

SEQ ID NO: 28628 - protein, 7 aa, Artificial Sequence
  Synthetic
GSELGRW

SEQ ID NO: 28629 - protein, 7 aa, Artificial Sequence
  Synthetic
GEVTGRW

SEQ ID NO: 28630 - protein, 7 aa, Artificial Sequence
  Synthetic
GTEAGRW

SEQ ID NO: 28631 - protein, 7 aa, Artificial Sequence
  Synthetic
GSDSGRW

SEQ ID NO: 28632 - protein, 7 aa, Artificial Sequence
  Synthetic
GDNVGRW

SEQ ID NO: 28633 - protein, 7 aa, Artificial Sequence
  Synthetic
GETVGRW

SEQ ID NO: 28634 - protein, 7 aa, Artificial Sequence
  Synthetic
GDLAGRW

SEQ ID NO: 28635 - protein, 7 aa, Artificial Sequence
  Synthetic
GGDPGRW

SEQ ID NO: 28636 - protein, 7 aa, Artificial Sequence
  Synthetic
GVEVGRW

SEQ ID NO: 28637 - protein, 7 aa, Artificial Sequence
  Synthetic
GEAAGRW

SEQ ID NO: 28638 - protein, 7 aa, Artificial Sequence
  Synthetic
GVNEGRW

SEQ ID NO: 28639 - protein, 7 aa, Artificial Sequence
  Synthetic
GPEVGRW

SEQ ID NO: 28640 - protein, 7 aa, Artificial Sequence
  Synthetic
GQDLGRW

SEQ ID NO: 28641 - protein, 7 aa, Artificial Sequence
  Synthetic
GDTQGRW

SEQ ID NO: 28642 - protein, 7 aa, Artificial Sequence
  Synthetic
GLVDGRW

SEQ ID NO: 28643 - protein, 7 aa, Artificial Sequence
  Synthetic
GEPLGRW

SEQ ID NO: 28644 - protein, 7 aa, Artificial Sequence
  Synthetic
GGSEGRW

SEQ ID NO: 28645 - protein, 7 aa, Artificial Sequence
  Synthetic
GTDTGRW

SEQ ID NO: 28646 - protein, 7 aa, Artificial Sequence
  Synthetic
GEDLGRW

SEQ ID NO: 28647 - protein, 7 aa, Artificial Sequence
  Synthetic
GLADGRW

SEQ ID NO: 28648 - protein, 7 aa, Artificial Sequence
  Synthetic
GDQPGRW

SEQ ID NO: 28649 - protein, 7 aa, Artificial Sequence
  Synthetic
GESVGRW

SEQ ID NO: 28650 - protein, 7 aa, Artificial Sequence
  Synthetic
GEDMGRW

SEQ ID NO: 28651 - protein, 7 aa, Artificial Sequence
  Synthetic
GGDTGRW

SEQ ID NO: 28652 - protein, 7 aa, Artificial Sequence
  Synthetic
GEPSGRW

SEQ ID NO: 28653 - protein, 7 aa, Artificial Sequence
  Synthetic
GMVEGRW

SEQ ID NO: 28654 - protein, 7 aa, Artificial Sequence
  Synthetic
GPDVGRW

SEQ ID NO: 28655 - protein, 7 aa, Artificial Sequence
  Synthetic
GDVSGRW

SEQ ID NO: 28656 - protein, 7 aa, Artificial Sequence
  Synthetic
GDLPGRW

SEQ ID NO: 28657 - protein, 7 aa, Artificial Sequence
  Synthetic
GIGEGRW

SEQ ID NO: 28658 - protein, 7 aa, Artificial Sequence
  Synthetic
GEPNGRW

SEQ ID NO: 28659 - protein, 7 aa, Artificial Sequence
  Synthetic
GGDTGRW

SEQ ID NO: 28660 - protein, 7 aa, Artificial Sequence
  Synthetic
GGEPGRW

SEQ ID NO: 28661 - protein, 7 aa, Artificial Sequence
  Synthetic
GPDAGRW

SEQ ID NO: 28662 - protein, 7 aa, Artificial Sequence
  Synthetic
GNEVGRW

SEQ ID NO: 28663 - protein, 7 aa, Artificial Sequence
  Synthetic
GLSDGRW

SEQ ID NO: 28664 - protein, 7 aa, Artificial Sequence
  Synthetic
GPGEGRW

SEQ ID NO: 28665 - protein, 7 aa, Artificial Sequence
  Synthetic
GSSPGRW

SEQ ID NO: 28666 - protein, 7 aa, Artificial Sequence
  Synthetic
GEVAGRW

SEQ ID NO: 28667 - protein, 7 aa, Artificial Sequence
  Synthetic
GEPHGRW

SEQ ID NO: 28668 - protein, 7 aa, Artificial Sequence
  Synthetic
GKDVGRW

SEQ ID NO: 28669 - protein, 7 aa, Artificial Sequence
  Synthetic
GVAEGRW

SEQ ID NO: 28670 - protein, 7 aa, Artificial Sequence
  Synthetic
GVSEGRW

SEQ ID NO: 28671 - protein, 7 aa, Artificial Sequence
  Synthetic
GGVEGRW

SEQ ID NO: 28672 - protein, 7 aa, Artificial Sequence
  Synthetic
GIDLGRW

SEQ ID NO: 28673 - protein, 7 aa, Artificial Sequence
  Synthetic
GSDVGRW

SEQ ID NO: 28674 - protein, 7 aa, Artificial Sequence
  Synthetic
GLSEGRW

SEQ ID NO: 28675 - protein, 7 aa, Artificial Sequence
  Synthetic
GRAEGRW

SEQ ID NO: 28676 - protein, 7 aa, Artificial Sequence
  Synthetic
GADTGRW

SEQ ID NO: 28677 - protein, 7 aa, Artificial Sequence
  Synthetic
GEHNGRW

SEQ ID NO: 28678 - protein, 7 aa, Artificial Sequence
  Synthetic
GLHDGRW

SEQ ID NO: 28679 - protein, 7 aa, Artificial Sequence
  Synthetic
GVNLGRW

SEQ ID NO: 28680 - protein, 7 aa, Artificial Sequence
  Synthetic
GDPPGRW

SEQ ID NO: 28681 - protein, 7 aa, Artificial Sequence
  Synthetic
GMEIGRW

SEQ ID NO: 28682 - protein, 7 aa, Artificial Sequence
  Synthetic
DVPSGRW

SEQ ID NO: 28683 - protein, 7 aa, Artificial Sequence
  Synthetic
DGASGRW

SEQ ID NO: 28684 - protein, 7 aa, Artificial Sequence
  Synthetic
EDGSGRW

SEQ ID NO: 28685 - protein, 7 aa, Artificial Sequence
  Synthetic
EDGSGRW

SEQ ID NO: 28686 - protein, 7 aa, Artificial Sequence
  Synthetic
EPGSGRW

SEQ ID NO: 28687 - protein, 7 aa, Artificial Sequence
  Synthetic
EGGSGRW

SEQ ID NO: 28688 - protein, 7 aa, Artificial Sequence
  Synthetic
DNTSGRW

SEQ ID NO: 28689 - protein, 7 aa, Artificial Sequence
  Synthetic
DLDSGRW

SEQ ID NO: 28690 - protein, 7 aa, Artificial Sequence
  Synthetic
DANSGRW

SEQ ID NO: 28691 - protein, 7 aa, Artificial Sequence
  Synthetic
DMLSGRW

SEQ ID NO: 28692 - protein, 7 aa, Artificial Sequence
  Synthetic
SPHDARW

SEQ ID NO: 28693 - protein, 7 aa, Artificial Sequence
  Synthetic
SYGDGRW

SEQ ID NO: 28694 - protein, 7 aa, Artificial Sequence
  Synthetic
SEGSSRW

SEQ ID NO: 28695 - protein, 7 aa, Artificial Sequence
  Synthetic
SGSDGRW

SEQ ID NO: 28696 - protein, 7 aa, Artificial Sequence
  Synthetic
SPDSGRW

SEQ ID NO: 28697 - protein, 7 aa, Artificial Sequence
  Synthetic
SLVGNRW

SEQ ID NO: 28698 - protein, 7 aa, Artificial Sequence
  Synthetic
SPNSVRW

SEQ ID NO: 28699 - protein, 7 aa, Artificial Sequence
  Synthetic
SPTEARW

SEQ ID NO: 28700 - protein, 7 aa, Artificial Sequence
  Synthetic
STYDGRW

SEQ ID NO: 28701 - protein, 7 aa, Artificial Sequence
  Synthetic
SENPGRW

SEQ ID NO: 28702 - protein, 7 aa, Artificial Sequence
  Synthetic
SDSPGRW

SEQ ID NO: 28703 - protein, 7 aa, Artificial Sequence
  Synthetic
SAGDNRW

SEQ ID NO: 28704 - protein, 7 aa, Artificial Sequence
  Synthetic
SGDSGRW

SEQ ID NO: 28705 - protein, 7 aa, Artificial Sequence
  Synthetic
SGVEGRW

SEQ ID NO: 28706 - protein, 7 aa, Artificial Sequence
  Synthetic
SYDSGRW

SEQ ID NO: 28707 - protein, 7 aa, Artificial Sequence
  Synthetic
SGDVGRW

SEQ ID NO: 28708 - protein, 7 aa, Artificial Sequence
  Synthetic
SLDSGRW

SEQ ID NO: 28709 - protein, 7 aa, Artificial Sequence
  Synthetic
SSDYNRW

SEQ ID NO: 28710 - protein, 7 aa, Artificial Sequence
  Synthetic
SPHESRW

SEQ ID NO: 28711 - protein, 7 aa, Artificial Sequence
  Synthetic
SESIGRW

SEQ ID NO: 28712 - protein, 7 aa, Artificial Sequence
  Synthetic
SGSPGRW

SEQ ID NO: 28713 - protein, 7 aa, Artificial Sequence
  Synthetic
STNDGRW

SEQ ID NO: 28714 - protein, 7 aa, Artificial Sequence
  Synthetic
LNYGGSM

SEQ ID NO: 28715 - protein, 7 aa, Artificial Sequence
  Synthetic
AVYMGSV

SEQ ID NO: 28716 - protein, 7 aa, Artificial Sequence
  Synthetic
MIYQGSS

SEQ ID NO: 28717 - protein, 7 aa, Artificial Sequence
  Synthetic
VSYHGSS

SEQ ID NO: 28718 - protein, 7 aa, Artificial Sequence
  Synthetic
EKYGGST

SEQ ID NO: 28719 - protein, 7 aa, Artificial Sequence
  Synthetic
HIYAGSS

SEQ ID NO: 28720 - protein, 7 aa, Artificial Sequence
  Synthetic
SMYHGSS

SEQ ID NO: 28721 - protein, 7 aa, Artificial Sequence
  Synthetic
MMYQGSA

SEQ ID NO: 28722 - protein, 7 aa, Artificial Sequence
  Synthetic
AFYNGSA

SEQ ID NO: 28723 - protein, 7 aa, Artificial Sequence
  Synthetic
RYYEGSS

SEQ ID NO: 28724 - protein, 7 aa, Artificial Sequence
  Synthetic
DKYMGSV

SEQ ID NO: 28725 - protein, 7 aa, Artificial Sequence
  Synthetic
VVYAGSS

SEQ ID NO: 28726 - protein, 7 aa, Artificial Sequence
  Synthetic
QNYNGSI

SEQ ID NO: 28727 - protein, 7 aa, Artificial Sequence
  Synthetic
EQYRGST

SEQ ID NO: 28728 - protein, 7 aa, Artificial Sequence
  Synthetic
DNYQGSA

SEQ ID NO: 28729 - protein, 7 aa, Artificial Sequence
  Synthetic
WAYQGSA

SEQ ID NO: 28730 - protein, 7 aa, Artificial Sequence
  Synthetic
THYSGST

SEQ ID NO: 28731 - protein, 7 aa, Artificial Sequence
  Synthetic
EFYGGSV

SEQ ID NO: 28732 - protein, 7 aa, Artificial Sequence
  Synthetic
LLYGGST

SEQ ID NO: 28733 - protein, 7 aa, Artificial Sequence
  Synthetic
LHYSGSS

SEQ ID NO: 28734 - protein, 7 aa, Artificial Sequence
  Synthetic
LSYMGSH

SEQ ID NO: 28735 - protein, 7 aa, Artificial Sequence
  Synthetic
KLYNGSI

SEQ ID NO: 28736 - protein, 7 aa, Artificial Sequence
  Synthetic
DRYIGSS

SEQ ID NO: 28737 - protein, 7 aa, Artificial Sequence
  Synthetic
TVYLGSV

SEQ ID NO: 28738 - protein, 7 aa, Artificial Sequence
  Synthetic
MSYHGSS

SEQ ID NO: 28739 - protein, 7 aa, Artificial Sequence
  Synthetic
LFYGGSS

SEQ ID NO: 28740 - protein, 7 aa, Artificial Sequence
  Synthetic
RVYSGSA

SEQ ID NO: 28741 - protein, 7 aa, Artificial Sequence
  Synthetic
LKYAGST

SEQ ID NO: 28742 - protein, 7 aa, Artificial Sequence
  Synthetic
AQYMGSS

SEQ ID NO: 28743 - protein, 7 aa, Artificial Sequence
  Synthetic
MVYSGSS

SEQ ID NO: 28744 - protein, 7 aa, Artificial Sequence
  Synthetic
MSYLGSS

SEQ ID NO: 28745 - protein, 7 aa, Artificial Sequence
  Synthetic
HRYEGSS

SEQ ID NO: 28746 - protein, 7 aa, Artificial Sequence
  Synthetic
MKYGGST

SEQ ID NO: 28747 - protein, 7 aa, Artificial Sequence
  Synthetic
EAYMGSV

SEQ ID NO: 28748 - protein, 7 aa, Artificial Sequence
  Synthetic
EFYGGSR

SEQ ID NO: 28749 - protein, 7 aa, Artificial Sequence
  Synthetic
VVYNGST

SEQ ID NO: 28750 - protein, 7 aa, Artificial Sequence
  Synthetic
SVYMGSS

SEQ ID NO: 28751 - protein, 7 aa, Artificial Sequence
  Synthetic
SIYLGSS

SEQ ID NO: 28752 - protein, 7 aa, Artificial Sequence
  Synthetic
LDYRGST

SEQ ID NO: 28753 - protein, 7 aa, Artificial Sequence
  Synthetic
RVYGGSQ

SEQ ID NO: 28754 - protein, 7 aa, Artificial Sequence
  Synthetic
GVYMGSS

SEQ ID NO: 28755 - protein, 7 aa, Artificial Sequence
  Synthetic
SSYMGST

SEQ ID NO: 28756 - protein, 7 aa, Artificial Sequence
  Synthetic
MIYSGSH

SEQ ID NO: 28757 - protein, 7 aa, Artificial Sequence
  Synthetic
ERYQGSH

SEQ ID NO: 28758 - protein, 7 aa, Artificial Sequence
  Synthetic
LAYLGSQ

SEQ ID NO: 28759 - protein, 7 aa, Artificial Sequence
  Synthetic
TQYNGSI

SEQ ID NO: 28760 - protein, 7 aa, Artificial Sequence
  Synthetic
STYLGST

SEQ ID NO: 28761 - protein, 7 aa, Artificial Sequence
  Synthetic
LLYGGST

SEQ ID NO: 28762 - protein, 7 aa, Artificial Sequence
  Synthetic
VMYGGSS

SEQ ID NO: 28763 - protein, 7 aa, Artificial Sequence
  Synthetic
HAYHGST

SEQ ID NO: 28764 - protein, 7 aa, Artificial Sequence
  Synthetic
MYYNGSH

SEQ ID NO: 28765 - protein, 7 aa, Artificial Sequence
  Synthetic
PFYSGSA

SEQ ID NO: 28766 - protein, 7 aa, Artificial Sequence
  Synthetic
ERYAGSS

SEQ ID NO: 28767 - protein, 7 aa, Artificial Sequence
  Synthetic
HEYRGSA

SEQ ID NO: 28768 - protein, 7 aa, Artificial Sequence
  Synthetic
HIYSGSM

SEQ ID NO: 28769 - protein, 7 aa, Artificial Sequence
  Synthetic
TMYGGST

SEQ ID NO: 28770 - protein, 7 aa, Artificial Sequence
  Synthetic
VYYSGSS

SEQ ID NO: 28771 - protein, 7 aa, Artificial Sequence
  Synthetic
EQYKGST

SEQ ID NO: 28772 - protein, 7 aa, Artificial Sequence
  Synthetic
SYYGGSA

SEQ ID NO: 28773 - protein, 7 aa, Artificial Sequence
  Synthetic
QKYNGST

SEQ ID NO: 28774 - protein, 7 aa, Artificial Sequence
  Synthetic
YKYEGST

SEQ ID NO: 28775 - protein, 7 aa, Artificial Sequence
  Synthetic
TVYGGST

SEQ ID NO: 28776 - protein, 7 aa, Artificial Sequence
  Synthetic
SLYLGST

SEQ ID NO: 28777 - protein, 7 aa, Artificial Sequence
  Synthetic
VYYTGSS

SEQ ID NO: 28778 - protein, 7 aa, Artificial Sequence
  Synthetic
EYYTGST

SEQ ID NO: 28779 - protein, 7 aa, Artificial Sequence
  Synthetic
ANYMGSM

SEQ ID NO: 28780 - protein, 7 aa, Artificial Sequence
  Synthetic
FIYSGSS

SEQ ID NO: 28781 - protein, 7 aa, Artificial Sequence
  Synthetic
TLYMGSS

SEQ ID NO: 28782 - protein, 7 aa, Artificial Sequence
  Synthetic
FYYGGSS

SEQ ID NO: 28783 - protein, 7 aa, Artificial Sequence
  Synthetic
VLYNGSM

SEQ ID NO: 28784 - protein, 7 aa, Artificial Sequence
  Synthetic
LRYAGST

SEQ ID NO: 28785 - protein, 7 aa, Artificial Sequence
  Synthetic
LMYSGSQ

SEQ ID NO: 28786 - protein, 7 aa, Artificial Sequence
  Synthetic
SVYHGSS

SEQ ID NO: 28787 - protein, 7 aa, Artificial Sequence
  Synthetic
SVYLGSV

SEQ ID NO: 28788 - protein, 7 aa, Artificial Sequence
  Synthetic
ERYHGSQ

SEQ ID NO: 28789 - protein, 7 aa, Artificial Sequence
  Synthetic
VLYLGSA

SEQ ID NO: 28790 - protein, 7 aa, Artificial Sequence
  Synthetic
QHYLGSS

SEQ ID NO: 28791 - protein, 7 aa, Artificial Sequence
  Synthetic
WAYGGSS

SEQ ID NO: 28792 - protein, 7 aa, Artificial Sequence
  Synthetic
AIYHGST

SEQ ID NO: 28793 - protein, 7 aa, Artificial Sequence
  Synthetic
WVYEGSA

SEQ ID NO: 28794 - protein, 7 aa, Artificial Sequence
  Synthetic
LQYRGSS

SEQ ID NO: 28795 - protein, 7 aa, Artificial Sequence
  Synthetic
ALYRGSS

SEQ ID NO: 28796 - protein, 7 aa, Artificial Sequence
  Synthetic
ELYYGSA

SEQ ID NO: 28797 - protein, 7 aa, Artificial Sequence
  Synthetic
LNYSGST

SEQ ID NO: 28798 - protein, 7 aa, Artificial Sequence
  Synthetic
MAYLGSQ

SEQ ID NO: 28799 - protein, 7 aa, Artificial Sequence
  Synthetic
SVYRGST

SEQ ID NO: 28800 - protein, 7 aa, Artificial Sequence
  Synthetic
QSYQGST

SEQ ID NO: 28801 - protein, 7 aa, Artificial Sequence
  Synthetic
IVYKGSA

SEQ ID NO: 28802 - protein, 7 aa, Artificial Sequence
  Synthetic
SIYHGSS

SEQ ID NO: 28803 - protein, 7 aa, Artificial Sequence
  Synthetic
YVYHGSS

SEQ ID NO: 28804 - protein, 7 aa, Artificial Sequence
  Synthetic
THYEGST

SEQ ID NO: 28805 - protein, 7 aa, Artificial Sequence
  Synthetic
MMYHGST

SEQ ID NO: 28806 - protein, 7 aa, Artificial Sequence
  Synthetic
LKYNGSL

SEQ ID NO: 28807 - protein, 7 aa, Artificial Sequence
  Synthetic
QMYMGSL

SEQ ID NO: 28808 - protein, 7 aa, Artificial Sequence
  Synthetic
LVYGGSV

SEQ ID NO: 28809 - protein, 7 aa, Artificial Sequence
  Synthetic
NQYLGSS

SEQ ID NO: 28810 - protein, 7 aa, Artificial Sequence
  Synthetic
GIYAGSW

SEQ ID NO: 28811 - protein, 7 aa, Artificial Sequence
  Synthetic
ERYSGSQ

SEQ ID NO: 28812 - protein, 7 aa, Artificial Sequence
  Synthetic
AEYTGSW

SEQ ID NO: 28813 - protein, 7 aa, Artificial Sequence
  Synthetic
EMYRGST

SEQ ID NO: 28814 - protein, 7 aa, Artificial Sequence
  Synthetic
FEYGGSQ

SEQ ID NO: 28815 - protein, 7 aa, Artificial Sequence
  Synthetic
HEYLGSS

SEQ ID NO: 28816 - protein, 7 aa, Artificial Sequence
  Synthetic
KIYSGSS

SEQ ID NO: 28817 - protein, 7 aa, Artificial Sequence
  Synthetic
YMYSGSM

SEQ ID NO: 28818 - protein, 7 aa, Artificial Sequence
  Synthetic
QAYHGST

SEQ ID NO: 28819 - protein, 7 aa, Artificial Sequence
  Synthetic
LMYLGSQ

SEQ ID NO: 28820 - protein, 7 aa, Artificial Sequence
  Synthetic
WAYEGSA

SEQ ID NO: 28821 - protein, 7 aa, Artificial Sequence
  Synthetic
LRYGGSV

SEQ ID NO: 28822 - protein, 7 aa, Artificial Sequence
  Synthetic
WNYGGSA

SEQ ID NO: 28823 - protein, 7 aa, Artificial Sequence
  Synthetic
WTYGGSA

SEQ ID NO: 28824 - protein, 7 aa, Artificial Sequence
  Synthetic
LVYMGST

SEQ ID NO: 28825 - protein, 7 aa, Artificial Sequence
  Synthetic
MAYHGST

SEQ ID NO: 28826 - protein, 7 aa, Artificial Sequence
  Synthetic
SAYHGST

SEQ ID NO: 28827 - protein, 7 aa, Artificial Sequence
  Synthetic
AFYGGSA

SEQ ID NO: 28828 - protein, 7 aa, Artificial Sequence
  Synthetic
CVYLGSA

SEQ ID NO: 28829 - protein, 7 aa, Artificial Sequence
  Synthetic
SAYLGSA

SEQ ID NO: 28830 - protein, 7 aa, Artificial Sequence
  Synthetic
LSYQGSQ

SEQ ID NO: 28831 - protein, 7 aa, Artificial Sequence
  Synthetic
DHYLGST

SEQ ID NO: 28832 - protein, 7 aa, Artificial Sequence
  Synthetic
EGYRGSS

SEQ ID NO: 28833 - protein, 7 aa, Artificial Sequence
  Synthetic
VVYGGSQ

SEQ ID NO: 28834 - protein, 7 aa, Artificial Sequence
  Synthetic
MSYHGST

SEQ ID NO: 28835 - protein, 7 aa, Artificial Sequence
  Synthetic
ERYNGSM

SEQ ID NO: 28836 - protein, 7 aa, Artificial Sequence
  Synthetic
SFYGGSH

SEQ ID NO: 28837 - protein, 7 aa, Artificial Sequence
  Synthetic
EYYRGSV

SEQ ID NO: 28838 - protein, 7 aa, Artificial Sequence
  Synthetic
AEYRGSS

SEQ ID NO: 28839 - protein, 7 aa, Artificial Sequence
  Synthetic
EEYMGSS

SEQ ID NO: 28840 - protein, 7 aa, Artificial Sequence
  Synthetic
LAYMGSV

SEQ ID NO: 28841 - protein, 7 aa, Artificial Sequence
  Synthetic
TYYHGSA

SEQ ID NO: 28842 - protein, 7 aa, Artificial Sequence
  Synthetic
SVYRGSV

SEQ ID NO: 28843 - protein, 7 aa, Artificial Sequence
  Synthetic
DHYLGSH

SEQ ID NO: 28844 - protein, 7 aa, Artificial Sequence
  Synthetic
VVYGGST

SEQ ID NO: 28845 - protein, 7 aa, Artificial Sequence
  Synthetic
SLYMGSS

SEQ ID NO: 28846 - protein, 7 aa, Artificial Sequence
  Synthetic
EVYQGSS

SEQ ID NO: 28847 - protein, 7 aa, Artificial Sequence
  Synthetic
WNYVGSS

SEQ ID NO: 28848 - protein, 7 aa, Artificial Sequence
  Synthetic
WMYEGSS

SEQ ID NO: 28849 - protein, 7 aa, Artificial Sequence
  Synthetic
IKYAGSS

SEQ ID NO: 28850 - protein, 7 aa, Artificial Sequence
  Synthetic
LIYNGSS

SEQ ID NO: 28851 - protein, 7 aa, Artificial Sequence
  Synthetic
NHYHGSS

SEQ ID NO: 28852 - protein, 7 aa, Artificial Sequence
  Synthetic
WIYGGSA

SEQ ID NO: 28853 - protein, 7 aa, Artificial Sequence
  Synthetic
EYYKGSA

SEQ ID NO: 28854 - protein, 7 aa, Artificial Sequence
  Synthetic
AYYSGST

SEQ ID NO: 28855 - protein, 7 aa, Artificial Sequence
  Synthetic
LVYAGSA

SEQ ID NO: 28856 - protein, 7 aa, Artificial Sequence
  Synthetic
EYYNGSA

SEQ ID NO: 28857 - protein, 7 aa, Artificial Sequence
  Synthetic
LFYGGSL

SEQ ID NO: 28858 - protein, 7 aa, Artificial Sequence
  Synthetic
LRYEGSM

SEQ ID NO: 28859 - protein, 7 aa, Artificial Sequence
  Synthetic
IVYGGSS

SEQ ID NO: 28860 - protein, 7 aa, Artificial Sequence
  Synthetic
AQYMGSS

SEQ ID NO: 28861 - protein, 7 aa, Artificial Sequence
  Synthetic
SSYFGSA

SEQ ID NO: 28862 - protein, 7 aa, Artificial Sequence
  Synthetic
SVYLGST

SEQ ID NO: 28863 - protein, 7 aa, Artificial Sequence
  Synthetic
ARYMGSV

SEQ ID NO: 28864 - protein, 7 aa, Artificial Sequence
  Synthetic
SYYTGSS

SEQ ID NO: 28865 - protein, 7 aa, Artificial Sequence
  Synthetic
EKYQGST

SEQ ID NO: 28866 - protein, 7 aa, Artificial Sequence
  Synthetic
LNYGGSQ

SEQ ID NO: 28867 - protein, 7 aa, Artificial Sequence
  Synthetic
IRYEGST

SEQ ID NO: 28868 - protein, 7 aa, Artificial Sequence
  Synthetic
WGYVGSG

SEQ ID NO: 28869 - protein, 7 aa, Artificial Sequence
  Synthetic
MIYGGSL

SEQ ID NO: 28870 - protein, 7 aa, Artificial Sequence
  Synthetic
SEYHGSS

SEQ ID NO: 28871 - protein, 7 aa, Artificial Sequence
  Synthetic
TYYGGSH

SEQ ID NO: 28872 - protein, 7 aa, Artificial Sequence
  Synthetic
NSYLGST

SEQ ID NO: 28873 - protein, 7 aa, Artificial Sequence
  Synthetic
AFYSGSH

SEQ ID NO: 28874 - protein, 7 aa, Artificial Sequence
  Synthetic
TMYRGSI

SEQ ID NO: 28875 - protein, 7 aa, Artificial Sequence
  Synthetic
VHYQGSS

SEQ ID NO: 28876 - protein, 7 aa, Artificial Sequence
  Synthetic
LVYKGSQ

SEQ ID NO: 28877 - protein, 7 aa, Artificial Sequence
  Synthetic
DVYRGSS

SEQ ID NO: 28878 - protein, 7 aa, Artificial Sequence
  Synthetic
VEYHGSA

SEQ ID NO: 28879 - protein, 7 aa, Artificial Sequence
  Synthetic
GVYMGSS

SEQ ID NO: 28880 - protein, 7 aa, Artificial Sequence
  Synthetic
SKYLGSQ

SEQ ID NO: 28881 - DNA, 21 bp, Artificial Sequence
  Synthetic
tatggttcgttgcaggggtgg

SEQ ID NO: 28882 - DNA, 21 bp, Artificial Sequence
  Synthetic
tatgatgtggggttgggttgg

SEQ ID NO: 28883 - DNA, 21 bp, Artificial Sequence
  Synthetic
tattctgttagtggggggtgg

SEQ ID NO: 28884 - DNA, 21 bp, Artificial Sequence
  Synthetic
tatgagaatccgggtatgtgg

SEQ ID NO: 28885 - DNA, 21 bp, Artificial Sequence
  Synthetic
tatacgggggctcttagttgg

SEQ ID NO: 28886 - DNA, 21 bp, Artificial Sequence
  Synthetic
tatggtgcgctttcttcttgg

SEQ ID NO: 28887 - DNA, 21 bp, Artificial Sequence
  Synthetic
tataagattgagactgggtgg

SEQ ID NO: 28888 - DNA, 21 bp, Artificial Sequence
  Synthetic
tatgatacgattcgtgggtgg

SEQ ID NO: 28889 - DNA, 21 bp, Artificial Sequence
  Synthetic
tatggtgctgtgggtccttgg

SEQ ID NO: 28890 - DNA, 21 bp, Artificial Sequence
  Synthetic
tatggttcgctgcatgggtgg

SEQ ID NO: 28891 - DNA, 21 bp, Artificial Sequence
  Synthetic
tatacggttccgggggggtgg

SEQ ID NO: 28892 - DNA, 21 bp, Artificial Sequence
  Synthetic
aagtctgttgggagtgtgtat

SEQ ID NO: 28893 - DNA, 21 bp, Artificial Sequence
  Synthetic
aagagtgcgggtagtatttat

SEQ ID NO: 28894 - DNA, 21 bp, Artificial Sequence
  Synthetic
aaggatgattatagttattat

SEQ ID NO: 28895 - DNA, 21 bp, Artificial Sequence
  Synthetic
aagggtccgcatgatttttat

SEQ ID NO: 28896 - DNA, 21 bp, Artificial Sequence
  Synthetic
aagtggcagaatgatatgtat

SEQ ID NO: 28897 - DNA, 21 bp, Artificial Sequence
  Synthetic
aagtctattgggactatttat

SEQ ID NO: 28898 - DNA, 21 bp, Artificial Sequence
  Synthetic
aaggaggtgggtcatatttat

SEQ ID NO: 28899 - DNA, 21 bp, Artificial Sequence
  Synthetic
aagagtatgggtactgtttat

SEQ ID NO: 28900 - DNA, 21 bp, Artificial Sequence
  Synthetic
aagcatccggcggctatttat

SEQ ID NO: 28901 - DNA, 21 bp, Artificial Sequence
  Synthetic
aagactgattatacgtattat

SEQ ID NO: 28902 - DNA, 21 bp, Artificial Sequence
  Synthetic
aagctggatcatgcttattat

SEQ ID NO: 28903 - DNA, 21 bp, Artificial Sequence
  Synthetic
aagtttagtcttgtgggttat

SEQ ID NO: 28904 - DNA, 21 bp, Artificial Sequence
  Synthetic
aagagtgagtggggtagttat

SEQ ID NO: 28905 - DNA, 21 bp, Artificial Sequence
  Synthetic
aaggatgtgaattggtcttat

SEQ ID NO: 28906 - DNA, 21 bp, Artificial Sequence
  Synthetic
aagacttatgagattccgtat

SEQ ID NO: 28907 - DNA, 21 bp, Artificial Sequence
  Synthetic
aggtttgctggtgattcggtt

SEQ ID NO: 28908 - DNA, 21 bp, Artificial Sequence
  Synthetic
aggtttctgggtgagccgtct

SEQ ID NO: 28909 - DNA, 21 bp, Artificial Sequence
  Synthetic
cggtatatgggtgattctgtt

SEQ ID NO: 28910 - DNA, 21 bp, Artificial Sequence
  Synthetic
aggtatactggggagagtacg

SEQ ID NO: 28911 - DNA, 21 bp, Artificial Sequence
  Synthetic
cgttttgctggtgatgcttcg

SEQ ID NO: 28912 - DNA, 21 bp, Artificial Sequence
  Synthetic
cgttatttgggggataatatt

SEQ ID NO: 28913 - DNA, 21 bp, Artificial Sequence
  Synthetic
cgttatatgggtgatgcgtcg

SEQ ID NO: 28914 - DNA, 21 bp, Artificial Sequence
  Synthetic
aggtatagtggtgatgcggcg

SEQ ID NO: 28915 - DNA, 21 bp, Artificial Sequence
  Synthetic
cggtatgggggtgatagttct

SEQ ID NO: 28916 - DNA, 21 bp, Artificial Sequence
  Synthetic
cgttatcaggctgatgctcag

SEQ ID NO: 28917 - DNA, 21 bp, Artificial Sequence
  Synthetic
aggtttgcgggtgattcgagt

SEQ ID NO: 28918 - DNA, 21 bp, Artificial Sequence
  Synthetic
cgttatattggggatagtgct

SEQ ID NO: 28919 - DNA, 21 bp, Artificial Sequence
  Synthetic
cgttttacgggggatccggcg

SEQ ID NO: 28920 - DNA, 21 bp, Artificial Sequence
  Synthetic
cggtttattgcggatcaggct

SEQ ID NO: 28921 - DNA, 21 bp, Artificial Sequence
  Synthetic
cggtttattgctgatcatgct

SEQ ID NO: 28922 - DNA, 21 bp, Artificial Sequence
  Synthetic
cggtttttgggggatatttct

SEQ ID NO: 28923 - DNA, 21 bp, Artificial Sequence
  Synthetic
cgttatattggggataatgtg

SEQ ID NO: 28924 - DNA, 21 bp, Artificial Sequence
  Synthetic
aggtatcagggggattcggcg

SEQ ID NO: 28925 - DNA, 21 bp, Artificial Sequence
  Synthetic
cggtttgttagtgatgcgacg

SEQ ID NO: 28926 - DNA, 21 bp, Artificial Sequence
  Synthetic
cgttatgcgggtgatagtact

SEQ ID NO: 28927 - DNA, 21 bp, Artificial Sequence
  Synthetic
cggtatcattcggatgctagt

SEQ ID NO: 28928 - DNA, 21 bp, Artificial Sequence
  Synthetic
aggtatgaggctgatgcggct

SEQ ID NO: 28929 - DNA, 21 bp, Artificial Sequence
  Synthetic
cggtttgttggtgattttggg

SEQ ID NO: 28930 - DNA, 21 bp, Artificial Sequence
  Synthetic
cgttttcctggtgatggtgcg

SEQ ID NO: 28931 - DNA, 21 bp, Artificial Sequence
  Synthetic
aggtttactaatgatagttct

SEQ ID NO: 28932 - DNA, 21 bp, Artificial Sequence
  Synthetic
aggtatgtgcatgaggctagt

SEQ ID NO: 28933 - DNA, 21 bp, Artificial Sequence
  Synthetic
cgttttcctggtgatgggtct

SEQ ID NO: 28934 - DNA, 21 bp, Artificial Sequence
  Synthetic
cggtttacggcggattctact

SEQ ID NO: 28935 - DNA, 21 bp, Artificial Sequence
  Synthetic
cgttatccgggtgagtctatg

SEQ ID NO: 28936 - DNA, 21 bp, Artificial Sequence
  Synthetic
cggtatatgggtgagttgttg

SEQ ID NO: 28937 - DNA, 21 bp, Artificial Sequence
  Synthetic
aggtatccgggggatccgagt

SEQ ID NO: 28938 - DNA, 21 bp, Artificial Sequence
  Synthetic
cgttatagtggggattctgtg

SEQ ID NO: 28939 - DNA, 21 bp, Artificial Sequence
  Synthetic
cgttatcattcggattctgct

SEQ ID NO: 28940 - DNA, 21 bp, Artificial Sequence
  Synthetic
cggtatgttaatgatgctagt

SEQ ID NO: 28941 - DNA, 21 bp, Artificial Sequence
  Synthetic
aggtatgctggtgaggctgct

SEQ ID NO: 28942 - DNA, 21 bp, Artificial Sequence
  Synthetic
cgttttcctgcggataggatt

SEQ ID NO: 28943 - DNA, 21 bp, Artificial Sequence
  Synthetic
aggtatcttgcggatgcgagt

SEQ ID NO: 28944 - DNA, 21 bp, Artificial Sequence
  Synthetic
cgttatgttggggataatacg

SEQ ID NO: 28945 - DNA, 21 bp, Artificial Sequence
  Synthetic
cgttatgcgggtgagtctgct

SEQ ID NO: 28946 - DNA, 21 bp, Artificial Sequence
  Synthetic
cggtatgcgcatgatagtatg

SEQ ID NO: 28947 - DNA, 21 bp, Artificial Sequence
  Synthetic
cggtttgcgagtgatagttcg

SEQ ID NO: 28948 - DNA, 21 bp, Artificial Sequence
  Synthetic
aggtattctggtgattctgcg

SEQ ID NO: 28949 - DNA, 21 bp, Artificial Sequence
  Synthetic
aggtatgtgcatgagattgct

SEQ ID NO: 28950 - DNA, 21 bp, Artificial Sequence
  Synthetic
aggtatcttggggatactaag

SEQ ID NO: 28951 - DNA, 21 bp, Artificial Sequence
  Synthetic
cgttataatggggagagtcag

SEQ ID NO: 28952 - DNA, 21 bp, Artificial Sequence
  Synthetic
cgttttcgtccggatcctggg

SEQ ID NO: 28953 - DNA, 21 bp, Artificial Sequence
  Synthetic
aggtatccggcggaggcgatg

SEQ ID NO: 28954 - DNA, 21 bp, Artificial Sequence
  Synthetic
cgttatcctgctgaggcgact

SEQ ID NO: 28955 - DNA, 21 bp, Artificial Sequence
  Synthetic
aggtatgcgcatgatgctagt

SEQ ID NO: 28956 - DNA, 21 bp, Artificial Sequence
  Synthetic
cgttatttgtctgattcttcg

SEQ ID NO: 28957 - DNA, 21 bp, Artificial Sequence
  Synthetic
cgttttattccggagccgagt

SEQ ID NO: 28958 - DNA, 21 bp, Artificial Sequence
  Synthetic
cggttttctggggatcctagt

SEQ ID NO: 28959 - DNA, 21 bp, Artificial Sequence
  Synthetic
cggtatcagatggatagtgcg

SEQ ID NO: 28960 - DNA, 21 bp, Artificial Sequence
  Synthetic
aggtttagtgctgattctagt

SEQ ID NO: 28961 - DNA, 21 bp, Artificial Sequence
  Synthetic
cgttatgctggggatgctgtg

SEQ ID NO: 28962 - DNA, 21 bp, Artificial Sequence
  Synthetic
cggtttcatggtgatgcgagt

SEQ ID NO: 28963 - DNA, 21 bp, Artificial Sequence
  Synthetic
cgttatcctggggagaatagt

SEQ ID NO: 28964 - DNA, 21 bp, Artificial Sequence
  Synthetic
aggtttattgctgagtctgct

SEQ ID NO: 28965 - DNA, 21 bp, Artificial Sequence
  Synthetic
cgttatgtgggggatccttcg

SEQ ID NO: 28966 - DNA, 21 bp, Artificial Sequence
  Synthetic
cggtttcatgctgatgcggct

SEQ ID NO: 28967 - DNA, 21 bp, Artificial Sequence
  Synthetic
cggtttgttgttgatagtgct

SEQ ID NO: 28968 - DNA, 21 bp, Artificial Sequence
  Synthetic
aggtttgctaatgattcgagt

SEQ ID NO: 28969 - DNA, 21 bp, Artificial Sequence
  Synthetic
cggttttcgggtgatgcgagt

SEQ ID NO: 28970 - DNA, 21 bp, Artificial Sequence
  Synthetic
aggtattctcctgatgcggcg

SEQ ID NO: 28971 - DNA, 21 bp, Artificial Sequence
  Synthetic
cggtatagtatggatagtagt

SEQ ID NO: 28972 - DNA, 21 bp, Artificial Sequence
  Synthetic
aggtatagtctggatgcggcg

SEQ ID NO: 28973 - DNA, 21 bp, Artificial Sequence
  Synthetic
cggtttggtggtgatagtact

SEQ ID NO: 28974 - DNA, 21 bp, Artificial Sequence
  Synthetic
aggtatcctcatgattctgcg

SEQ ID NO: 28975 - DNA, 21 bp, Artificial Sequence
  Synthetic
cgttatctgggggagactagt

SEQ ID NO: 28976 - DNA, 21 bp, Artificial Sequence
  Synthetic
aggtatgttgctgagcttact

SEQ ID NO: 28977 - DNA, 21 bp, Artificial Sequence
  Synthetic
aggtttgtgtctgattttgcg

SEQ ID NO: 28978 - DNA, 21 bp, Artificial Sequence
  Synthetic
cggtatcctggggatagtgtt

SEQ ID NO: 28979 - DNA, 21 bp, Artificial Sequence
  Synthetic
cgttttattcgggatcaggcg

SEQ ID NO: 28980 - DNA, 21 bp, Artificial Sequence
  Synthetic
cgttttcatagtgatgctagt

SEQ ID NO: 28981 - DNA, 21 bp, Artificial Sequence
  Synthetic
cggtttactggtgataattct

SEQ ID NO: 28982 - DNA, 21 bp, Artificial Sequence
  Synthetic
cggtatgcttcggatgctgct

SEQ ID NO: 28983 - DNA, 21 bp, Artificial Sequence
  Synthetic
cggtttcatatggatgctacg

SEQ ID NO: 28984 - DNA, 21 bp, Artificial Sequence
  Synthetic
cggtttagtggtgatgcgtct

SEQ ID NO: 28985 - DNA, 21 bp, Artificial Sequence
  Synthetic
aggtttgaggcggatagtgct

SEQ ID NO: 28986 - DNA, 21 bp, Artificial Sequence
  Synthetic
aggttttcgcctgatgctgcg

SEQ ID NO: 28987 - DNA, 21 bp, Artificial Sequence
  Synthetic
aggtttgatcatgatgcggcg

SEQ ID NO: 28988 - DNA, 21 bp, Artificial Sequence
  Synthetic
aggtatattcctgaggcgagt

SEQ ID NO: 28989 - DNA, 21 bp, Artificial Sequence
  Synthetic
aggtttgagcttgattctgct

SEQ ID NO: 28990 - DNA, 21 bp, Artificial Sequence
  Synthetic
cgttatctgggtgagttgtct

SEQ ID NO: 28991 - DNA, 21 bp, Artificial Sequence
  Synthetic
cggtatcctgctgatgctatt

SEQ ID NO: 28992 - DNA, 21 bp, Artificial Sequence
  Synthetic
cgttttcctggtgataattct

SEQ ID NO: 28993 - DNA, 21 bp, Artificial Sequence
  Synthetic
cgttatatgggggatagtcag

SEQ ID NO: 28994 - DNA, 21 bp, Artificial Sequence
  Synthetic
aggtatccgcatgatgcgagt

SEQ ID NO: 28995 - DNA, 21 bp, Artificial Sequence
  Synthetic
cggtttatgccggatgctgct

SEQ ID NO: 28996 - DNA, 21 bp, Artificial Sequence
  Synthetic
aggtttactaatgattcgtcg

SEQ ID NO: 28997 - DNA, 21 bp, Artificial Sequence
  Synthetic
aggtttcttaatgatgcggcg

SEQ ID NO: 28998 - DNA, 21 bp, Artificial Sequence
  Synthetic
cgttttactggtgatccgtcg

SEQ ID NO: 28999 - DNA, 21 bp, Artificial Sequence
  Synthetic
cggtatattcctgatgctagt

SEQ ID NO: 29000 - DNA, 21 bp, Artificial Sequence
  Synthetic
cgttttttgtctgatcatgcg

SEQ ID NO: 29001 - DNA, 21 bp, Artificial Sequence
  Synthetic
cgttataatggggatgcggct

SEQ ID NO: 29002 - DNA, 21 bp, Artificial Sequence
  Synthetic
cgttttcttggggatacggcg

SEQ ID NO: 29003 - DNA, 21 bp, Artificial Sequence
  Synthetic
aggtttcttggtgatatgctt

SEQ ID NO: 29004 - DNA, 21 bp, Artificial Sequence
  Synthetic
cggtatgtgggggattcgtcg

SEQ ID NO: 29005 - DNA, 21 bp, Artificial Sequence
  Synthetic
aggtatgctcaggatagttct

SEQ ID NO: 29006 - DNA, 21 bp, Artificial Sequence
  Synthetic
ccgcgtattggttatagtgct

SEQ ID NO: 29007 - DNA, 21 bp, Artificial Sequence
  Synthetic
ttgaagctggggtatagtact

SEQ ID NO: 29008 - DNA, 21 bp, Artificial Sequence
  Synthetic
cgggctcctgggtatagtatg

SEQ ID NO: 29009 - DNA, 21 bp, Artificial Sequence
  Synthetic
cttcgggcgggttattcggtt

SEQ ID NO: 29010 - DNA, 21 bp, Artificial Sequence
  Synthetic
ttgtcgatgggtttttcgcag

SEQ ID NO: 29011 - DNA, 21 bp, Artificial Sequence
  Synthetic
ccgtttccggggtttagtgct

SEQ ID NO: 29012 - DNA, 21 bp, Artificial Sequence
  Synthetic
gaggcgaggggttggagtacg

SEQ ID NO: 29013 - DNA, 21 bp, Artificial Sequence
  Synthetic
ttttcgcatgggtatagtact

SEQ ID NO: 29014 - DNA, 21 bp, Artificial Sequence
  Synthetic
attgatcggggttattcggtt

SEQ ID NO: 29015 - DNA, 21 bp, Artificial Sequence
  Synthetic
acgaagcttggttttagtcag

SEQ ID NO: 29016 - DNA, 21 bp, Artificial Sequence
  Synthetic
ccgatgagggggttttcttcg

SEQ ID NO: 29017 - DNA, 21 bp, Artificial Sequence
  Synthetic
caggctgcgggttggagtagt

SEQ ID NO: 29018 - DNA, 21 bp, Artificial Sequence
  Synthetic
tcgcgtgaggggtggagtact

SEQ ID NO: 29019 - DNA, 21 bp, Artificial Sequence
  Synthetic
gattatagggggtattcgact

SEQ ID NO: 29020 - DNA, 21 bp, Artificial Sequence
  Synthetic
ccgagggctgggtattctatg

SEQ ID NO: 29021 - DNA, 21 bp, Artificial Sequence
  Synthetic
cctgctcctgggtggtcgtcg

SEQ ID NO: 29022 - DNA, 21 bp, Artificial Sequence
  Synthetic
attgcgaagggttattctcag

SEQ ID NO: 29023 - DNA, 21 bp, Artificial Sequence
  Synthetic
cagagggtggggtttagttct

SEQ ID NO: 29024 - DNA, 21 bp, Artificial Sequence
  Synthetic
cttaagtcgggtttttcgatg

SEQ ID NO: 29025 - DNA, 21 bp, Artificial Sequence
  Synthetic
gttgctttgggttatagttcg

SEQ ID NO: 29026 - DNA, 21 bp, Artificial Sequence
  Synthetic
atggctactggttggtcgtcg

SEQ ID NO: 29027 - DNA, 21 bp, Artificial Sequence
  Synthetic
gagcgggcggggtattcgtcg

SEQ ID NO: 29028 - DNA, 21 bp, Artificial Sequence
  Synthetic
gtggcgagggggtatagttct

SEQ ID NO: 29029 - DNA, 21 bp, Artificial Sequence
  Synthetic
ccgagggttggtttttcttct

SEQ ID NO: 29030 - DNA, 21 bp, Artificial Sequence
  Synthetic
ttgaggccggggtatagttcg

SEQ ID NO: 29031 - DNA, 21 bp, Artificial Sequence
  Synthetic
catggtcttgggttttcgagt

SEQ ID NO: 29032 - DNA, 21 bp, Artificial Sequence
  Synthetic
gtgcgtagtggttatagttct

SEQ ID NO: 29033 - DNA, 21 bp, Artificial Sequence
  Synthetic
agtaggccgggtttttcgatg

SEQ ID NO: 29034 - DNA, 21 bp, Artificial Sequence
  Synthetic
ttgaagacgggtttttcttct

SEQ ID NO: 29035 - DNA, 21 bp, Artificial Sequence
  Synthetic
ttgaagcagggttggtctgcg

SEQ ID NO: 29036 - DNA, 21 bp, Artificial Sequence
  Synthetic
tatttgaggggttggagtgag

SEQ ID NO: 29037 - DNA, 21 bp, Artificial Sequence
  Synthetic
actaagacggggtatagtagt

SEQ ID NO: 29038 - DNA, 21 bp, Artificial Sequence
  Synthetic
attgctttgggttatagtgct

SEQ ID NO: 29039 - DNA, 21 bp, Artificial Sequence
  Synthetic
gcgcagattgggtggtcgagt

SEQ ID NO: 29040 - DNA, 21 bp, Artificial Sequence
  Synthetic
agtgtgccggggtggtcggcg

SEQ ID NO: 29041 - DNA, 21 bp, Artificial Sequence
  Synthetic
ttgcatgctggttttagtagt

SEQ ID NO: 29042 - DNA, 21 bp, Artificial Sequence
  Synthetic
ctgagtattgggtggtctagt

SEQ ID NO: 29043 - DNA, 21 bp, Artificial Sequence
  Synthetic
gttcatcttggtttttcgtcg

SEQ ID NO: 29044 - DNA, 21 bp, Artificial Sequence
  Synthetic
ctgggtcatgggtggtctcag

SEQ ID NO: 29045 - DNA, 21 bp, Artificial Sequence
  Synthetic
tcgagggcgggttatagtatg

SEQ ID NO: 29046 - DNA, 21 bp, Artificial Sequence
  Synthetic
cgtgttccggggttttcttcg

SEQ ID NO: 29047 - DNA, 21 bp, Artificial Sequence
  Synthetic
gttattccgggttggtcttct

SEQ ID NO: 29048 - DNA, 21 bp, Artificial Sequence
  Synthetic
cttatgcgtggttttagtacg

SEQ ID NO: 29049 - DNA, 21 bp, Artificial Sequence
  Synthetic
ttgcagcctggttggagtact

SEQ ID NO: 29050 - DNA, 21 bp, Artificial Sequence
  Synthetic
actattgtggggttttcttcg

SEQ ID NO: 29051 - DNA, 21 bp, Artificial Sequence
  Synthetic
gttcgtgcgggtttttcttct

SEQ ID NO: 29052 - DNA, 21 bp, Artificial Sequence
  Synthetic
aattatgctgggtatagtact

SEQ ID NO: 29053 - DNA, 21 bp, Artificial Sequence
  Synthetic
aagtctccgggtttttctagt

SEQ ID NO: 29054 - DNA, 21 bp, Artificial Sequence
  Synthetic
atggctgcgggtttttctcag

SEQ ID NO: 29055 - DNA, 21 bp, Artificial Sequence
  Synthetic
cttagggcggggtattctgtt

SEQ ID NO: 29056 - DNA, 21 bp, Artificial Sequence
  Synthetic
cctcggtctgggtttagtagt

SEQ ID NO: 29057 - DNA, 21 bp, Artificial Sequence
  Synthetic
atggctgttggttttagtagt

SEQ ID NO: 29058 - DNA, 21 bp, Artificial Sequence
  Synthetic
aatcgtccggggtttagtagt

SEQ ID NO: 29059 - DNA, 21 bp, Artificial Sequence
  Synthetic
gggggtctgggttggagttcg

SEQ ID NO: 29060 - DNA, 21 bp, Artificial Sequence
  Synthetic
tggagtcatgggtattctacg

SEQ ID NO: 29061 - DNA, 21 bp, Artificial Sequence
  Synthetic
gttcgtagtgggtttagttcg

SEQ ID NO: 29062 - DNA, 21 bp, Artificial Sequence
  Synthetic
gtgcggtcggggtttagtatg

SEQ ID NO: 29063 - DNA, 21 bp, Artificial Sequence
  Synthetic
gtgatgcatggttttagttcg

SEQ ID NO: 29064 - DNA, 21 bp, Artificial Sequence
  Synthetic
agtaaggttggttattctagt

SEQ ID NO: 29065 - DNA, 21 bp, Artificial Sequence
  Synthetic
acgtatcctgggtattctgtg

SEQ ID NO: 29066 - DNA, 21 bp, Artificial Sequence
  Synthetic
ttgagggaggggttttctcag

SEQ ID NO: 29067 - DNA, 21 bp, Artificial Sequence
  Synthetic
gtgatgcctggttggtctagt

SEQ ID NO: 29068 - DNA, 21 bp, Artificial Sequence
  Synthetic
gctatgcgggggtattctagt

SEQ ID NO: 29069 - DNA, 21 bp, Artificial Sequence
  Synthetic
ttgcagactggttatagtcag

SEQ ID NO: 29070 - DNA, 21 bp, Artificial Sequence
  Synthetic
aagcatacgggttttagtcag

SEQ ID NO: 29071 - DNA, 21 bp, Artificial Sequence
  Synthetic
ggttttccggggttttctacg

SEQ ID NO: 29072 - DNA, 21 bp, Artificial Sequence
  Synthetic
atgcatcctgggtattcgatg

SEQ ID NO: 29073 - DNA, 21 bp, Artificial Sequence
  Synthetic
tggagggaggggtggtcgact

SEQ ID NO: 29074 - DNA, 21 bp, Artificial Sequence
  Synthetic
atgaaggctggttatagttct

SEQ ID NO: 29075 - DNA, 21 bp, Artificial Sequence
  Synthetic
ctgtttgctggttattctacg

SEQ ID NO: 29076 - DNA, 21 bp, Artificial Sequence
  Synthetic
aggattccgggtttttcggcg

SEQ ID NO: 29077 - DNA, 21 bp, Artificial Sequence
  Synthetic
ttgttgaagggttggtcggct

SEQ ID NO: 29078 - DNA, 21 bp, Artificial Sequence
  Synthetic
tctgtgccgggttggtcgtcg

SEQ ID NO: 29079 - DNA, 21 bp, Artificial Sequence
  Synthetic
gttgttccggggttttcttat

SEQ ID NO: 29080 - DNA, 21 bp, Artificial Sequence
  Synthetic
atgaatcatggttattctatg

SEQ ID NO: 29081 - DNA, 21 bp, Artificial Sequence
  Synthetic
gtgctttctgggttttcgcag

SEQ ID NO: 29082 - DNA, 21 bp, Artificial Sequence
  Synthetic
aaggttcaggggttttctagt

SEQ ID NO: 29083 - DNA, 21 bp, Artificial Sequence
  Synthetic
agtcatccgggttttagttct

SEQ ID NO: 29084 - DNA, 21 bp, Artificial Sequence
  Synthetic
gtttttagtgggtattcgtct

SEQ ID NO: 29085 - DNA, 21 bp, Artificial Sequence
  Synthetic
ttgttgcgtggttattcgaat

SEQ ID NO: 29086 - DNA, 21 bp, Artificial Sequence
  Synthetic
tggaagattggttttagttct

SEQ ID NO: 29087 - DNA, 21 bp, Artificial Sequence
  Synthetic
gataggccgggttttagttat

SEQ ID NO: 29088 - DNA, 21 bp, Artificial Sequence
  Synthetic
gtgcatcagggttatagtagt

SEQ ID NO: 29089 - DNA, 21 bp, Artificial Sequence
  Synthetic
aaggtgccggggtatagtgcg

SEQ ID NO: 29090 - DNA, 21 bp, Artificial Sequence
  Synthetic
gcgaaggctgggtggagtagt

SEQ ID NO: 29091 - DNA, 21 bp, Artificial Sequence
  Synthetic
actcgggctgggtattctagt

SEQ ID NO: 29092 - DNA, 21 bp, Artificial Sequence
  Synthetic
tttatggctgggtattctaat

SEQ ID NO: 29093 - DNA, 21 bp, Artificial Sequence
  Synthetic
agtgcgccgggttggagtacg

SEQ ID NO: 29094 - DNA, 21 bp, Artificial Sequence
  Synthetic
ctgattgcggggtatagttcg

SEQ ID NO: 29095 - DNA, 21 bp, Artificial Sequence
  Synthetic
tcgtatcagggttatagtagt

SEQ ID NO: 29096 - DNA, 21 bp, Artificial Sequence
  Synthetic
gtggctcatgggtttagtatg

SEQ ID NO: 29097 - DNA, 21 bp, Artificial Sequence
  Synthetic
ctttatgctgggtttagtagt

SEQ ID NO: 29098 - DNA, 21 bp, Artificial Sequence
  Synthetic
gggatggcgggttggtcttcg

SEQ ID NO: 29099 - DNA, 21 bp, Artificial Sequence
  Synthetic
cttaatttggggtatagtcag

SEQ ID NO: 29100 - DNA, 21 bp, Artificial Sequence
  Synthetic
gagtttcctggttggagtagt

SEQ ID NO: 29101 - DNA, 21 bp, Artificial Sequence
  Synthetic
ttgtcgattgggtttagtgtg

SEQ ID NO: 29102 - DNA, 21 bp, Artificial Sequence
  Synthetic
tatgatagggggtattcgacg

SEQ ID NO: 29103 - DNA, 21 bp, Artificial Sequence
  Synthetic
acggctcatgggtatagttcg

SEQ ID NO: 29104 - DNA, 21 bp, Artificial Sequence
  Synthetic
tggctgcatgggtattcttcg

SEQ ID NO: 29105 - DNA, 21 bp, Artificial Sequence
  Synthetic
atgcagaaggggttttctacg

SEQ ID NO: 29106 - DNA, 21 bp, Artificial Sequence
  Synthetic
acgatgccgggttatagtgcg

SEQ ID NO: 29107 - DNA, 21 bp, Artificial Sequence
  Synthetic
agttcgccggggtggagttct

SEQ ID NO: 29108 - DNA, 21 bp, Artificial Sequence
  Synthetic
aagcagatggggtttagttct

SEQ ID NO: 29109 - DNA, 21 bp, Artificial Sequence
  Synthetic
aaggcgcctgggttttcgcag

SEQ ID NO: 29110 - DNA, 21 bp, Artificial Sequence
  Synthetic
gttcgtgctgggttttcgagt

SEQ ID NO: 29111 - DNA, 21 bp, Artificial Sequence
  Synthetic
ttggagattggttggtcttcg

SEQ ID NO: 29112 - DNA, 21 bp, Artificial Sequence
  Synthetic
gtgaggtctggttattcggct

SEQ ID NO: 29113 - DNA, 21 bp, Artificial Sequence
  Synthetic
actcatgctgggtttagtacg

SEQ ID NO: 29114 - DNA, 21 bp, Artificial Sequence
  Synthetic
atgcatagtgggtattcgagt

SEQ ID NO: 29115 - DNA, 21 bp, Artificial Sequence
  Synthetic
ttgagggatgggtggtctcag

SEQ ID NO: 29116 - DNA, 21 bp, Artificial Sequence
  Synthetic
gagcgtactgggtattcgatg

SEQ ID NO: 29117 - DNA, 21 bp, Artificial Sequence
  Synthetic
gtggtgcctggtttttctagt

SEQ ID NO: 29118 - DNA, 21 bp, Artificial Sequence
  Synthetic
cttcgtccgggttggtcgcag

SEQ ID NO: 29119 - DNA, 21 bp, Artificial Sequence
  Synthetic
gtgaatctggggtattcttct

SEQ ID NO: 29120 - DNA, 21 bp, Artificial Sequence
  Synthetic
cctcatgctgggtatagtgcg

SEQ ID NO: 29121 - DNA, 21 bp, Artificial Sequence
  Synthetic
ctttcgcatgggtattctagt

SEQ ID NO: 29122 - DNA, 21 bp, Artificial Sequence
  Synthetic
caggctgcgggttggtcttcg

SEQ ID NO: 29123 - DNA, 21 bp, Artificial Sequence
  Synthetic
ggtgctccgggttggagtact

SEQ ID NO: 29124 - DNA, 21 bp, Artificial Sequence
  Synthetic
ttgagtaagggtttttcgact

SEQ ID NO: 29125 - DNA, 21 bp, Artificial Sequence
  Synthetic
cttcgtgaggggtatagtact

SEQ ID NO: 29126 - DNA, 21 bp, Artificial Sequence
  Synthetic
catcttcatggttattcggat

SEQ ID NO: 29127 - DNA, 21 bp, Artificial Sequence
  Synthetic
tttagtattggtttttcgagt

SEQ ID NO: 29128 - DNA, 21 bp, Artificial Sequence
  Synthetic
ttgttgaagggttggagtacg

SEQ ID NO: 29129 - DNA, 21 bp, Artificial Sequence
  Synthetic
attattaagggttattcgtcg

SEQ ID NO: 29130 - DNA, 21 bp, Artificial Sequence
  Synthetic
gttgtgagtggttggtcttct

SEQ ID NO: 29131 - DNA, 21 bp, Artificial Sequence
  Synthetic
attcgtgagggttattctagt

SEQ ID NO: 29132 - DNA, 21 bp, Artificial Sequence
  Synthetic
agtcgtgagggttggtctacg

SEQ ID NO: 29133 - DNA, 21 bp, Artificial Sequence
  Synthetic
gagcgtgcgggttggtctgcg

SEQ ID NO: 29134 - DNA, 21 bp, Artificial Sequence
  Synthetic
atggatttgggttggagttcg

SEQ ID NO: 29135 - DNA, 21 bp, Artificial Sequence
  Synthetic
gtgatgaagggttatagtagt

SEQ ID NO: 29136 - DNA, 21 bp, Artificial Sequence
  Synthetic
actcgtacggggtatagtgtt

SEQ ID NO: 29137 - DNA, 21 bp, Artificial Sequence
  Synthetic
gttgcggcgggttggagtacg

SEQ ID NO: 29138 - DNA, 21 bp, Artificial Sequence
  Synthetic
gcgtatttgggttatagtgcg

SEQ ID NO: 29139 - DNA, 21 bp, Artificial Sequence
  Synthetic
acggggcatgggtatagttct

SEQ ID NO: 29140 - DNA, 21 bp, Artificial Sequence
  Synthetic
agtcggacggggtttagtact

SEQ ID NO: 29141 - DNA, 21 bp, Artificial Sequence
  Synthetic
attctgtcgggttattcgatg

SEQ ID NO: 29142 - DNA, 21 bp, Artificial Sequence
  Synthetic
ctggatgttgggtggagttcg

SEQ ID NO: 29143 - DNA, 21 bp, Artificial Sequence
  Synthetic
ggtgtgccgggttggtcttct

SEQ ID NO: 29144 - DNA, 21 bp, Artificial Sequence
  Synthetic
agtgcgccgggttggtcgcat

SEQ ID NO: 29145 - DNA, 21 bp, Artificial Sequence
  Synthetic
ttgaatccggggtggtcgacg

SEQ ID NO: 29146 - DNA, 21 bp, Artificial Sequence
  Synthetic
gttactcatgggttttcttct

SEQ ID NO: 29147 - DNA, 21 bp, Artificial Sequence
  Synthetic
gctatgaggggtttttctact

SEQ ID NO: 29148 - DNA, 21 bp, Artificial Sequence
  Synthetic
tcgcttattggttattcttcg

SEQ ID NO: 29149 - DNA, 21 bp, Artificial Sequence
  Synthetic
agtgatcctggttggtcgtcg

SEQ ID NO: 29150 - DNA, 21 bp, Artificial Sequence
  Synthetic
aattcgccgggttggtcgtct

SEQ ID NO: 29151 - DNA, 21 bp, Artificial Sequence
  Synthetic
gatcggactgggtggtctact

SEQ ID NO: 29152 - DNA, 21 bp, Artificial Sequence
  Synthetic
cagcgggcgggtttttctcag

SEQ ID NO: 29153 - DNA, 21 bp, Artificial Sequence
  Synthetic
actcagcgtgggtatagttct

SEQ ID NO: 29154 - DNA, 21 bp, Artificial Sequence
  Synthetic
catcttgtggggtttagttcg

SEQ ID NO: 29155 - DNA, 21 bp, Artificial Sequence
  Synthetic
cttggtaagggttattctacg

SEQ ID NO: 29156 - DNA, 21 bp, Artificial Sequence
  Synthetic
tttatgcctgggtattctgct

SEQ ID NO: 29157 - DNA, 21 bp, Artificial Sequence
  Synthetic
agtgtgattgggtattctcag

SEQ ID NO: 29158 - DNA, 21 bp, Artificial Sequence
  Synthetic
actgctatgggtttttcgtcg

SEQ ID NO: 29159 - DNA, 21 bp, Artificial Sequence
  Synthetic
caggggcttgggtttagttcg

SEQ ID NO: 29160 - DNA, 21 bp, Artificial Sequence
  Synthetic
gcgaatcatgggtattctatg

SEQ ID NO: 29161 - DNA, 21 bp, Artificial Sequence
  Synthetic
ggtgggattggttggtcgtcg

SEQ ID NO: 29162 - DNA, 21 bp, Artificial Sequence
  Synthetic
cagcatccgggtttttctgtg

SEQ ID NO: 29163 - DNA, 21 bp, Artificial Sequence
  Synthetic
gagaggatggggtattctgtg

SEQ ID NO: 29164 - DNA, 21 bp, Artificial Sequence
  Synthetic
gttcatgtggggtttagttct

SEQ ID NO: 29165 - DNA, 21 bp, Artificial Sequence
  Synthetic
gtgcgggcggggtattcggcg

SEQ ID NO: 29166 - DNA, 21 bp, Artificial Sequence
  Synthetic
ttggagagggggtatagtcag

SEQ ID NO: 29167 - DNA, 21 bp, Artificial Sequence
  Synthetic
actggtcatggttatagtacg

SEQ ID NO: 29168 - DNA, 21 bp, Artificial Sequence
  Synthetic
ctgactaagggttattctacg

SEQ ID NO: 29169 - DNA, 21 bp, Artificial Sequence
  Synthetic
ctgaatctggggtattcgcag

SEQ ID NO: 29170 - DNA, 21 bp, Artificial Sequence
  Synthetic
tttttggcggggtatagtact

SEQ ID NO: 29171 - DNA, 21 bp, Artificial Sequence
  Synthetic
actcatactggttttagtacg

SEQ ID NO: 29172 - DNA, 21 bp, Artificial Sequence
  Synthetic
ttttctaagggttattcgacg

SEQ ID NO: 29173 - DNA, 21 bp, Artificial Sequence
  Synthetic
tataagtcggggtggtctagt

SEQ ID NO: 29174 - DNA, 21 bp, Artificial Sequence
  Synthetic
gtgcatttggggtttagttct

SEQ ID NO: 29175 - DNA, 21 bp, Artificial Sequence
  Synthetic
cttctgggtggttatagtcag

SEQ ID NO: 29176 - DNA, 21 bp, Artificial Sequence
  Synthetic
atggcggttgggtggagtgcg

SEQ ID NO: 29177 - DNA, 21 bp, Artificial Sequence
  Synthetic
gctgggtatgggtattctagt

SEQ ID NO: 29178 - DNA, 21 bp, Artificial Sequence
  Synthetic
atgtttcaggggtattctgtg

SEQ ID NO: 29179 - DNA, 21 bp, Artificial Sequence
  Synthetic
gtgatgactgggtattcggcg

SEQ ID NO: 29180 - DNA, 21 bp, Artificial Sequence
  Synthetic
ttgaatgtggggttttctacg

SEQ ID NO: 29181 - DNA, 21 bp, Artificial Sequence
  Synthetic
actgggcttgggttttcttcg

SEQ ID NO: 29182 - DNA, 21 bp, Artificial Sequence
  Synthetic
gtggagcgtggttggagttct

SEQ ID NO: 29183 - DNA, 21 bp, Artificial Sequence
  Synthetic
tttcctgttgggtggagtgct

SEQ ID NO: 29184 - DNA, 21 bp, Artificial Sequence
  Synthetic
actgttgcgggttttagtagt

SEQ ID NO: 29185 - DNA, 21 bp, Artificial Sequence
  Synthetic
tcgagtcggggttattcgagt

SEQ ID NO: 29186 - DNA, 21 bp, Artificial Sequence
  Synthetic
tttggggttggtttttcttct

SEQ ID NO: 29187 - DNA, 21 bp, Artificial Sequence
  Synthetic
cctcatgcggggttttcttct

SEQ ID NO: 29188 - DNA, 21 bp, Artificial Sequence
  Synthetic
attaaggctggttatagtagt

SEQ ID NO: 29189 - DNA, 21 bp, Artificial Sequence
  Synthetic
ctgatggctgggtatagtgct

SEQ ID NO: 29190 - DNA, 21 bp, Artificial Sequence
  Synthetic
cagattccgggtttttctgct

SEQ ID NO: 29191 - DNA, 21 bp, Artificial Sequence
  Synthetic
ctgattcggggttatagtagt

SEQ ID NO: 29192 - DNA, 21 bp, Artificial Sequence
  Synthetic
gagaagtcgggttattctagt

SEQ ID NO: 29193 - DNA, 21 bp, Artificial Sequence
  Synthetic
gagatgccgggttttagtgcg

SEQ ID NO: 29194 - DNA, 21 bp, Artificial Sequence
  Synthetic
cctaaggttggtttttctgcg

SEQ ID NO: 29195 - DNA, 21 bp, Artificial Sequence
  Synthetic
gcgaggagtggtttttctagt

SEQ ID NO: 29196 - DNA, 21 bp, Artificial Sequence
  Synthetic
atggtgcatgggttttcgtct

SEQ ID NO: 29197 - DNA, 21 bp, Artificial Sequence
  Synthetic
tggatgaagggttatagtatg

SEQ ID NO: 29198 - DNA, 21 bp, Artificial Sequence
  Synthetic
gagcggacggggtggagtgtt

SEQ ID NO: 29199 - DNA, 21 bp, Artificial Sequence
  Synthetic
gctcggttgggttatagtacg

SEQ ID NO: 29200 - DNA, 21 bp, Artificial Sequence
  Synthetic
tcgaaggcgggttatagtgcg

SEQ ID NO: 29201 - DNA, 21 bp, Artificial Sequence
  Synthetic
tggaagagtggtttttcttcg

SEQ ID NO: 29202 - DNA, 21 bp, Artificial Sequence
  Synthetic
ttgttgcatggttatagtgtt

SEQ ID NO: 29203 - DNA, 21 bp, Artificial Sequence
  Synthetic
gcttatccggggtattcgtct

SEQ ID NO: 29204 - DNA, 21 bp, Artificial Sequence
  Synthetic
attgctacgggttattcgtcg

SEQ ID NO: 29205 - DNA, 21 bp, Artificial Sequence
  Synthetic
ccggttagggggtttagtgct

SEQ ID NO: 29206 - DNA, 21 bp, Artificial Sequence
  Synthetic
ttggttccggggtggagtgtg

SEQ ID NO: 29207 - DNA, 21 bp, Artificial Sequence
  Synthetic
cctgcggttggttttagtgcg

SEQ ID NO: 29208 - DNA, 21 bp, Artificial Sequence
  Synthetic
ttgggtttgggttttagtgtt

SEQ ID NO: 29209 - DNA, 21 bp, Artificial Sequence
  Synthetic
atttcggttgggtggagtagt

SEQ ID NO: 29210 - DNA, 21 bp, Artificial Sequence
  Synthetic
gttgggcatggtttttctcag

SEQ ID NO: 29211 - DNA, 21 bp, Artificial Sequence
  Synthetic
tcgcgggttggttatagtacg

SEQ ID NO: 29212 - DNA, 21 bp, Artificial Sequence
  Synthetic
agtgtggctgggtatagtcag

SEQ ID NO: 29213 - DNA, 21 bp, Artificial Sequence
  Synthetic
gagctgcctggttggagtgtg

SEQ ID NO: 29214 - DNA, 21 bp, Artificial Sequence
  Synthetic
aggtcgccgggttattcgcag

SEQ ID NO: 29215 - DNA, 21 bp, Artificial Sequence
  Synthetic
tttattccggggttttctcag

SEQ ID NO: 29216 - DNA, 21 bp, Artificial Sequence
  Synthetic
ttgtttggtgggtattcgacg

SEQ ID NO: 29217 - DNA, 21 bp, Artificial Sequence
  Synthetic
gttcgtgatgggtggagttct

SEQ ID NO: 29218 - DNA, 21 bp, Artificial Sequence
  Synthetic
atggatcgtgggttttcttct

SEQ ID NO: 29219 - DNA, 21 bp, Artificial Sequence
  Synthetic
ctgtcgattgggtggagtcag

SEQ ID NO: 29220 - DNA, 21 bp, Artificial Sequence
  Synthetic
gctcaggttggttggtcggct

SEQ ID NO: 29221 - DNA, 21 bp, Artificial Sequence
  Synthetic
gttactcgtgggtattcgatg

SEQ ID NO: 29222 - DNA, 21 bp, Artificial Sequence
  Synthetic
cgggtgcctggttatagtatg

SEQ ID NO: 29223 - DNA, 21 bp, Artificial Sequence
  Synthetic
actgtgcatggttatagtacg

SEQ ID NO: 29224 - DNA, 21 bp, Artificial Sequence
  Synthetic
cgttgggagggttttagtcag

SEQ ID NO: 29225 - DNA, 21 bp, Artificial Sequence
  Synthetic
acggtgacgggttttagtcag

SEQ ID NO: 29226 - DNA, 21 bp, Artificial Sequence
  Synthetic
cggtctgcggggttttcttct

SEQ ID NO: 29227 - DNA, 21 bp, Artificial Sequence
  Synthetic
tcgtttcctggttggagtgcg

SEQ ID NO: 29228 - DNA, 21 bp, Artificial Sequence
  Synthetic
ggtttgattgggtggtctagt

SEQ ID NO: 29229 - DNA, 21 bp, Artificial Sequence
  Synthetic
tctggtgttggttggagttct

SEQ ID NO: 29230 - DNA, 21 bp, Artificial Sequence
  Synthetic
cagatgacgggttggtcgtct

SEQ ID NO: 29231 - DNA, 21 bp, Artificial Sequence
  Synthetic
acttctcgtggttattcgatg

SEQ ID NO: 29232 - DNA, 21 bp, Artificial Sequence
  Synthetic
gcgaggcctggtttttcgagt

SEQ ID NO: 29233 - DNA, 21 bp, Artificial Sequence
  Synthetic
gggtttcctgggtattcgtct

SEQ ID NO: 29234 - DNA, 21 bp, Artificial Sequence
  Synthetic
acgtatgctgggtattcggct

SEQ ID NO: 29235 - DNA, 21 bp, Artificial Sequence
  Synthetic
ctggatcgggggttttcttcg

SEQ ID NO: 29236 - DNA, 21 bp, Artificial Sequence
  Synthetic
agttcgcctgggtttagttcg

SEQ ID NO: 29237 - DNA, 21 bp, Artificial Sequence
  Synthetic
aagatgcctgggtggtctact

SEQ ID NO: 29238 - DNA, 21 bp, Artificial Sequence
  Synthetic
gttgcgaggggttatagtatg

SEQ ID NO: 29239 - DNA, 21 bp, Artificial Sequence
  Synthetic
gcgggtgttggttttagttcg

SEQ ID NO: 29240 - DNA, 21 bp, Artificial Sequence
  Synthetic
gcggttaggggtttttcttcg

SEQ ID NO: 29241 - DNA, 21 bp, Artificial Sequence
  Synthetic
atgctgagtgggtattcgatg

SEQ ID NO: 29242 - DNA, 21 bp, Artificial Sequence
  Synthetic
gattggagggggtattctagt

SEQ ID NO: 29243 - DNA, 21 bp, Artificial Sequence
  Synthetic
tgggcggctgggtatagttat

SEQ ID NO: 29244 - DNA, 21 bp, Artificial Sequence
  Synthetic
gtgcatcaggggtatagtact

SEQ ID NO: 29245 - DNA, 21 bp, Artificial Sequence
  Synthetic
ttggggagtggttggagtact

SEQ ID NO: 29246 - DNA, 21 bp, Artificial Sequence
  Synthetic
tttgtgccgggttttagtcag

SEQ ID NO: 29247 - DNA, 21 bp, Artificial Sequence
  Synthetic
gataatagggggtggtctacg

SEQ ID NO: 29248 - DNA, 21 bp, Artificial Sequence
  Synthetic
gagcgttcggggtttagtagt

SEQ ID NO: 29249 - DNA, 21 bp, Artificial Sequence
  Synthetic
actggtattggttattctcag

SEQ ID NO: 29250 - DNA, 21 bp, Artificial Sequence
  Synthetic
catttgcgggggtattcggag

SEQ ID NO: 29251 - DNA, 21 bp, Artificial Sequence
  Synthetic
gggggtattgggtggtctagt

SEQ ID NO: 29252 - DNA, 21 bp, Artificial Sequence
  Synthetic
ctgcatgtggggtatagtgcg

SEQ ID NO: 29253 - DNA, 21 bp, Artificial Sequence
  Synthetic
tcttggtctgggtattctgct

SEQ ID NO: 29254 - DNA, 21 bp, Artificial Sequence
  Synthetic
gtttttgcgggttttagtgcg

SEQ ID NO: 29255 - DNA, 21 bp, Artificial Sequence
  Synthetic
attacgattggttattcgcag

SEQ ID NO: 29256 - DNA, 21 bp, Artificial Sequence
  Synthetic
gagaaggttggttggtcgcag

SEQ ID NO: 29257 - DNA, 21 bp, Artificial Sequence
  Synthetic
ttggcgattgggtggagttct

SEQ ID NO: 29258 - DNA, 21 bp, Artificial Sequence
  Synthetic
agtcatgcggggtattctact

SEQ ID NO: 29259 - DNA, 21 bp, Artificial Sequence
  Synthetic
gtgagggttgggttttcttct

SEQ ID NO: 29260 - DNA, 21 bp, Artificial Sequence
  Synthetic
actgctaagggttggtcgagt

SEQ ID NO: 29261 - DNA, 21 bp, Artificial Sequence
  Synthetic
gagaggactggttggtctgct

SEQ ID NO: 29262 - DNA, 21 bp, Artificial Sequence
  Synthetic
ttggagcgtgggtattctact

SEQ ID NO: 29263 - DNA, 21 bp, Artificial Sequence
  Synthetic
ggttatcctgggttttctact

SEQ ID NO: 29264 - DNA, 21 bp, Artificial Sequence
  Synthetic
atgcgtactgggttttcgcag

SEQ ID NO: 29265 - DNA, 21 bp, Artificial Sequence
  Synthetic
attgctaggggttatagtgtt

SEQ ID NO: 29266 - DNA, 21 bp, Artificial Sequence
  Synthetic
gatattcctgggtggagtcat

SEQ ID NO: 29267 - DNA, 21 bp, Artificial Sequence
  Synthetic
actattcggggtttttctgtg

SEQ ID NO: 29268 - DNA, 21 bp, Artificial Sequence
  Synthetic
cttatggttggttattctgtg

SEQ ID NO: 29269 - DNA, 21 bp, Artificial Sequence
  Synthetic
acgaggacgggttatagtacg

SEQ ID NO: 29270 - DNA, 21 bp, Artificial Sequence
  Synthetic
agtcatgtggggtggagtcag

SEQ ID NO: 29271 - DNA, 21 bp, Artificial Sequence
  Synthetic
gatcttcctggttggtcttct

SEQ ID NO: 29272 - DNA, 21 bp, Artificial Sequence
  Synthetic
ctggagcagggttggagtacg

SEQ ID NO: 29273 - DNA, 21 bp, Artificial Sequence
  Synthetic
attgcgcaggggtattcgacg

SEQ ID NO: 29274 - DNA, 21 bp, Artificial Sequence
  Synthetic
gataagactggttggtctagt

SEQ ID NO: 29275 - DNA, 21 bp, Artificial Sequence
  Synthetic
cattttagtgggtattctacg

SEQ ID NO: 29276 - DNA, 21 bp, Artificial Sequence
  Synthetic
ctggaggtgggttggagtact

SEQ ID NO: 29277 - DNA, 21 bp, Artificial Sequence
  Synthetic
atgatgattggttggtctgct

SEQ ID NO: 29278 - DNA, 21 bp, Artificial Sequence
  Synthetic
ttggtgcatggttttagtgtg

SEQ ID NO: 29279 - DNA, 21 bp, Artificial Sequence
  Synthetic
gagattcctgggtattcgcag

SEQ ID NO: 29280 - DNA, 21 bp, Artificial Sequence
  Synthetic
gaggcgccgggttattcgagt

SEQ ID NO: 29281 - DNA, 21 bp, Artificial Sequence
  Synthetic
atgggtgttggttttagtagt

SEQ ID NO: 29282 - DNA, 21 bp, Artificial Sequence
  Synthetic
caggtggcgggttggagtgct

SEQ ID NO: 29283 - DNA, 21 bp, Artificial Sequence
  Synthetic
cttaagcctggtttttcttct

SEQ ID NO: 29284 - DNA, 21 bp, Artificial Sequence
  Synthetic
ctgcagattggtttttctact

SEQ ID NO: 29285 - DNA, 21 bp, Artificial Sequence
  Synthetic
agttttgtggggtttagtgct

SEQ ID NO: 29286 - DNA, 21 bp, Artificial Sequence
  Synthetic
tattcgcatggttattctcag

SEQ ID NO: 29287 - DNA, 21 bp, Artificial Sequence
  Synthetic
gttatgctggggtatagtgct

SEQ ID NO: 29288 - DNA, 21 bp, Artificial Sequence
  Synthetic
tatcatattggttattctgct

SEQ ID NO: 29289 - DNA, 21 bp, Artificial Sequence
  Synthetic
ggttttcctggtttttctact

SEQ ID NO: 29290 - DNA, 21 bp, Artificial Sequence
  Synthetic
agtagggaggggtatagtact

SEQ ID NO: 29291 - DNA, 21 bp, Artificial Sequence
  Synthetic
gcgcagccggggtggagtagt

SEQ ID NO: 29292 - DNA, 21 bp, Artificial Sequence
  Synthetic
attgttaagggttattcggcg

SEQ ID NO: 29293 - DNA, 21 bp, Artificial Sequence
  Synthetic
gtggctgcgggttggagtcag

SEQ ID NO: 29294 - DNA, 21 bp, Artificial Sequence
  Synthetic
gtgatgaaggggtattctgct

SEQ ID NO: 29295 - DNA, 21 bp, Artificial Sequence
  Synthetic
gtggtttcgggttggtcttct

SEQ ID NO: 29296 - DNA, 21 bp, Artificial Sequence
  Synthetic
cctagtctgggttggagttct

SEQ ID NO: 29297 - DNA, 21 bp, Artificial Sequence
  Synthetic
tatcatgtgggttggtctgcg

SEQ ID NO: 29298 - DNA, 21 bp, Artificial Sequence
  Synthetic
cttcagtctggttggagtgtg

SEQ ID NO: 29299 - DNA, 21 bp, Artificial Sequence
  Synthetic
ttgcaggagggttggagtcat

SEQ ID NO: 29300 - DNA, 21 bp, Artificial Sequence
  Synthetic
atgcaggtgggttggtcttcg

SEQ ID NO: 29301 - DNA, 21 bp, Artificial Sequence
  Synthetic
gatcggagtggttttagttgg

SEQ ID NO: 29302 - DNA, 21 bp, Artificial Sequence
  Synthetic
atgactacggggtggagttct

SEQ ID NO: 29303 - DNA, 21 bp, Artificial Sequence
  Synthetic
gagcctcctgggtggagtcat

SEQ ID NO: 29304 - DNA, 21 bp, Artificial Sequence
  Synthetic
catgattatggttttagtcag

SEQ ID NO: 29305 - DNA, 21 bp, Artificial Sequence
  Synthetic
acgagggttggtttttcgcat

SEQ ID NO: 29306 - DNA, 21 bp, Artificial Sequence
  Synthetic
cttaatgttgggtggagttct

SEQ ID NO: 29307 - DNA, 21 bp, Artificial Sequence
  Synthetic
gttgatagggggtattctcag

SEQ ID NO: 29308 - DNA, 21 bp, Artificial Sequence
  Synthetic
cagcgtccgggttatagtgct

SEQ ID NO: 29309 - DNA, 21 bp, Artificial Sequence
  Synthetic
tctgctcagggttatagtact

SEQ ID NO: 29310 - DNA, 21 bp, Artificial Sequence
  Synthetic
ttgaaggggggttggagttct

SEQ ID NO: 29311 - DNA, 21 bp, Artificial Sequence
  Synthetic
ctgaagcttgggttttcgacg

SEQ ID NO: 29312 - DNA, 21 bp, Artificial Sequence
  Synthetic
atgcatagtggtttttcggtg

SEQ ID NO: 29313 - DNA, 21 bp, Artificial Sequence
  Synthetic
tcggttgtggggtggtcggcg

SEQ ID NO: 29314 - DNA, 21 bp, Artificial Sequence
  Synthetic
gttgctgttggttggagtgcg

SEQ ID NO: 29315 - DNA, 21 bp, Artificial Sequence
  Synthetic
gagcggcatgggtttagttat

SEQ ID NO: 29316 - DNA, 21 bp, Artificial Sequence
  Synthetic
tttggtgtgggttttagtact

SEQ ID NO: 29317 - DNA, 21 bp, Artificial Sequence
  Synthetic
tttattgcggggtggtcgtcg

SEQ ID NO: 29318 - DNA, 21 bp, Artificial Sequence
  Synthetic
atgaatgctgggtttagttct

SEQ ID NO: 29319 - DNA, 21 bp, Artificial Sequence
  Synthetic
gataggattggttattcgtat

SEQ ID NO: 29320 - DNA, 21 bp, Artificial Sequence
  Synthetic
gttaaggctgggtattcgtcg

SEQ ID NO: 29321 - DNA, 21 bp, Artificial Sequence
  Synthetic
gataagttgggttggagtgct

SEQ ID NO: 29322 - DNA, 21 bp, Artificial Sequence
  Synthetic
attgttattgggttttcgtcg

SEQ ID NO: 29323 - DNA, 21 bp, Artificial Sequence
  Synthetic
aagatgccgggttggtcttct

SEQ ID NO: 29324 - DNA, 21 bp, Artificial Sequence
  Synthetic
cttgctagggggtattcgtct

SEQ ID NO: 29325 - DNA, 21 bp, Artificial Sequence
  Synthetic
gtgttttctggttttagtagt

SEQ ID NO: 29326 - DNA, 21 bp, Artificial Sequence
  Synthetic
tggcttcctggttttagtcag

SEQ ID NO: 29327 - DNA, 21 bp, Artificial Sequence
  Synthetic
ctgtatgttgggtttagtagt

SEQ ID NO: 29328 - DNA, 21 bp, Artificial Sequence
  Synthetic
gcgcttcatgggtatagtatt

SEQ ID NO: 29329 - DNA, 21 bp, Artificial Sequence
  Synthetic
actttgcatggttggagtgcg

SEQ ID NO: 29330 - DNA, 21 bp, Artificial Sequence
  Synthetic
attattctggggtatagtact

SEQ ID NO: 29331 - DNA, 21 bp, Artificial Sequence
  Synthetic
tcgcgggttggtttttcgacg

SEQ ID NO: 29332 - DNA, 21 bp, Artificial Sequence
  Synthetic
gttgcgactgggtggtcgtcg

SEQ ID NO: 29333 - DNA, 21 bp, Artificial Sequence
  Synthetic
atgtttgttggttttagtgcg

SEQ ID NO: 29334 - DNA, 21 bp, Artificial Sequence
  Synthetic
acgtttgttgggtattcgtct

SEQ ID NO: 29335 - DNA, 21 bp, Artificial Sequence
  Synthetic
cctccgggtgggtggtctagt

SEQ ID NO: 29336 - DNA, 21 bp, Artificial Sequence
  Synthetic
cctgggaagggttattcgtcg

SEQ ID NO: 29337 - DNA, 21 bp, Artificial Sequence
  Synthetic
agtcatattgggtttagtgcg

SEQ ID NO: 29338 - DNA, 21 bp, Artificial Sequence
  Synthetic
cctagggctgggttttcgatg

SEQ ID NO: 29339 - DNA, 21 bp, Artificial Sequence
  Synthetic
actattagtgggtattcgacg

SEQ ID NO: 29340 - DNA, 21 bp, Artificial Sequence
  Synthetic
gcgtatgctgggtatagtctt

SEQ ID NO: 29341 - DNA, 21 bp, Artificial Sequence
  Synthetic
gttaataagggttatagtact

SEQ ID NO: 29342 - DNA, 21 bp, Artificial Sequence
  Synthetic
ctttatcctggttttagtgct

SEQ ID NO: 29343 - DNA, 21 bp, Artificial Sequence
  Synthetic
gtttctatgggttattcgtct

SEQ ID NO: 29344 - DNA, 21 bp, Artificial Sequence
  Synthetic
cctgcggggggttttagtgtt

SEQ ID NO: 29345 - DNA, 21 bp, Artificial Sequence
  Synthetic
gttgttaggggttattcggcg

SEQ ID NO: 29346 - DNA, 21 bp, Artificial Sequence
  Synthetic
ccgggtcctgggtttagttct

SEQ ID NO: 29347 - DNA, 21 bp, Artificial Sequence
  Synthetic
gctagttatgggtattcgagt

SEQ ID NO: 29348 - DNA, 21 bp, Artificial Sequence
  Synthetic
attgctattggttatagtacg

SEQ ID NO: 29349 - DNA, 21 bp, Artificial Sequence
  Synthetic
gattttagggggtattcggtt

SEQ ID NO: 29350 - DNA, 21 bp, Artificial Sequence
  Synthetic
cagaagattggttatagtgcg

SEQ ID NO: 29351 - DNA, 21 bp, Artificial Sequence
  Synthetic
agtctggttgggtattcgtat

SEQ ID NO: 29352 - DNA, 21 bp, Artificial Sequence
  Synthetic
gataggcatggttatagttcg

SEQ ID NO: 29353 - DNA, 21 bp, Artificial Sequence
  Synthetic
tatcttaatgggtatagtatt

SEQ ID NO: 29354 - DNA, 21 bp, Artificial Sequence
  Synthetic
attgtgcatgggtttagtact

SEQ ID NO: 29355 - DNA, 21 bp, Artificial Sequence
  Synthetic
tgtcaggtggggttttcttct

SEQ ID NO: 29356 - DNA, 21 bp, Artificial Sequence
  Synthetic
agtggggttggttggagttcg

SEQ ID NO: 29357 - DNA, 21 bp, Artificial Sequence
  Synthetic
tttgctcagggttttagttcg

SEQ ID NO: 29358 - DNA, 21 bp, Artificial Sequence
  Synthetic
gagtatgagggttggagttcg

SEQ ID NO: 29359 - DNA, 21 bp, Artificial Sequence
  Synthetic
gttagtaaggggtatagtagt

SEQ ID NO: 29360 - DNA, 21 bp, Artificial Sequence
  Synthetic
attttgccgggttggagtact

SEQ ID NO: 29361 - DNA, 21 bp, Artificial Sequence
  Synthetic
tgggttcatgggtattcgagt

SEQ ID NO: 29362 - DNA, 21 bp, Artificial Sequence
  Synthetic
agttatcagggttttagttct

SEQ ID NO: 29363 - DNA, 21 bp, Artificial Sequence
  Synthetic
tcgcggcctggttattctgct

SEQ ID NO: 29364 - DNA, 21 bp, Artificial Sequence
  Synthetic
aatcgtgtgggttatagtagt

SEQ ID NO: 29365 - DNA, 21 bp, Artificial Sequence
  Synthetic
gttctgacggggtggtctgct

SEQ ID NO: 29366 - DNA, 21 bp, Artificial Sequence
  Synthetic
gcgaatcctgggtggtctact

SEQ ID NO: 29367 - DNA, 21 bp, Artificial Sequence
  Synthetic
gagaaggcggggtggagtgtt

SEQ ID NO: 29368 - DNA, 21 bp, Artificial Sequence
  Synthetic
gagcatcatggtttttctatg

SEQ ID NO: 29369 - DNA, 21 bp, Artificial Sequence
  Synthetic
cctgcgggtgggtttagtgct

SEQ ID NO: 29370 - DNA, 21 bp, Artificial Sequence
  Synthetic
acgtttgcggggtggtctgct

SEQ ID NO: 29371 - DNA, 21 bp, Artificial Sequence
  Synthetic
gtgatgcttggttatagttcg

SEQ ID NO: 29372 - DNA, 21 bp, Artificial Sequence
  Synthetic
ttgcttttggggtatagtgcg

SEQ ID NO: 29373 - DNA, 21 bp, Artificial Sequence
  Synthetic
atgcgggaggggtggagttct

SEQ ID NO: 29374 - DNA, 21 bp, Artificial Sequence
  Synthetic
gagcggacggggttttctgcg

SEQ ID NO: 29375 - DNA, 21 bp, Artificial Sequence
  Synthetic
tggaagactgggtattcttcg

SEQ ID NO: 29376 - DNA, 21 bp, Artificial Sequence
  Synthetic
ttgcgggttgggttttctatg

SEQ ID NO: 29377 - DNA, 21 bp, Artificial Sequence
  Synthetic
gttgagaggggttggtcggct

SEQ ID NO: 29378 - DNA, 21 bp, Artificial Sequence
  Synthetic
tcgaggcctggttggagtgtt

SEQ ID NO: 29379 - DNA, 21 bp, Artificial Sequence
  Synthetic
attattgcggggtattctgcg

SEQ ID NO: 29380 - DNA, 21 bp, Artificial Sequence
  Synthetic
attctggtgggttattcggtt

SEQ ID NO: 29381 - DNA, 21 bp, Artificial Sequence
  Synthetic
tctagtccggggtatagtagt

SEQ ID NO: 29382 - DNA, 21 bp, Artificial Sequence
  Synthetic
gcggctgttggttggtcgacg

SEQ ID NO: 29383 - DNA, 21 bp, Artificial Sequence
  Synthetic
cgggctgagggttggtcgtcg

SEQ ID NO: 29384 - DNA, 21 bp, Artificial Sequence
  Synthetic
ccgattcgggggttttctacg

SEQ ID NO: 29385 - DNA, 21 bp, Artificial Sequence
  Synthetic
agtcttccggggtggtctgct

SEQ ID NO: 29386 - DNA, 21 bp, Artificial Sequence
  Synthetic
ttgagttatggttattctgtg

SEQ ID NO: 29387 - DNA, 21 bp, Artificial Sequence
  Synthetic
atgtttactgggttttcgagt

SEQ ID NO: 29388 - DNA, 21 bp, Artificial Sequence
  Synthetic
cagagtgcgggttggagtact

SEQ ID NO: 29389 - DNA, 21 bp, Artificial Sequence
  Synthetic
gcgggggtgggtttttcgatg

SEQ ID NO: 29390 - DNA, 21 bp, Artificial Sequence
  Synthetic
gttagggctggttattcttcg

SEQ ID NO: 29391 - DNA, 21 bp, Artificial Sequence
  Synthetic
gagaggaatggttggagtact

SEQ ID NO: 29392 - DNA, 21 bp, Artificial Sequence
  Synthetic
gtgtggggtggttttagtgag

SEQ ID NO: 29393 - DNA, 21 bp, Artificial Sequence
  Synthetic
ctgacgcagggttattcgcag

SEQ ID NO: 29394 - DNA, 21 bp, Artificial Sequence
  Synthetic
catgagcgtgggtatagttcg

SEQ ID NO: 29395 - DNA, 21 bp, Artificial Sequence
  Synthetic
tttggtcttggttattcgacg

SEQ ID NO: 29396 - DNA, 21 bp, Artificial Sequence
  Synthetic
cttacggctgggtattcgagt

SEQ ID NO: 29397 - DNA, 21 bp, Artificial Sequence
  Synthetic
ttgcatgctggttttagtcat

SEQ ID NO: 29398 - DNA, 21 bp, Artificial Sequence
  Synthetic
gttacgtttgggtattcgact

SEQ ID NO: 29399 - DNA, 21 bp, Artificial Sequence
  Synthetic
gcggtggttggttggtcttcg

SEQ ID NO: 29400 - DNA, 21 bp, Artificial Sequence
  Synthetic
ttgattgctggttatagtcag

SEQ ID NO: 29401 - DNA, 21 bp, Artificial Sequence
  Synthetic
gagtcgcatggttttagttcg

SEQ ID NO: 29402 - DNA, 21 bp, Artificial Sequence
  Synthetic
agtcatgtggggtatagttct

SEQ ID NO: 29403 - DNA, 21 bp, Artificial Sequence
  Synthetic
gagattccgggttattctagt

SEQ ID NO: 29404 - DNA, 21 bp, Artificial Sequence
  Synthetic
tcgcatactggtttttctact

SEQ ID NO: 29405 - DNA, 21 bp, Artificial Sequence
  Synthetic
ctgcttttggggtattcgacg

SEQ ID NO: 29406 - DNA, 21 bp, Artificial Sequence
  Synthetic
ggggcttttggtttttcgtct

SEQ ID NO: 29407 - DNA, 21 bp, Artificial Sequence
  Synthetic
gtgcatcctgggtattcgatg

SEQ ID NO: 29408 - DNA, 21 bp, Artificial Sequence
  Synthetic
gggtatgttggttttagtact

SEQ ID NO: 29409 - DNA, 21 bp, Artificial Sequence
  Synthetic
cctgagccggggtggtctgct

SEQ ID NO: 29410 - DNA, 21 bp, Artificial Sequence
  Synthetic
cttcatagtgggtattctcag

SEQ ID NO: 29411 - DNA, 21 bp, Artificial Sequence
  Synthetic
gcgattcctggttggagttcg

SEQ ID NO: 29412 - DNA, 21 bp, Artificial Sequence
  Synthetic
gttggtcatggtttttcgagt

SEQ ID NO: 29413 - DNA, 21 bp, Artificial Sequence
  Synthetic
tcgaagcaggggtggagttct

SEQ ID NO: 29414 - DNA, 21 bp, Artificial Sequence
  Synthetic
ttgtctcgtgggtttagtact

SEQ ID NO: 29415 - DNA, 21 bp, Artificial Sequence
  Synthetic
gtggctcggggttttagtact

SEQ ID NO: 29416 - DNA, 21 bp, Artificial Sequence
  Synthetic
tttctgagtgggtttagtcag

SEQ ID NO: 29417 - DNA, 21 bp, Artificial Sequence
  Synthetic
gtttttgcgggttatagtacg

SEQ ID NO: 29418 - DNA, 21 bp, Artificial Sequence
  Synthetic
attatgatgggtttttcggct

SEQ ID NO: 29419 - DNA, 21 bp, Artificial Sequence
  Synthetic
gagcggggtgggtatagttcg

SEQ ID NO: 29420 - DNA, 21 bp, Artificial Sequence
  Synthetic
gtgtatcctgggtttagtgtt

SEQ ID NO: 29421 - DNA, 21 bp, Artificial Sequence
  Synthetic
gtttatgcggggtatagttct

SEQ ID NO: 29422 - DNA, 21 bp, Artificial Sequence
  Synthetic
aaggcgccgggtttttcggtt

SEQ ID NO: 29423 - DNA, 21 bp, Artificial Sequence
  Synthetic
ccggttgctgggtggagttcg

SEQ ID NO: 29424 - DNA, 21 bp, Artificial Sequence
  Synthetic
gcttatagtggttatagtctg

SEQ ID NO: 29425 - DNA, 21 bp, Artificial Sequence
  Synthetic
caggtgaggggtttttcgagt

SEQ ID NO: 29426 - DNA, 21 bp, Artificial Sequence
  Synthetic
attgcgatgggttattcgacg

SEQ ID NO: 29427 - DNA, 21 bp, Artificial Sequence
  Synthetic
cagtataaggggtattctacg

SEQ ID NO: 29428 - DNA, 21 bp, Artificial Sequence
  Synthetic
tcttttatggggtatagttcg

SEQ ID NO: 29429 - DNA, 21 bp, Artificial Sequence
  Synthetic
agttcgattgggtggagtgcg

SEQ ID NO: 29430 - DNA, 21 bp, Artificial Sequence
  Synthetic
gcggtgccgggttggtctatg

SEQ ID NO: 29431 - DNA, 21 bp, Artificial Sequence
  Synthetic
gaggcgcggggttttagtcag

SEQ ID NO: 29432 - DNA, 21 bp, Artificial Sequence
  Synthetic
gatcggcctgggtatagttct

SEQ ID NO: 29433 - DNA, 21 bp, Artificial Sequence
  Synthetic
cttgtggctgggtattcttct

SEQ ID NO: 29434 - DNA, 21 bp, Artificial Sequence
  Synthetic
tcgaatcctggtttttcttct

SEQ ID NO: 29435 - DNA, 21 bp, Artificial Sequence
  Synthetic
gagcagagggggtggagtgcg

SEQ ID NO: 29436 - DNA, 21 bp, Artificial Sequence
  Synthetic
cttgtgaagggttggtcggtg

SEQ ID NO: 29437 - DNA, 21 bp, Artificial Sequence
  Synthetic
atgatggttgggtttagttcg

SEQ ID NO: 29438 - DNA, 21 bp, Artificial Sequence
  Synthetic
catatggttggttggagtagt

SEQ ID NO: 29439 - DNA, 21 bp, Artificial Sequence
  Synthetic
tgggtgcatggttattctcag

SEQ ID NO: 29440 - DNA, 21 bp, Artificial Sequence
  Synthetic
gttgatagggggtattctgtg

SEQ ID NO: 29441 - DNA, 21 bp, Artificial Sequence
  Synthetic
ttttgggaggggtttagtgct

SEQ ID NO: 29442 - DNA, 21 bp, Artificial Sequence
  Synthetic
gagatgcttgggtttagtagt

SEQ ID NO: 29443 - DNA, 21 bp, Artificial Sequence
  Synthetic
ggttcgatgggttggtcgtct

SEQ ID NO: 29444 - DNA, 21 bp, Artificial Sequence
  Synthetic
attgtgaaggggtattcgtct

SEQ ID NO: 29445 - DNA, 21 bp, Artificial Sequence
  Synthetic
gagcgtgggggttggtcggct

SEQ ID NO: 29446 - DNA, 21 bp, Artificial Sequence
  Synthetic
gtgggttttgggtattcgatg

SEQ ID NO: 29447 - DNA, 21 bp, Artificial Sequence
  Synthetic
tttgctcatggttattcttcg

SEQ ID NO: 29448 - DNA, 21 bp, Artificial Sequence
  Synthetic
gtggcgcagggttggagtcag

SEQ ID NO: 29449 - DNA, 21 bp, Artificial Sequence
  Synthetic
ccgggtattgggtatagttcg

SEQ ID NO: 29450 - DNA, 21 bp, Artificial Sequence
  Synthetic
cagtcgtttgggtattctagt

SEQ ID NO: 29451 - DNA, 21 bp, Artificial Sequence
  Synthetic
attggtcctggttggtctatg

SEQ ID NO: 29452 - DNA, 21 bp, Artificial Sequence
  Synthetic
gtgaagattggttggtcgacg

SEQ ID NO: 29453 - DNA, 21 bp, Artificial Sequence
  Synthetic
cagcatcagggttggtcttcg

SEQ ID NO: 29454 - DNA, 21 bp, Artificial Sequence
  Synthetic
tctcatccggggtggtcggcg

SEQ ID NO: 29455 - DNA, 21 bp, Artificial Sequence
  Synthetic
ttggctatgggtttttcgact

SEQ ID NO: 29456 - DNA, 21 bp, Artificial Sequence
  Synthetic
gttaatgttgggtattctagt

SEQ ID NO: 29457 - DNA, 21 bp, Artificial Sequence
  Synthetic
actacgatgggttatagttcg

SEQ ID NO: 29458 - DNA, 21 bp, Artificial Sequence
  Synthetic
ggttatcctggtttttcgagt

SEQ ID NO: 29459 - DNA, 21 bp, Artificial Sequence
  Synthetic
cggcatccgggttatagtgtg

SEQ ID NO: 29460 - DNA, 21 bp, Artificial Sequence
  Synthetic
cttattgagggttggagtact

SEQ ID NO: 29461 - DNA, 21 bp, Artificial Sequence
  Synthetic
atgaatcttgggttttcgagt

SEQ ID NO: 29462 - DNA, 21 bp, Artificial Sequence
  Synthetic
cttgcggtggggtggagttcg

SEQ ID NO: 29463 - DNA, 21 bp, Artificial Sequence
  Synthetic
gatcggatgggttttagtcag

SEQ ID NO: 29464 - DNA, 21 bp, Artificial Sequence
  Synthetic
cataggtctggtttttctcag

SEQ ID NO: 29465 - DNA, 21 bp, Artificial Sequence
  Synthetic
ccggggcatgggtttagtgtg

SEQ ID NO: 29466 - DNA, 21 bp, Artificial Sequence
  Synthetic
aatgttgtgggttggagtagt

SEQ ID NO: 29467 - DNA, 21 bp, Artificial Sequence
  Synthetic
gtgttgaggggttatagtgct

SEQ ID NO: 29468 - DNA, 21 bp, Artificial Sequence
  Synthetic
caggttcctggttatagtgct

SEQ ID NO: 29469 - DNA, 21 bp, Artificial Sequence
  Synthetic
gtgtcgattggttggtcttcg

SEQ ID NO: 29470 - DNA, 21 bp, Artificial Sequence
  Synthetic
gcgctggtggggtatagtttt

SEQ ID NO: 29471 - DNA, 21 bp, Artificial Sequence
  Synthetic
gtgtatcatggttttagtcag

SEQ ID NO: 29472 - DNA, 21 bp, Artificial Sequence
  Synthetic
atgtatgaggggttttcgcag

SEQ ID NO: 29473 - DNA, 21 bp, Artificial Sequence
  Synthetic
attaatcaggggtggagtact

SEQ ID NO: 29474 - DNA, 21 bp, Artificial Sequence
  Synthetic
atgggtgttgggttttcgtct

SEQ ID NO: 29475 - DNA, 21 bp, Artificial Sequence
  Synthetic
tttgcgacggggtttagtagt

SEQ ID NO: 29476 - DNA, 21 bp, Artificial Sequence
  Synthetic
atgaagcctgggtggtcgacg

SEQ ID NO: 29477 - DNA, 21 bp, Artificial Sequence
  Synthetic
gcgaggcatggtttttcgagt

SEQ ID NO: 29478 - DNA, 21 bp, Artificial Sequence
  Synthetic
tttgctcagggtttttctact

SEQ ID NO: 29479 - DNA, 21 bp, Artificial Sequence
  Synthetic
gcgatggctggttggtctgct

SEQ ID NO: 29480 - DNA, 21 bp, Artificial Sequence
  Synthetic
gagaataagggttggtcttct

SEQ ID NO: 29481 - DNA, 21 bp, Artificial Sequence
  Synthetic
ctgcatcttgggttttctacg

SEQ ID NO: 29482 - DNA, 21 bp, Artificial Sequence
  Synthetic
gcgacgattggttggtcttcg

SEQ ID NO: 29483 - DNA, 21 bp, Artificial Sequence
  Synthetic
tcgtctcatggtttttcgacg

SEQ ID NO: 29484 - DNA, 21 bp, Artificial Sequence
  Synthetic
cctcatctgggttattctgct

SEQ ID NO: 29485 - DNA, 21 bp, Artificial Sequence
  Synthetic
gcgaagtttgggtattctact

SEQ ID NO: 29486 - DNA, 21 bp, Artificial Sequence
  Synthetic
aataggcctgggttttctcag

SEQ ID NO: 29487 - DNA, 21 bp, Artificial Sequence
  Synthetic
agtgcgattggttatagtact

SEQ ID NO: 29488 - DNA, 21 bp, Artificial Sequence
  Synthetic
tttgggtcggggtggtctcat

SEQ ID NO: 29489 - DNA, 21 bp, Artificial Sequence
  Synthetic
cagtttgcggggtttagtacg

SEQ ID NO: 29490 - DNA, 21 bp, Artificial Sequence
  Synthetic
aaggctttgggtttttcgatg

SEQ ID NO: 29491 - DNA, 21 bp, Artificial Sequence
  Synthetic
actattgttgggtttagtacg

SEQ ID NO: 29492 - DNA, 21 bp, Artificial Sequence
  Synthetic
attcttagtggttatagtctg

SEQ ID NO: 29493 - DNA, 21 bp, Artificial Sequence
  Synthetic
gattatcagggtttttcggtt

SEQ ID NO: 29494 - DNA, 21 bp, Artificial Sequence
  Synthetic
gagcgggttggttattcggtt

SEQ ID NO: 29495 - DNA, 21 bp, Artificial Sequence
  Synthetic
cttacgcaggggtatagtcag

SEQ ID NO: 29496 - DNA, 21 bp, Artificial Sequence
  Synthetic
ggttatgggggttggtcgatg

SEQ ID NO: 29497 - DNA, 21 bp, Artificial Sequence
  Synthetic
tcgcgtgagggttggtctacg

SEQ ID NO: 29498 - DNA, 21 bp, Artificial Sequence
  Synthetic
gttactagggggtttagtact

SEQ ID NO: 29499 - DNA, 21 bp, Artificial Sequence
  Synthetic
ttttatgatggttattcgagt

SEQ ID NO: 29500 - DNA, 21 bp, Artificial Sequence
  Synthetic
tttgttctgggttatagtagt

SEQ ID NO: 29501 - DNA, 21 bp, Artificial Sequence
  Synthetic
tggttggcgggtttttcggcg

SEQ ID NO: 29502 - DNA, 21 bp, Artificial Sequence
  Synthetic
gcgggggtggggtggtctact

SEQ ID NO: 29503 - DNA, 21 bp, Artificial Sequence
  Synthetic
tctcaggttgggtttagttct

SEQ ID NO: 29504 - DNA, 21 bp, Artificial Sequence
  Synthetic
tttcttcatggttattcggag

SEQ ID NO: 29505 - DNA, 21 bp, Artificial Sequence
  Synthetic
tttgttcctgggttttcgagt

SEQ ID NO: 29506 - DNA, 21 bp, Artificial Sequence
  Synthetic
ttgattccggggttttcgttg

SEQ ID NO: 29507 - DNA, 21 bp, Artificial Sequence
  Synthetic
atggttcatggttattcttct

SEQ ID NO: 29508 - DNA, 21 bp, Artificial Sequence
  Synthetic
gctgggagggggtttagttcg

SEQ ID NO: 29509 - DNA, 21 bp, Artificial Sequence
  Synthetic
cgtgtgccgggttttagttcg

SEQ ID NO: 29510 - DNA, 21 bp, Artificial Sequence
  Synthetic
actcatcatggttatagtgtg

SEQ ID NO: 29511 - DNA, 21 bp, Artificial Sequence
  Synthetic
acgatggttggttggagtgct

SEQ ID NO: 29512 - DNA, 21 bp, Artificial Sequence
  Synthetic
tcggctgttgggtattctagt

SEQ ID NO: 29513 - DNA, 21 bp, Artificial Sequence
  Synthetic
acgactattgggtatagttcg

SEQ ID NO: 29514 - DNA, 21 bp, Artificial Sequence
  Synthetic
gagaggcttggttattcgtct

SEQ ID NO: 29515 - DNA, 21 bp, Artificial Sequence
  Synthetic
actgatcatggttatagtagt

SEQ ID NO: 29516 - DNA, 21 bp, Artificial Sequence
  Synthetic
gagcgggcgggttattctgct

SEQ ID NO: 29517 - DNA, 21 bp, Artificial Sequence
  Synthetic
cagcatgtgggttatagttct

SEQ ID NO: 29518 - DNA, 21 bp, Artificial Sequence
  Synthetic
gagaggaatgggtggtcttcg

SEQ ID NO: 29519 - DNA, 21 bp, Artificial Sequence
  Synthetic
cgtggtctggggtatagttct

SEQ ID NO: 29520 - DNA, 21 bp, Artificial Sequence
  Synthetic
attgggactggttggagtagt

SEQ ID NO: 29521 - DNA, 21 bp, Artificial Sequence
  Synthetic
gatcgttatgggtattctgcg

SEQ ID NO: 29522 - DNA, 21 bp, Artificial Sequence
  Synthetic
ggggttcatcctggggtgtgg

SEQ ID NO: 29523 - DNA, 21 bp, Artificial Sequence
  Synthetic
tttgatcatccgggtgtttgg

SEQ ID NO: 29524 - DNA, 21 bp, Artificial Sequence
  Synthetic
ccggtgaatcctggtgtgtgg

SEQ ID NO: 29525 - DNA, 21 bp, Artificial Sequence
  Synthetic
aattctcatccgggtgtttgg

SEQ ID NO: 29526 - DNA, 21 bp, Artificial Sequence
  Synthetic
ggtggtaatccgggtgtttgg

SEQ ID NO: 29527 - DNA, 21 bp, Artificial Sequence
  Synthetic
agggggagtcctggggtgtgg

SEQ ID NO: 29528 - DNA, 21 bp, Artificial Sequence
  Synthetic
gctaggaatccgggtgtttgg

SEQ ID NO: 29529 - DNA, 21 bp, Artificial Sequence
  Synthetic
ccggggcagccgggggtttgg

SEQ ID NO: 29530 - DNA, 21 bp, Artificial Sequence
  Synthetic
gttgggaagcctggggtttgg

SEQ ID NO: 29531 - DNA, 21 bp, Artificial Sequence
  Synthetic
gcgggttctcctggggtttgg

SEQ ID NO: 29532 - DNA, 21 bp, Artificial Sequence
  Synthetic
gaggggaggccgggggtgtgg

SEQ ID NO: 29533 - DNA, 21 bp, Artificial Sequence
  Synthetic
catggtcagccgggtgtttgg

SEQ ID NO: 29534 - DNA, 21 bp, Artificial Sequence
  Synthetic
ggtgagcgtcctggtgtgtgg

SEQ ID NO: 29535 - DNA, 21 bp, Artificial Sequence
  Synthetic
atggatcatcctggtgtgtgg

SEQ ID NO: 29536 - DNA, 21 bp, Artificial Sequence
  Synthetic
gggaatgatcctggggtttgg

SEQ ID NO: 29537 - DNA, 21 bp, Artificial Sequence
  Synthetic
ggtatttcgcctggggtttgg

SEQ ID NO: 29538 - DNA, 21 bp, Artificial Sequence
  Synthetic
gatggtcggccgggtgtgtgg

SEQ ID NO: 29539 - DNA, 21 bp, Artificial Sequence
  Synthetic
aatagttatccgggtgtttgg

SEQ ID NO: 29540 - DNA, 21 bp, Artificial Sequence
  Synthetic
ggtcagcagccgggtgtgtgg

SEQ ID NO: 29541 - DNA, 21 bp, Artificial Sequence
  Synthetic
gggagtacgcctggtgtttgg

SEQ ID NO: 29542 - DNA, 21 bp, Artificial Sequence
  Synthetic
gttaagactcctggtgtttgg

SEQ ID NO: 29543 - DNA, 21 bp, Artificial Sequence
  Synthetic
ggttcgtctcctggggtgtgg

SEQ ID NO: 29544 - DNA, 21 bp, Artificial Sequence
  Synthetic
gggtctgagattgggaggtgg

SEQ ID NO: 29545 - DNA, 21 bp, Artificial Sequence
  Synthetic
ggtgtgggggaggggaggtgg

SEQ ID NO: 29546 - DNA, 21 bp, Artificial Sequence
  Synthetic
gggaatgatacggggcgttgg

SEQ ID NO: 29547 - DNA, 21 bp, Artificial Sequence
  Synthetic
ggtcctgtggaggggcggtgg

SEQ ID NO: 29548 - DNA, 21 bp, Artificial Sequence
  Synthetic
ggtgatgtgattggtaggtgg

SEQ ID NO: 29549 - DNA, 21 bp, Artificial Sequence
  Synthetic
ggttctgaggctgggaggtgg

SEQ ID NO: 29550 - DNA, 21 bp, Artificial Sequence
  Synthetic
ggggatcctgctgggcggtgg

SEQ ID NO: 29551 - DNA, 21 bp, Artificial Sequence
  Synthetic
ggggagtcgtcggggcgttgg

SEQ ID NO: 29552 - DNA, 21 bp, Artificial Sequence
  Synthetic
ggttcggatctggggcggtgg

SEQ ID NO: 29553 - DNA, 21 bp, Artificial Sequence
  Synthetic
ggtgatagtgttggtcggtgg

SEQ ID NO: 29554 - DNA, 21 bp, Artificial Sequence
  Synthetic
ggtaatgatccggggcggtgg

SEQ ID NO: 29555 - DNA, 21 bp, Artificial Sequence
  Synthetic
ggggatatgactggtcggtgg

SEQ ID NO: 29556 - DNA, 21 bp, Artificial Sequence
  Synthetic
ggggagtctgcgggtcggtgg

SEQ ID NO: 29557 - DNA, 21 bp, Artificial Sequence
  Synthetic
ggtcttgataatgggaggtgg

SEQ ID NO: 29558 - DNA, 21 bp, Artificial Sequence
  Synthetic
ggggctgatactgggcgttgg

SEQ ID NO: 29559 - DNA, 21 bp, Artificial Sequence
  Synthetic
ggggagcttacggggcgttgg

SEQ ID NO: 29560 - DNA, 21 bp, Artificial Sequence
  Synthetic
ggttatgagtctggtcggtgg

SEQ ID NO: 29561 - DNA, 21 bp, Artificial Sequence
  Synthetic
ggtacgtctcctggtcgttgg

SEQ ID NO: 29562 - DNA, 21 bp, Artificial Sequence
  Synthetic
ggtgagatggtgggtcgttgg

SEQ ID NO: 29563 - DNA, 21 bp, Artificial Sequence
  Synthetic
ggggagacgaatggtcgttgg

SEQ ID NO: 29564 - DNA, 21 bp, Artificial Sequence
  Synthetic
gggggggagacgggtaggtgg

SEQ ID NO: 29565 - DNA, 21 bp, Artificial Sequence
  Synthetic
ggggcggagttggggcggtgg

SEQ ID NO: 29566 - DNA, 21 bp, Artificial Sequence
  Synthetic
ggtagtgagcttggtcgttgg

SEQ ID NO: 29567 - DNA, 21 bp, Artificial Sequence
  Synthetic
ggggaggtgacggggcggtgg

SEQ ID NO: 29568 - DNA, 21 bp, Artificial Sequence
  Synthetic
ggtacggaggcggggcggtgg

SEQ ID NO: 29569 - DNA, 21 bp, Artificial Sequence
  Synthetic
gggtctgatagtggtaggtgg

SEQ ID NO: 29570 - DNA, 21 bp, Artificial Sequence
  Synthetic
ggtgataatgtggggcggtgg

SEQ ID NO: 29571 - DNA, 21 bp, Artificial Sequence
  Synthetic
ggggagacggtggggaggtgg

SEQ ID NO: 29572 - DNA, 21 bp, Artificial Sequence
  Synthetic
ggggatcttgctgggcgttgg

SEQ ID NO: 29573 - DNA, 21 bp, Artificial Sequence
  Synthetic
ggtggggatccggggaggtgg

SEQ ID NO: 29574 - DNA, 21 bp, Artificial Sequence
  Synthetic
ggtgttgaggtggggcgttgg

SEQ ID NO: 29575 - DNA, 21 bp, Artificial Sequence
  Synthetic
ggtgaggcggctggtaggtgg

SEQ ID NO: 29576 - DNA, 21 bp, Artificial Sequence
  Synthetic
ggggtgaatgagggtaggtgg

SEQ ID NO: 29577 - DNA, 21 bp, Artificial Sequence
  Synthetic
ggtcctgaggttggtcgttgg

SEQ ID NO: 29578 - DNA, 21 bp, Artificial Sequence
  Synthetic
ggtcaggatctggggaggtgg

SEQ ID NO: 29579 - DNA, 21 bp, Artificial Sequence
  Synthetic
ggtgatactcaggggcggtgg

SEQ ID NO: 29580 - DNA, 21 bp, Artificial Sequence
  Synthetic
ggtttggttgatgggcggtgg

SEQ ID NO: 29581 - DNA, 21 bp, Artificial Sequence
  Synthetic
ggtgagccgttgggtcgttgg

SEQ ID NO: 29582 - DNA, 21 bp, Artificial Sequence
  Synthetic
ggggggagtgagggtaggtgg

SEQ ID NO: 29583 - DNA, 21 bp, Artificial Sequence
  Synthetic
ggtactgatacggggcggtgg

SEQ ID NO: 29584 - DNA, 21 bp, Artificial Sequence
  Synthetic
ggtgaggatctggggcggtgg

SEQ ID NO: 29585 - DNA, 21 bp, Artificial Sequence
  Synthetic
gggttggcggatggtaggtgg

SEQ ID NO: 29586 - DNA, 21 bp, Artificial Sequence
  Synthetic
ggtgatcagcctgggaggtgg

SEQ ID NO: 29587 - DNA, 21 bp, Artificial Sequence
  Synthetic
ggggagtcggttggtcggtgg

SEQ ID NO: 29588 - DNA, 21 bp, Artificial Sequence
  Synthetic
ggggaggatatgggtcgttgg

SEQ ID NO: 29589 - DNA, 21 bp, Artificial Sequence
  Synthetic
ggtggggatactggtcggtgg

SEQ ID NO: 29590 - DNA, 21 bp, Artificial Sequence
  Synthetic
ggggagccgagtgggcgttgg

SEQ ID NO: 29591 - DNA, 21 bp, Artificial Sequence
  Synthetic
ggtatggtggagggtcgttgg

SEQ ID NO: 29592 - DNA, 21 bp, Artificial Sequence
  Synthetic
ggtcctgatgtggggaggtgg

SEQ ID NO: 29593 - DNA, 21 bp, Artificial Sequence
  Synthetic
ggtgatgtgagtggtaggtgg

SEQ ID NO: 29594 - DNA, 21 bp, Artificial Sequence
  Synthetic
ggtgatcttcctggtaggtgg

SEQ ID NO: 29595 - DNA, 21 bp, Artificial Sequence
  Synthetic
ggtattggggaggggcggtgg

SEQ ID NO: 29596 - DNA, 21 bp, Artificial Sequence
  Synthetic
ggtgagccgaatgggaggtgg

SEQ ID NO: 29597 - DNA, 21 bp, Artificial Sequence
  Synthetic
ggtggggatacggggcggtgg

SEQ ID NO: 29598 - DNA, 21 bp, Artificial Sequence
  Synthetic
ggtggggagccggggcggtgg

SEQ ID NO: 29599 - DNA, 21 bp, Artificial Sequence
  Synthetic
gggcctgatgctggtcgttgg

SEQ ID NO: 29600 - DNA, 21 bp, Artificial Sequence
  Synthetic
gggaatgaggttggtcggtgg

SEQ ID NO: 29601 - DNA, 21 bp, Artificial Sequence
  Synthetic
ggtttgagtgatgggaggtgg

SEQ ID NO: 29602 - DNA, 21 bp, Artificial Sequence
  Synthetic
ggtccgggtgagggtaggtgg

SEQ ID NO: 29603 - DNA, 21 bp, Artificial Sequence
  Synthetic
ggttcgtctccgggtcggtgg

SEQ ID NO: 29604 - DNA, 21 bp, Artificial Sequence
  Synthetic
ggggaggttgcgggtaggtgg

SEQ ID NO: 29605 - DNA, 21 bp, Artificial Sequence
  Synthetic
ggggagccgcatgggcggtgg

SEQ ID NO: 29606 - DNA, 21 bp, Artificial Sequence
  Synthetic
gggaaggatgttggtcgttgg

SEQ ID NO: 29607 - DNA, 21 bp, Artificial Sequence
  Synthetic
ggtgttgcggagggtaggtgg

SEQ ID NO: 29608 - DNA, 21 bp, Artificial Sequence
  Synthetic
ggggtttcggaggggcggtgg

SEQ ID NO: 29609 - DNA, 21 bp, Artificial Sequence
  Synthetic
gggggtgtggagggtaggtgg

SEQ ID NO: 29610 - DNA, 21 bp, Artificial Sequence
  Synthetic
ggtattgatctgggtaggtgg

SEQ ID NO: 29611 - DNA, 21 bp, Artificial Sequence
  Synthetic
gggtctgatgttgggcggtgg

SEQ ID NO: 29612 - DNA, 21 bp, Artificial Sequence
  Synthetic
gggttgtctgagggtcgttgg

SEQ ID NO: 29613 - DNA, 21 bp, Artificial Sequence
  Synthetic
gggcgtgcggagggtcgttgg

SEQ ID NO: 29614 - DNA, 21 bp, Artificial Sequence
  Synthetic
ggtgcggatacgggtcggtgg

SEQ ID NO: 29615 - DNA, 21 bp, Artificial Sequence
  Synthetic
ggtgagcataatggtcgttgg

SEQ ID NO: 29616 - DNA, 21 bp, Artificial Sequence
  Synthetic
ggtcttcatgatgggcgttgg

SEQ ID NO: 29617 - DNA, 21 bp, Artificial Sequence
  Synthetic
ggggttaatttgggtaggtgg

SEQ ID NO: 29618 - DNA, 21 bp, Artificial Sequence
  Synthetic
ggtgatcctccggggaggtgg

SEQ ID NO: 29619 - DNA, 21 bp, Artificial Sequence
  Synthetic
gggatggagattggtcggtgg

SEQ ID NO: 29620 - DNA, 21 bp, Artificial Sequence
  Synthetic
gatgttccgtctgggaggtgg

SEQ ID NO: 29621 - DNA, 21 bp, Artificial Sequence
  Synthetic
gatggtgcttcggggcggtgg

SEQ ID NO: 29622 - DNA, 21 bp, Artificial Sequence
  Synthetic
gaggatggttcgggtcggtgg

SEQ ID NO: 29623 - DNA, 21 bp, Artificial Sequence
  Synthetic
gaggatgggtcgggtcgttgg

SEQ ID NO: 29624 - DNA, 21 bp, Artificial Sequence
  Synthetic
gagccgggttctgggaggtgg

SEQ ID NO: 29625 - DNA, 21 bp, Artificial Sequence
  Synthetic
gagggggggagtgggcggtgg

SEQ ID NO: 29626 - DNA, 21 bp, Artificial Sequence
  Synthetic
gataatactagtggtcggtgg

SEQ ID NO: 29627 - DNA, 21 bp, Artificial Sequence
  Synthetic
gatcttgattctggtcgttgg

SEQ ID NO: 29628 - DNA, 21 bp, Artificial Sequence
  Synthetic
gatgctaatagtggtaggtgg

SEQ ID NO: 29629 - DNA, 21 bp, Artificial Sequence
  Synthetic
gatatgttgagtggtaggtgg

SEQ ID NO: 29630 - DNA, 21 bp, Artificial Sequence
  Synthetic
tctccgcatgatgcgaggtgg

SEQ ID NO: 29631 - DNA, 21 bp, Artificial Sequence
  Synthetic
tcgtatggggatgggaggtgg

SEQ ID NO: 29632 - DNA, 21 bp, Artificial Sequence
  Synthetic
tcggagggttcttctaggtgg

SEQ ID NO: 29633 - DNA, 21 bp, Artificial Sequence
  Synthetic
agtgggagtgatggtcgttgg

SEQ ID NO: 29634 - DNA, 21 bp, Artificial Sequence
  Synthetic
tcgcctgattctggtcgttgg

SEQ ID NO: 29635 - DNA, 21 bp, Artificial Sequence
  Synthetic
tcgctggtggggaataggtgg

SEQ ID NO: 29636 - DNA, 21 bp, Artificial Sequence
  Synthetic
tcgcctaattcggtgaggtgg

SEQ ID NO: 29637 - DNA, 21 bp, Artificial Sequence
  Synthetic
tctccgacggaggctcggtgg

SEQ ID NO: 29638 - DNA, 21 bp, Artificial Sequence
  Synthetic
agtacgtatgatggtcgttgg

SEQ ID NO: 29639 - DNA, 21 bp, Artificial Sequence
  Synthetic
agtgagaatcctgggcgttgg

SEQ ID NO: 29640 - DNA, 21 bp, Artificial Sequence
  Synthetic
agtgattcgccgggtaggtgg

SEQ ID NO: 29641 - DNA, 21 bp, Artificial Sequence
  Synthetic
agtgcgggtgataatcgttgg

SEQ ID NO: 29642 - DNA, 21 bp, Artificial Sequence
  Synthetic
tcgggtgatagtgggcggtgg

SEQ ID NO: 29643 - DNA, 21 bp, Artificial Sequence
  Synthetic
agtggtgttgagggtaggtgg

SEQ ID NO: 29644 - DNA, 21 bp, Artificial Sequence
  Synthetic
tcgtatgattcgggtcggtgg

SEQ ID NO: 29645 - DNA, 21 bp, Artificial Sequence
  Synthetic
tctggtgatgtgggtaggtgg

SEQ ID NO: 29646 - DNA, 21 bp, Artificial Sequence
  Synthetic
agtctggattctggtcgttgg

SEQ ID NO: 29647 - DNA, 21 bp, Artificial Sequence
  Synthetic
tcttctgattataatcggtgg

SEQ ID NO: 29648 - DNA, 21 bp, Artificial Sequence
  Synthetic
tctcctcatgagtctcgttgg

SEQ ID NO: 29649 - DNA, 21 bp, Artificial Sequence
  Synthetic
tctgagtctattggtaggtgg

SEQ ID NO: 29650 - DNA, 21 bp, Artificial Sequence
  Synthetic
agtgggagtcctgggcggtgg

SEQ ID NO: 29651 - DNA, 21 bp, Artificial Sequence
  Synthetic
tctactaatgatgggaggtgg

SEQ ID NO: 29652 - DNA, 21 bp, Artificial Sequence
  Synthetic
ctgaattatggtgggtctatg

SEQ ID NO: 29653 - DNA, 21 bp, Artificial Sequence
  Synthetic
gcggtttatatggggtctgtt

SEQ ID NO: 29654 - DNA, 21 bp, Artificial Sequence
  Synthetic
atgatttatcagggttcttct

SEQ ID NO: 29655 - DNA, 21 bp, Artificial Sequence
  Synthetic
gtgtcgtatcatggtagtagt

SEQ ID NO: 29656 - DNA, 21 bp, Artificial Sequence
  Synthetic
gagaagtatggtggttcgacg

SEQ ID NO: 29657 - DNA, 21 bp, Artificial Sequence
  Synthetic
catatttatgctggtagttct

SEQ ID NO: 29658 - DNA, 21 bp, Artificial Sequence
  Synthetic
tcgatgtatcatgggagttcg

SEQ ID NO: 29659 - DNA, 21 bp, Artificial Sequence
  Synthetic
atgatgtatcaggggtctgcg

SEQ ID NO: 29660 - DNA, 21 bp, Artificial Sequence
  Synthetic
gctttttataatggttcggct

SEQ ID NO: 29661 - DNA, 21 bp, Artificial Sequence
  Synthetic
cgttattatgaggggagtagt

SEQ ID NO: 29662 - DNA, 21 bp, Artificial Sequence
  Synthetic
gataagtatatgggtagtgtg

SEQ ID NO: 29663 - DNA, 21 bp, Artificial Sequence
  Synthetic
gtggtttatgcgggtagttcg

SEQ ID NO: 29664 - DNA, 21 bp, Artificial Sequence
  Synthetic
cagaattataatgggagtatt

SEQ ID NO: 29665 - DNA, 21 bp, Artificial Sequence
  Synthetic
gagcagtatcggggttcgacg

SEQ ID NO: 29666 - DNA, 21 bp, Artificial Sequence
  Synthetic
gataattatcaggggtcggcg

SEQ ID NO: 29667 - DNA, 21 bp, Artificial Sequence
  Synthetic
tgggcgtatcagggttctgct

SEQ ID NO: 29668 - DNA, 21 bp, Artificial Sequence
  Synthetic
acgcattatagtggtagtacg

SEQ ID NO: 29669 - DNA, 21 bp, Artificial Sequence
  Synthetic
gagttttatggtggttcggtt

SEQ ID NO: 29670 - DNA, 21 bp, Artificial Sequence
  Synthetic
ttgctttatgggggtagtact

SEQ ID NO: 29671 - DNA, 21 bp, Artificial Sequence
  Synthetic
ctgcattattcgggtagtagt

SEQ ID NO: 29672 - DNA, 21 bp, Artificial Sequence
  Synthetic
cttagttatatgggttcgcat

SEQ ID NO: 29673 - DNA, 21 bp, Artificial Sequence
  Synthetic
aagctttataatgggagtatt

SEQ ID NO: 29674 - DNA, 21 bp, Artificial Sequence
  Synthetic
gatcgttatattggtagttcg

SEQ ID NO: 29675 - DNA, 21 bp, Artificial Sequence
  Synthetic
actgtttatcttgggtctgtg

SEQ ID NO: 29676 - DNA, 21 bp, Artificial Sequence
  Synthetic
atgagttatcatgggtcgagt

SEQ ID NO: 29677 - DNA, 21 bp, Artificial Sequence
  Synthetic
ttgttttatggtggttcgagt

SEQ ID NO: 29678 - DNA, 21 bp, Artificial Sequence
  Synthetic
agggtttattctgggagtgcg

SEQ ID NO: 29679 - DNA, 21 bp, Artificial Sequence
  Synthetic
ctgaagtatgctgggagtacg

SEQ ID NO: 29680 - DNA, 21 bp, Artificial Sequence
  Synthetic
gcgcagtatatgggtagttct

SEQ ID NO: 29681 - DNA, 21 bp, Artificial Sequence
  Synthetic
atggtgtatagtgggtcgtcg

SEQ ID NO: 29682 - DNA, 21 bp, Artificial Sequence
  Synthetic
atgtcttatcttggttcgtct

SEQ ID NO: 29683 - DNA, 21 bp, Artificial Sequence
  Synthetic
catcggtatgaggggtcgagt

SEQ ID NO: 29684 - DNA, 21 bp, Artificial Sequence
  Synthetic
atgaagtatgggggttcgact

SEQ ID NO: 29685 - DNA, 21 bp, Artificial Sequence
  Synthetic
gaggcgtatatgggttctgtg

SEQ ID NO: 29686 - DNA, 21 bp, Artificial Sequence
  Synthetic
gagttttatggtggttcgcgg

SEQ ID NO: 29687 - DNA, 21 bp, Artificial Sequence
  Synthetic
gttgtgtataatggtagtacg

SEQ ID NO: 29688 - DNA, 21 bp, Artificial Sequence
  Synthetic
agtgtgtatatggggagttct

SEQ ID NO: 29689 - DNA, 21 bp, Artificial Sequence
  Synthetic
agtatttatttggggtctagt

SEQ ID NO: 29690 - DNA, 21 bp, Artificial Sequence
  Synthetic
cttgattatagggggtctact

SEQ ID NO: 29691 - DNA, 21 bp, Artificial Sequence
  Synthetic
cgtgtttatggggggtctcag

SEQ ID NO: 29692 - DNA, 21 bp, Artificial Sequence
  Synthetic
ggtgtttatatggggagttct

SEQ ID NO: 29693 - DNA, 21 bp, Artificial Sequence
  Synthetic
agttcttatatggggtcgact

SEQ ID NO: 29694 - DNA, 21 bp, Artificial Sequence
  Synthetic
atgatttatagtgggtcgcat

SEQ ID NO: 29695 - DNA, 21 bp, Artificial Sequence
  Synthetic
gagaggtatcagggttctcat

SEQ ID NO: 29696 - DNA, 21 bp, Artificial Sequence
  Synthetic
ctggcgtatcttgggtctcag

SEQ ID NO: 29697 - DNA, 21 bp, Artificial Sequence
  Synthetic
actcagtataatggttctatt

SEQ ID NO: 29698 - DNA, 21 bp, Artificial Sequence
  Synthetic
agtacgtatctgggtagtacg

SEQ ID NO: 29699 - DNA, 21 bp, Artificial Sequence
  Synthetic
ttgttgtatggtggttctacg

SEQ ID NO: 29700 - DNA, 21 bp, Artificial Sequence
  Synthetic
gtgatgtatgggggttcttcg

SEQ ID NO: 29701 - DNA, 21 bp, Artificial Sequence
  Synthetic
catgcgtatcatggttctact

SEQ ID NO: 29702 - DNA, 21 bp, Artificial Sequence
  Synthetic
atgtattataatggtagtcat

SEQ ID NO: 29703 - DNA, 21 bp, Artificial Sequence
  Synthetic
ccgttttatagtggttctgcg

SEQ ID NO: 29704 - DNA, 21 bp, Artificial Sequence
  Synthetic
gagcggtatgcggggtcttcg

SEQ ID NO: 29705 - DNA, 21 bp, Artificial Sequence
  Synthetic
catgagtatcggggttctgcg

SEQ ID NO: 29706 - DNA, 21 bp, Artificial Sequence
  Synthetic
catatttatagtgggtcgatg

SEQ ID NO: 29707 - DNA, 21 bp, Artificial Sequence
  Synthetic
acgatgtatggtgggtctacg

SEQ ID NO: 29708 - DNA, 21 bp, Artificial Sequence
  Synthetic
gtttattattcgggttcgagt

SEQ ID NO: 29709 - DNA, 21 bp, Artificial Sequence
  Synthetic
gagcagtataagggtagtacg

SEQ ID NO: 29710 - DNA, 21 bp, Artificial Sequence
  Synthetic
tcttattatggtggttctgcg

SEQ ID NO: 29711 - DNA, 21 bp, Artificial Sequence
  Synthetic
cagaagtataatgggagtacg

SEQ ID NO: 29712 - DNA, 21 bp, Artificial Sequence
  Synthetic
tataagtatgagggtagtacg

SEQ ID NO: 29713 - DNA, 21 bp, Artificial Sequence
  Synthetic
actgtgtatggtgggagtacg

SEQ ID NO: 29714 - DNA, 21 bp, Artificial Sequence
  Synthetic
tcgctgtatttggggtctacg

SEQ ID NO: 29715 - DNA, 21 bp, Artificial Sequence
  Synthetic
gtgtattatactggtagttcg

SEQ ID NO: 29716 - DNA, 21 bp, Artificial Sequence
  Synthetic
gagtattatacgggtagtact

SEQ ID NO: 29717 - DNA, 21 bp, Artificial Sequence
  Synthetic
gcgaattatatgggttcgatg

SEQ ID NO: 29718 - DNA, 21 bp, Artificial Sequence
  Synthetic
tttatttattcggggagtagt

SEQ ID NO: 29719 - DNA, 21 bp, Artificial Sequence
  Synthetic
actctttatatggggagtagt

SEQ ID NO: 29720 - DNA, 21 bp, Artificial Sequence
  Synthetic
ttttattatggtgggtcgagt

SEQ ID NO: 29721 - DNA, 21 bp, Artificial Sequence
  Synthetic
gtgctgtataatggtagtatg

SEQ ID NO: 29722 - DNA, 21 bp, Artificial Sequence
  Synthetic
ctgaggtatgcgggttcgact

SEQ ID NO: 29723 - DNA, 21 bp, Artificial Sequence
  Synthetic
cttatgtattctgggtctcag

SEQ ID NO: 29724 - DNA, 21 bp, Artificial Sequence
  Synthetic
tctgtttatcatgggagttct

SEQ ID NO: 29725 - DNA, 21 bp, Artificial Sequence
  Synthetic
agtgtgtatctggggtcggtt

SEQ ID NO: 29726 - DNA, 21 bp, Artificial Sequence
  Synthetic
gagaggtatcatgggtctcag

SEQ ID NO: 29727 - DNA, 21 bp, Artificial Sequence
  Synthetic
gttctgtatctggggagtgcg

SEQ ID NO: 29728 - DNA, 21 bp, Artificial Sequence
  Synthetic
cagcattatcttggtagttct

SEQ ID NO: 29729 - DNA, 21 bp, Artificial Sequence
  Synthetic
tgggcttatggtggtagttcg

SEQ ID NO: 29730 - DNA, 21 bp, Artificial Sequence
  Synthetic
gcgatttatcatggttctact

SEQ ID NO: 29731 - DNA, 21 bp, Artificial Sequence
  Synthetic
tgggtgtatgaggggtcggcg

SEQ ID NO: 29732 - DNA, 21 bp, Artificial Sequence
  Synthetic
ttgcagtataggggttctagt

SEQ ID NO: 29733 - DNA, 21 bp, Artificial Sequence
  Synthetic
gcgctttataggggttcttct

SEQ ID NO: 29734 - DNA, 21 bp, Artificial Sequence
  Synthetic
gagttgtattatgggtctgct

SEQ ID NO: 29735 - DNA, 21 bp, Artificial Sequence
  Synthetic
cttaattatagtgggtcgacg

SEQ ID NO: 29736 - DNA, 21 bp, Artificial Sequence
  Synthetic
atggcttatttggggtctcag

SEQ ID NO: 29737 - DNA, 21 bp, Artificial Sequence
  Synthetic
agtgtgtatagggggtcgact

SEQ ID NO: 29738 - DNA, 21 bp, Artificial Sequence
  Synthetic
cagagttatcaggggagtact

SEQ ID NO: 29739 - DNA, 21 bp, Artificial Sequence
  Synthetic
attgtttataaggggtctgcg

SEQ ID NO: 29740 - DNA, 21 bp, Artificial Sequence
  Synthetic
agtatttatcatggttcttcg

SEQ ID NO: 29741 - DNA, 21 bp, Artificial Sequence
  Synthetic
tatgtttatcatggttcgtcg

SEQ ID NO: 29742 - DNA, 21 bp, Artificial Sequence
  Synthetic
actcattatgagggttcgacg

SEQ ID NO: 29743 - DNA, 21 bp, Artificial Sequence
  Synthetic
atgatgtatcatgggagtact

SEQ ID NO: 29744 - DNA, 21 bp, Artificial Sequence
  Synthetic
ctgaagtataatggtagtctg

SEQ ID NO: 29745 - DNA, 21 bp, Artificial Sequence
  Synthetic
cagatgtatatgggttctctt

SEQ ID NO: 29746 - DNA, 21 bp, Artificial Sequence
  Synthetic
ctggtttatgggggttctgtg

SEQ ID NO: 29747 - DNA, 21 bp, Artificial Sequence
  Synthetic
aatcagtatctgggttctagt

SEQ ID NO: 29748 - DNA, 21 bp, Artificial Sequence
  Synthetic
gggatttatgctgggtcgtgg

SEQ ID NO: 29749 - DNA, 21 bp, Artificial Sequence
  Synthetic
gagcgttattctgggtctcag

SEQ ID NO: 29750 - DNA, 21 bp, Artificial Sequence
  Synthetic
gctgagtatacgggttcttgg

SEQ ID NO: 29751 - DNA, 21 bp, Artificial Sequence
  Synthetic
gagatgtatcgggggtctacg

SEQ ID NO: 29752 - DNA, 21 bp, Artificial Sequence
  Synthetic
tttgagtatggtggttcgcag

SEQ ID NO: 29753 - DNA, 21 bp, Artificial Sequence
  Synthetic
catgagtatcttggttcttct

SEQ ID NO: 29754 - DNA, 21 bp, Artificial Sequence
  Synthetic
aagatttatagtgggagtagt

SEQ ID NO: 29755 - DNA, 21 bp, Artificial Sequence
  Synthetic
tatatgtattctggttcgatg

SEQ ID NO: 29756 - DNA, 21 bp, Artificial Sequence
  Synthetic
caggcttatcatggttctacg

SEQ ID NO: 29757 - DNA, 21 bp, Artificial Sequence
  Synthetic
cttatgtatcttgggtcgcag

SEQ ID NO: 29758 - DNA, 21 bp, Artificial Sequence
  Synthetic
tgggcttatgagggtagtgcg

SEQ ID NO: 29759 - DNA, 21 bp, Artificial Sequence
  Synthetic
cttaggtatgggggtagtgtg

SEQ ID NO: 29760 - DNA, 21 bp, Artificial Sequence
  Synthetic
tggaattatggtggttctgcg

SEQ ID NO: 29761 - DNA, 21 bp, Artificial Sequence
  Synthetic
tggacttatgggggttctgct

SEQ ID NO: 29762 - DNA, 21 bp, Artificial Sequence
  Synthetic
ttggtttatatgggttctacg

SEQ ID NO: 29763 - DNA, 21 bp, Artificial Sequence
  Synthetic
atggcttatcatggttcgact

SEQ ID NO: 29764 - DNA, 21 bp, Artificial Sequence
  Synthetic
agtgcttatcatggtagtact

SEQ ID NO: 29765 - DNA, 21 bp, Artificial Sequence
  Synthetic
gcgttttatggtgggtctgcg

SEQ ID NO: 29766 - DNA, 21 bp, Artificial Sequence
  Synthetic
tgtgtgtatctggggtcggct

SEQ ID NO: 29767 - DNA, 21 bp, Artificial Sequence
  Synthetic
tctgcgtatttggggtctgct

SEQ ID NO: 29768 - DNA, 21 bp, Artificial Sequence
  Synthetic
ttgtcttatcaggggagtcag

SEQ ID NO: 29769 - DNA, 21 bp, Artificial Sequence
  Synthetic
gatcattatctgggtagtacg

SEQ ID NO: 29770 - DNA, 21 bp, Artificial Sequence
  Synthetic
gagggttatcggggttcttcg

SEQ ID NO: 29771 - DNA, 21 bp, Artificial Sequence
  Synthetic
gttgtgtatggggggtcgcag

SEQ ID NO: 29772 - DNA, 21 bp, Artificial Sequence
  Synthetic
atgtcgtatcatgggagtact

SEQ ID NO: 29773 - DNA, 21 bp, Artificial Sequence
  Synthetic
gagaggtataatgggagtatg

SEQ ID NO: 29774 - DNA, 21 bp, Artificial Sequence
  Synthetic
agtttttatgggggttctcat

SEQ ID NO: 29775 - DNA, 21 bp, Artificial Sequence
  Synthetic
gagtattatcgtgggtcggtt

SEQ ID NO: 29776 - DNA, 21 bp, Artificial Sequence
  Synthetic
gcggagtatcggggtagtagt

SEQ ID NO: 29777 - DNA, 21 bp, Artificial Sequence
  Synthetic
gaggagtatatgggttcgtct

SEQ ID NO: 29778 - DNA, 21 bp, Artificial Sequence
  Synthetic
ttggcgtatatgggtagtgtg

SEQ ID NO: 29779 - DNA, 21 bp, Artificial Sequence
  Synthetic
acttattatcatggttctgcg

SEQ ID NO: 29780 - DNA, 21 bp, Artificial Sequence
  Synthetic
tctgtgtatcgtggtagtgtt

SEQ ID NO: 29781 - DNA, 21 bp, Artificial Sequence
  Synthetic
gatcattatctgggtagtcat

SEQ ID NO: 29782 - DNA, 21 bp, Artificial Sequence
  Synthetic
gttgtttatgggggttctact

SEQ ID NO: 29783 - DNA, 21 bp, Artificial Sequence
  Synthetic
tctttgtatatggggagtagt

SEQ ID NO: 29784 - DNA, 21 bp, Artificial Sequence
  Synthetic
gaggtgtatcaggggtcgtcg

SEQ ID NO: 29785 - DNA, 21 bp, Artificial Sequence
  Synthetic
tggaattatgtggggtcgtct

SEQ ID NO: 29786 - DNA, 21 bp, Artificial Sequence
  Synthetic
tggatgtatgagggtagtagt

SEQ ID NO: 29787 - DNA, 21 bp, Artificial Sequence
  Synthetic
attaagtatgctgggtcttcg

SEQ ID NO: 29788 - DNA, 21 bp, Artificial Sequence
  Synthetic
cttatttataatgggagttcg

SEQ ID NO: 29789 - DNA, 21 bp, Artificial Sequence
  Synthetic
aatcattatcatgggagtagt

SEQ ID NO: 29790 - DNA, 21 bp, Artificial Sequence
  Synthetic
tggatttatggtggtagtgct

SEQ ID NO: 29791 - DNA, 21 bp, Artificial Sequence
  Synthetic
gagtattataagggtagtgcg

SEQ ID NO: 29792 - DNA, 21 bp, Artificial Sequence
  Synthetic
gcttattattcgggttcgacg

SEQ ID NO: 29793 - DNA, 21 bp, Artificial Sequence
  Synthetic
cttgtgtatgctgggagtgcg

SEQ ID NO: 29794 - DNA, 21 bp, Artificial Sequence
  Synthetic
gagtattataatgggtctgcg

SEQ ID NO: 29795 - DNA, 21 bp, Artificial Sequence
  Synthetic
ttgttttatggtggttcgctt

SEQ ID NO: 29796 - DNA, 21 bp, Artificial Sequence
  Synthetic
ttgcgttatgagggttcgatg

SEQ ID NO: 29797 - DNA, 21 bp, Artificial Sequence
  Synthetic
attgtgtatgggggttcttct

SEQ ID NO: 29798 - DNA, 21 bp, Artificial Sequence
  Synthetic
gctcagtatatgggttcgtcg

SEQ ID NO: 29799 - DNA, 21 bp, Artificial Sequence
  Synthetic
tcttcttattttgggtcggcg

SEQ ID NO: 29800 - DNA, 21 bp, Artificial Sequence
  Synthetic
tctgtttatttgggttctact

SEQ ID NO: 29801 - DNA, 21 bp, Artificial Sequence
  Synthetic
gctaggtatatgggtagtgtg

SEQ ID NO: 29802 - DNA, 21 bp, Artificial Sequence
  Synthetic
tcgtattatactgggtcgtct

SEQ ID NO: 29803 - DNA, 21 bp, Artificial Sequence
  Synthetic
gagaagtatcaggggagtact

SEQ ID NO: 29804 - DNA, 21 bp, Artificial Sequence
  Synthetic
cttaattatgggggtagtcag

SEQ ID NO: 29805 - DNA, 21 bp, Artificial Sequence
  Synthetic
attaggtatgaggggagtacg

SEQ ID NO: 29806 - DNA, 21 bp, Artificial Sequence
  Synthetic
tggggttatgttgggagtggt

SEQ ID NO: 29807 - DNA, 21 bp, Artificial Sequence
  Synthetic
atgatttatggtgggtcgctg

SEQ ID NO: 29808 - DNA, 21 bp, Artificial Sequence
  Synthetic
tctgagtatcatgggagttct

SEQ ID NO: 29809 - DNA, 21 bp, Artificial Sequence
  Synthetic
acgtattatggtggtagtcat

SEQ ID NO: 29810 - DNA, 21 bp, Artificial Sequence
  Synthetic
aattcttatcttgggagtact

SEQ ID NO: 29811 - DNA, 21 bp, Artificial Sequence
  Synthetic
gcgttttattcgggttctcat

SEQ ID NO: 29812 - DNA, 21 bp, Artificial Sequence
  Synthetic
acgatgtatcgtgggtctatt

SEQ ID NO: 29813 - DNA, 21 bp, Artificial Sequence
  Synthetic
gtgcattatcaggggtctagt

SEQ ID NO: 29814 - DNA, 21 bp, Artificial Sequence
  Synthetic
ttggtttataagggttcgcag

SEQ ID NO: 29815 - DNA, 21 bp, Artificial Sequence
  Synthetic
gatgtgtatcggggttcgagt

SEQ ID NO: 29816 - DNA, 21 bp, Artificial Sequence
  Synthetic
gtggagtatcatggtagtgcg

SEQ ID NO: 29817 - DNA, 21 bp, Artificial Sequence
  Synthetic
ggtgtttatatggggtcgagt

SEQ ID NO: 29818 - DNA, 21 bp, Artificial Sequence
  Synthetic
tcgaagtatcttgggagtcag

SEQ ID NO: 29819 - protein, 7 aa, Artificial Sequence
  Synthetic
RVSAGST

SEQ ID NO: 29820 - protein, 7 aa, Artificial Sequence
  Synthetic
RVSAGST

SEQ ID NO: 29821 - protein, 7 aa, Artificial Sequence
  Synthetic
RVSAAST

SEQ ID NO: 29822 - protein, 7 aa, Artificial Sequence
  Synthetic
RISAGST

SEQ ID NO: 29823 - protein, 7 aa, Artificial Sequence
  Synthetic
RISAGST

SEQ ID NO: 29824 - protein, 7 aa, Artificial Sequence
  Synthetic
DHGCAEC

SEQ ID NO: 29825 - protein, 7 aa, Artificial Sequence
  Synthetic
RISAAST

SEQ ID NO: 29826 - protein, 7 aa, Artificial Sequence
  Synthetic
RISAAST

SEQ ID NO: 29827 - protein, 7 aa, Artificial Sequence
  Synthetic
RVSAAST

SEQ ID NO: 29828 - protein, 7 aa, Artificial Sequence
  Synthetic
RISSAST

SEQ ID NO: 29829 - protein, 7 aa, Artificial Sequence
  Synthetic
RIGAGST

SEQ ID NO: 29830 - protein, 7 aa, Artificial Sequence
  Synthetic
RVSSAST

SEQ ID NO: 29831 - protein, 7 aa, Artificial Sequence
  Synthetic
RISAAYT

SEQ ID NO: 29832 - protein, 7 aa, Artificial Sequence
  Synthetic
RISSAST

SEQ ID NO: 29833 - protein, 7 aa, Artificial Sequence
  Synthetic
RISANST

SEQ ID NO: 29834 - protein, 7 aa, Artificial Sequence
  Synthetic
RTGAGST

SEQ ID NO: 29835 - protein, 7 aa, Artificial Sequence
  Synthetic
RMSAGST

SEQ ID NO: 29836 - protein, 7 aa, Artificial Sequence
  Synthetic
RVSANST

SEQ ID NO: 29837 - protein, 7 aa, Artificial Sequence
  Synthetic
RTGAGST

SEQ ID NO: 29838 - protein, 7 aa, Artificial Sequence
  Synthetic
RISSNST

SEQ ID NO: 29839 - protein, 7 aa, Artificial Sequence
  Synthetic
RISANST

SEQ ID NO: 29840 - protein, 7 aa, Artificial Sequence
  Synthetic
RMSAGST

SEQ ID NO: 29841 - protein, 7 aa, Artificial Sequence
  Synthetic
RISANYT

SEQ ID NO: 29842 - protein, 7 aa, Artificial Sequence
  Synthetic
RMSAATT

SEQ ID NO: 29843 - protein, 7 aa, Artificial Sequence
  Synthetic
RISAGAT

SEQ ID NO: 29844 - protein, 7 aa, Artificial Sequence
  Synthetic
RISSNST

SEQ ID NO: 29845 - protein, 7 aa, Artificial Sequence
  Synthetic
RVSAAYT

SEQ ID NO: 29846 - protein, 7 aa, Artificial Sequence
  Synthetic
RISAGAT

SEQ ID NO: 29847 - protein, 7 aa, Artificial Sequence
  Synthetic
RTSAAST

SEQ ID NO: 29848 - protein, 7 aa, Artificial Sequence
  Synthetic
RISAGNT

SEQ ID NO: 29849 - protein, 7 aa, Artificial Sequence
  Synthetic
RISAATT

SEQ ID NO: 29850 - protein, 7 aa, Artificial Sequence
  Synthetic
RTSAGST

SEQ ID NO: 29851 - protein, 7 aa, Artificial Sequence
  Synthetic
RISAAYT

SEQ ID NO: 29852 - protein, 7 aa, Artificial Sequence
  Synthetic
RIGAGST

SEQ ID NO: 29853 - protein, 7 aa, Artificial Sequence
  Synthetic
RVSANST

SEQ ID NO: 29854 - protein, 7 aa, Artificial Sequence
  Synthetic
RVSAAYT

SEQ ID NO: 29855 - protein, 7 aa, Artificial Sequence
  Synthetic
RISAAAT

SEQ ID NO: 29856 - protein, 7 aa, Artificial Sequence
  Synthetic
RISAAGT

SEQ ID NO: 29857 - protein, 7 aa, Artificial Sequence
  Synthetic
RISSGST

SEQ ID NO: 29858 - protein, 7 aa, Artificial Sequence
  Synthetic
RMGAGST

SEQ ID NO: 29859 - protein, 7 aa, Artificial Sequence
  Synthetic
RVSAGYT

SEQ ID NO: 29860 - protein, 7 aa, Artificial Sequence
  Synthetic
RVSSAST

SEQ ID NO: 29861 - protein, 7 aa, Artificial Sequence
  Synthetic
RISAANT

SEQ ID NO: 29862 - protein, 7 aa, Artificial Sequence
  Synthetic
RISAANT

SEQ ID NO: 29863 - protein, 7 aa, Artificial Sequence
  Synthetic
RVSAQYT

SEQ ID NO: 29864 - protein, 7 aa, Artificial Sequence
  Synthetic
RISSAYT

SEQ ID NO: 29865 - protein, 7 aa, Artificial Sequence
  Synthetic
RISAAAT

SEQ ID NO: 29866 - protein, 7 aa, Artificial Sequence
  Synthetic
RISAGNT

SEQ ID NO: 29867 - protein, 7 aa, Artificial Sequence
  Synthetic
RFSAATT

SEQ ID NO: 29868 - protein, 7 aa, Artificial Sequence
  Synthetic
RVSSNST

SEQ ID NO: 29869 - protein, 7 aa, Artificial Sequence
  Synthetic
RISANYT

SEQ ID NO: 29870 - protein, 7 aa, Artificial Sequence
  Synthetic
RISSGST

SEQ ID NO: 29871 - protein, 7 aa, Artificial Sequence
  Synthetic
RVSAGAT

SEQ ID NO: 29872 - protein, 7 aa, Artificial Sequence
  Synthetic
RISAGYT

SEQ ID NO: 29873 - protein, 7 aa, Artificial Sequence
  Synthetic
RVSAGAT

SEQ ID NO: 29874 - protein, 7 aa, Artificial Sequence
  Synthetic
RLSSATT

SEQ ID NO: 29875 - protein, 7 aa, Artificial Sequence
  Synthetic
RISAQYT

SEQ ID NO: 29876 - protein, 7 aa, Artificial Sequence
  Synthetic
RMSAATT

SEQ ID NO: 29877 - protein, 7 aa, Artificial Sequence
  Synthetic
RISAGGT

SEQ ID NO: 29878 - protein, 7 aa, Artificial Sequence
  Synthetic
RMSAAST

SEQ ID NO: 29879 - protein, 7 aa, Artificial Sequence
  Synthetic
RFSAAST

SEQ ID NO: 29880 - protein, 7 aa, Artificial Sequence
  Synthetic
RLSSATT

SEQ ID NO: 29881 - protein, 7 aa, Artificial Sequence
  Synthetic
RVSAATT

SEQ ID NO: 29882 - protein, 7 aa, Artificial Sequence
  Synthetic
RVGAGST

SEQ ID NO: 29883 - protein, 7 aa, Artificial Sequence
  Synthetic
RISAGTT

SEQ ID NO: 29884 - protein, 7 aa, Artificial Sequence
  Synthetic
RISAQYT

SEQ ID NO: 29885 - protein, 7 aa, Artificial Sequence
  Synthetic
RISAATT

SEQ ID NO: 29886 - protein, 7 aa, Artificial Sequence
  Synthetic
RMGAGST

SEQ ID NO: 29887 - protein, 7 aa, Artificial Sequence
  Synthetic
RVSAGNT

SEQ ID NO: 29888 - protein, 7 aa, Artificial Sequence
  Synthetic
RFSAGST

SEQ ID NO: 29889 - protein, 7 aa, Artificial Sequence
  Synthetic
RTSANST

SEQ ID NO: 29890 - protein, 7 aa, Artificial Sequence
  Synthetic
RFGAGST

SEQ ID NO: 29891 - protein, 7 aa, Artificial Sequence
  Synthetic
RFSAGST

SEQ ID NO: 29892 - protein, 7 aa, Artificial Sequence
  Synthetic
RISSATT

SEQ ID NO: 29893 - protein, 7 aa, Artificial Sequence
  Synthetic
RFSAGTT

SEQ ID NO: 29894 - protein, 7 aa, Artificial Sequence
  Synthetic
RMSAAST

SEQ ID NO: 29895 - protein, 7 aa, Artificial Sequence
  Synthetic
RFSSATT

SEQ ID NO: 29896 - protein, 7 aa, Artificial Sequence
  Synthetic
RISAGTT

SEQ ID NO: 29897 - protein, 7 aa, Artificial Sequence
  Synthetic
RMSAGTT

SEQ ID NO: 29898 - protein, 7 aa, Artificial Sequence
  Synthetic
RVSSNST

SEQ ID NO: 29899 - protein, 7 aa, Artificial Sequence
  Synthetic
RVSAGTT

SEQ ID NO: 29900 - protein, 7 aa, Artificial Sequence
  Synthetic
RISSATT

SEQ ID NO: 29901 - protein, 7 aa, Artificial Sequence
  Synthetic
RTSAATT

SEQ ID NO: 29902 - protein, 7 aa, Artificial Sequence
  Synthetic
RMSANST

SEQ ID NO: 29903 - protein, 7 aa, Artificial Sequence
  Synthetic
RTSSAST

SEQ ID NO: 29904 - protein, 7 aa, Artificial Sequence
  Synthetic
RTGSAST

SEQ ID NO: 29905 - protein, 7 aa, Artificial Sequence
  Synthetic
RFGAGST

SEQ ID NO: 29906 - protein, 7 aa, Artificial Sequence
  Synthetic
RTSAGST

SEQ ID NO: 29907 - protein, 7 aa, Artificial Sequence
  Synthetic
RVSAANT

SEQ ID NO: 29908 - protein, 7 aa, Artificial Sequence
  Synthetic
RMSAGTT

SEQ ID NO: 29909 - protein, 7 aa, Artificial Sequence
  Synthetic
RVSAATT

SEQ ID NO: 29910 - protein, 7 aa, Artificial Sequence
  Synthetic
RFSAATT

SEQ ID NO: 29911 - protein, 7 aa, Artificial Sequence
  Synthetic
RISANTT

SEQ ID NO: 29912 - protein, 7 aa, Artificial Sequence
  Synthetic
RFSAAST

SEQ ID NO: 29913 - protein, 7 aa, Artificial Sequence
  Synthetic
RVGAGST

SEQ ID NO: 29914 - protein, 7 aa, Artificial Sequence
  Synthetic
RVSAGNT

SEQ ID NO: 29915 - protein, 7 aa, Artificial Sequence
  Synthetic
DHGCAEC

SEQ ID NO: 29916 - protein, 7 aa, Artificial Sequence
  Synthetic
RYSAATT

SEQ ID NO: 29917 - protein, 7 aa, Artificial Sequence
  Synthetic
RVSSGST

SEQ ID NO: 29918 - protein, 7 aa, Artificial Sequence
  Synthetic
RTGSGST

SEQ ID NO: 29919 - protein, 7 aa, Artificial Sequence
  Synthetic
RVSAANT

SEQ ID NO: 29920 - protein, 7 aa, Artificial Sequence
  Synthetic
RMSANTT

SEQ ID NO: 29921 - protein, 7 aa, Artificial Sequence
  Synthetic
RVSAGYT

SEQ ID NO: 29922 - protein, 7 aa, Artificial Sequence
  Synthetic
RVSSGST

SEQ ID NO: 29923 - protein, 7 aa, Artificial Sequence
  Synthetic
RTGSGST

SEQ ID NO: 29924 - protein, 7 aa, Artificial Sequence
  Synthetic
RTSAAST

SEQ ID NO: 29925 - protein, 7 aa, Artificial Sequence
  Synthetic
RVSAGTT

SEQ ID NO: 29926 - protein, 7 aa, Artificial Sequence
  Synthetic
RVSAAAT

SEQ ID NO: 29927 - protein, 7 aa, Artificial Sequence
  Synthetic
RISSANT

SEQ ID NO: 29928 - protein, 7 aa, Artificial Sequence
  Synthetic
RMSANST

SEQ ID NO: 29929 - protein, 7 aa, Artificial Sequence
  Synthetic
RYGAGST

SEQ ID NO: 29930 - protein, 7 aa, Artificial Sequence
  Synthetic
RISAGGT

SEQ ID NO: 29931 - protein, 7 aa, Artificial Sequence
  Synthetic
RISANTT

SEQ ID NO: 29932 - protein, 7 aa, Artificial Sequence
  Synthetic
RISASST

SEQ ID NO: 29933 - protein, 7 aa, Artificial Sequence
  Synthetic
RTSSAST

SEQ ID NO: 29934 - protein, 7 aa, Artificial Sequence
  Synthetic
RTGSAST

SEQ ID NO: 29935 - protein, 7 aa, Artificial Sequence
  Synthetic
RTSAAGT

SEQ ID NO: 29936 - protein, 7 aa, Artificial Sequence
  Synthetic
RTGSNST

SEQ ID NO: 29937 - protein, 7 aa, Artificial Sequence
  Synthetic
RFSAGAT

SEQ ID NO: 29938 - protein, 7 aa, Artificial Sequence
  Synthetic
RFSANTT

SEQ ID NO: 29939 - protein, 7 aa, Artificial Sequence
  Synthetic
RLSSNTT

SEQ ID NO: 29940 - protein, 7 aa, Artificial Sequence
  Synthetic
RVSANNT

SEQ ID NO: 29941 - protein, 7 aa, Artificial Sequence
  Synthetic
RISANNT

SEQ ID NO: 29942 - protein, 7 aa, Artificial Sequence
  Synthetic
RISSAYT

SEQ ID NO: 29943 - protein, 7 aa, Artificial Sequence
  Synthetic
RVSANYT

SEQ ID NO: 29944 - protein, 7 aa, Artificial Sequence
  Synthetic
RISAAGT

SEQ ID NO: 29945 - protein, 7 aa, Artificial Sequence
  Synthetic
RVSSAYT

SEQ ID NO: 29946 - protein, 7 aa, Artificial Sequence
  Synthetic
RMSSAST

SEQ ID NO: 29947 - protein, 7 aa, Artificial Sequence
  Synthetic
RISSAAT

SEQ ID NO: 29948 - protein, 7 aa, Artificial Sequence
  Synthetic
RISASST

SEQ ID NO: 29949 - protein, 7 aa, Artificial Sequence
  Synthetic
RVSAAGT

SEQ ID NO: 29950 - protein, 7 aa, Artificial Sequence
  Synthetic
RVSAAAT

SEQ ID NO: 29951 - protein, 7 aa, Artificial Sequence
  Synthetic
RFSANTT

SEQ ID NO: 29952 - protein, 7 aa, Artificial Sequence
  Synthetic
RMSSNST

SEQ ID NO: 29953 - protein, 7 aa, Artificial Sequence
  Synthetic
RYGAGST

SEQ ID NO: 29954 - protein, 7 aa, Artificial Sequence
  Synthetic
RTSAAGT

SEQ ID NO: 29955 - protein, 7 aa, Artificial Sequence
  Synthetic
RVSAGGT

SEQ ID NO: 29956 - protein, 7 aa, Artificial Sequence
  Synthetic
RISAQST

SEQ ID NO: 29957 - protein, 7 aa, Artificial Sequence
  Synthetic
RMSSAST

SEQ ID NO: 29958 - protein, 7 aa, Artificial Sequence
  Synthetic
RVSSAYT

SEQ ID NO: 29959 - protein, 7 aa, Artificial Sequence
  Synthetic
RLSSNTT

SEQ ID NO: 29960 - protein, 7 aa, Artificial Sequence
  Synthetic
RVSSATT

SEQ ID NO: 29961 - protein, 7 aa, Artificial Sequence
  Synthetic
RVSAQYT

SEQ ID NO: 29962 - protein, 7 aa, Artificial Sequence
  Synthetic
RYSSATT

SEQ ID NO: 29963 - protein, 7 aa, Artificial Sequence
  Synthetic
RMSSATT

SEQ ID NO: 29964 - protein, 7 aa, Artificial Sequence
  Synthetic
RTGAAST

SEQ ID NO: 29965 - protein, 7 aa, Artificial Sequence
  Synthetic
RISASYT

SEQ ID NO: 29966 - protein, 7 aa, Artificial Sequence
  Synthetic
RMSSATT

SEQ ID NO: 29967 - protein, 7 aa, Artificial Sequence
  Synthetic
RVSSATT

SEQ ID NO: 29968 - protein, 7 aa, Artificial Sequence
  Synthetic
RISANAT

SEQ ID NO: 29969 - protein, 7 aa, Artificial Sequence
  Synthetic
LMVKKMT

SEQ ID NO: 29970 - protein, 7 aa, Artificial Sequence
  Synthetic
RISSSST

SEQ ID NO: 29971 - protein, 7 aa, Artificial Sequence
  Synthetic
RTSAATT

SEQ ID NO: 29972 - protein, 7 aa, Artificial Sequence
  Synthetic
RTGSNST

SEQ ID NO: 29973 - protein, 7 aa, Artificial Sequence
  Synthetic
RVSANYT

SEQ ID NO: 29974 - protein, 7 aa, Artificial Sequence
  Synthetic
RISSANT

SEQ ID NO: 29975 - protein, 7 aa, Artificial Sequence
  Synthetic
RMSANTT

SEQ ID NO: 29976 - protein, 7 aa, Artificial Sequence
  Synthetic
RYSAATT

SEQ ID NO: 29977 - protein, 7 aa, Artificial Sequence
  Synthetic
RISANAT

SEQ ID NO: 29978 - protein, 7 aa, Artificial Sequence
  Synthetic
RMSSNST

SEQ ID NO: 29979 - protein, 7 aa, Artificial Sequence
  Synthetic
RTSSNST

SEQ ID NO: 29980 - protein, 7 aa, Artificial Sequence
  Synthetic
RISASYT

SEQ ID NO: 29981 - protein, 7 aa, Artificial Sequence
  Synthetic
RFSSAST

SEQ ID NO: 29982 - protein, 7 aa, Artificial Sequence
  Synthetic
RVSANTT

SEQ ID NO: 29983 - protein, 7 aa, Artificial Sequence
  Synthetic
RVSASST

SEQ ID NO: 29984 - DNA, 21 bp, Artificial Sequence
  Synthetic
agggtgtccgcggggtccacg

SEQ ID NO: 29985 - DNA, 21 bp, Artificial Sequence
  Synthetic
cgcgtatcagccggctcaacc

SEQ ID NO: 29986 - DNA, 21 bp, Artificial Sequence
  Synthetic
cgcgtatcagccgcctcaacc

SEQ ID NO: 29987 - DNA, 21 bp, Artificial Sequence
  Synthetic
cgcatctcagccggctcaacc

SEQ ID NO: 29988 - DNA, 21 bp, Artificial Sequence
  Synthetic
aggatatccgcggggtccacg

SEQ ID NO: 29989 - DNA, 21 bp, Artificial Sequence
  Synthetic
gatcacgggtgtgcggagtgt

SEQ ID NO: 29990 - DNA, 21 bp, Artificial Sequence
  Synthetic
aggatatccgcggcgtccacg

SEQ ID NO: 29991 - DNA, 21 bp, Artificial Sequence
  Synthetic
cgcatctcagccgcctcaacc

SEQ ID NO: 29992 - DNA, 21 bp, Artificial Sequence
  Synthetic
agggtgtccgcggcgtccacg

SEQ ID NO: 29993 - DNA, 21 bp, Artificial Sequence
  Synthetic
cgcatctcatcagcctcaacc

SEQ ID NO: 29994 - DNA, 21 bp, Artificial Sequence
  Synthetic
cgcatcggcgccggctcaacc

SEQ ID NO: 29995 - DNA, 21 bp, Artificial Sequence
  Synthetic
cgcgtatcatcagcctcaacc

SEQ ID NO: 29996 - DNA, 21 bp, Artificial Sequence
  Synthetic
cgcatctcagccgcctacacc

SEQ ID NO: 29997 - DNA, 21 bp, Artificial Sequence
  Synthetic
aggatatcctccgcgtccacg

SEQ ID NO: 29998 - DNA, 21 bp, Artificial Sequence
  Synthetic
aggatatccgcgaattccacg

SEQ ID NO: 29999 - DNA, 21 bp, Artificial Sequence
  Synthetic
aggacgggggcggggtccacg

SEQ ID NO: 30000 - DNA, 21 bp, Artificial Sequence
  Synthetic
aggatgtccgcggggtccacg

SEQ ID NO: 30001 - DNA, 21 bp, Artificial Sequence
  Synthetic
agggtgtccgcgaattccacg

SEQ ID NO: 30002 - DNA, 21 bp, Artificial Sequence
  Synthetic
cgcaccggcgccggctcaacc

SEQ ID NO: 30003 - DNA, 21 bp, Artificial Sequence
  Synthetic
aggatatcctccaattccacg

SEQ ID NO: 30004 - DNA, 21 bp, Artificial Sequence
  Synthetic
cgcatctcagccaactcaacc

SEQ ID NO: 30005 - DNA, 21 bp, Artificial Sequence
  Synthetic
cgcatgtcagccggctcaacc

SEQ ID NO: 30006 - DNA, 21 bp, Artificial Sequence
  Synthetic
cgcatctcagccaactacacc

SEQ ID NO: 30007 - DNA, 21 bp, Artificial Sequence
  Synthetic
cgcatgtcagccgccaccacc

SEQ ID NO: 30008 - DNA, 21 bp, Artificial Sequence
  Synthetic
cgcatctcagccggcgccacc

SEQ ID NO: 30009 - DNA, 21 bp, Artificial Sequence
  Synthetic
cgcatctcatcaaactcaacc

SEQ ID NO: 30010 - DNA, 21 bp, Artificial Sequence
  Synthetic
cgcgtatcagccgcctacacc

SEQ ID NO: 30011 - DNA, 21 bp, Artificial Sequence
  Synthetic
aggatatccgcgggggcgacg

SEQ ID NO: 30012 - DNA, 21 bp, Artificial Sequence
  Synthetic
aggacgtccgcggcgtccacg

SEQ ID NO: 30013 - DNA, 21 bp, Artificial Sequence
  Synthetic
aggatatccgcggggaatacg

SEQ ID NO: 30014 - DNA, 21 bp, Artificial Sequence
  Synthetic
aggatatccgcggcgacgacg

SEQ ID NO: 30015 - DNA, 21 bp, Artificial Sequence
  Synthetic
aggacgtccgcggggtccacg

SEQ ID NO: 30016 - DNA, 21 bp, Artificial Sequence
  Synthetic
aggatatccgcggcgtatacg

SEQ ID NO: 30017 - DNA, 21 bp, Artificial Sequence
  Synthetic
aggataggggcggggtccacg

SEQ ID NO: 30018 - DNA, 21 bp, Artificial Sequence
  Synthetic
cgcgtatcagccaactcaacc

SEQ ID NO: 30019 - DNA, 21 bp, Artificial Sequence
  Synthetic
agggtgtccgcggcgtatacg

SEQ ID NO: 30020 - DNA, 21 bp, Artificial Sequence
  Synthetic
aggatatccgcggcggcgacg

SEQ ID NO: 30021 - DNA, 21 bp, Artificial Sequence
  Synthetic
cgcatctcagccgccggcacc

SEQ ID NO: 30022 - DNA, 21 bp, Artificial Sequence
  Synthetic
cgcatctcatcaggctcaacc

SEQ ID NO: 30023 - DNA, 21 bp, Artificial Sequence
  Synthetic
aggatgggggcggggtccacg

SEQ ID NO: 30024 - DNA, 21 bp, Artificial Sequence
  Synthetic
cgcgtatcagccggctacacc

SEQ ID NO: 30025 - DNA, 21 bp, Artificial Sequence
  Synthetic
agggtgtcctccgcgtccacg

SEQ ID NO: 30026 - DNA, 21 bp, Artificial Sequence
  Synthetic
cgcatctcagccgccaacacc

SEQ ID NO: 30027 - DNA, 21 bp, Artificial Sequence
  Synthetic
aggatatccgcggcgaatacg

SEQ ID NO: 30028 - DNA, 21 bp, Artificial Sequence
  Synthetic
agggtgtccgcgcagtatacg

SEQ ID NO: 30029 - DNA, 21 bp, Artificial Sequence
  Synthetic
aggatatcctccgcgtatacg

SEQ ID NO: 30030 - DNA, 21 bp, Artificial Sequence
  Synthetic
cgcatctcagccgccgccacc

SEQ ID NO: 30031 - DNA, 21 bp, Artificial Sequence
  Synthetic
cgcatctcagccggcaacacc

SEQ ID NO: 30032 - DNA, 21 bp, Artificial Sequence
  Synthetic
aggttctccgcggcgacgacg

SEQ ID NO: 30033 - DNA, 21 bp, Artificial Sequence
  Synthetic
agggtgtcctccaattccacg

SEQ ID NO: 30034 - DNA, 21 bp, Artificial Sequence
  Synthetic
aggatatccgcgaattatacg

SEQ ID NO: 30035 - DNA, 21 bp, Artificial Sequence
  Synthetic
aggatatcctccgggtccacg

SEQ ID NO: 30036 - DNA, 21 bp, Artificial Sequence
  Synthetic
agggtgtccgcgggggcgacg

SEQ ID NO: 30037 - DNA, 21 bp, Artificial Sequence
  Synthetic
aggatatccgcggggtatacg

SEQ ID NO: 30038 - DNA, 21 bp, Artificial Sequence
  Synthetic
cgcgtatcagccggcgccacc

SEQ ID NO: 30039 - DNA, 21 bp, Artificial Sequence
  Synthetic
aggttgtcctccgcgacgacg

SEQ ID NO: 30040 - DNA, 21 bp, Artificial Sequence
  Synthetic
aggatatccgcgcagtatacg

SEQ ID NO: 30041 - DNA, 21 bp, Artificial Sequence
  Synthetic
aggatgtccgcggcgacgacg

SEQ ID NO: 30042 - DNA, 21 bp, Artificial Sequence
  Synthetic
cgcatctcagccggcggcacc

SEQ ID NO: 30043 - DNA, 21 bp, Artificial Sequence
  Synthetic
aggatgtccgcggcgtccacg

SEQ ID NO: 30044 - DNA, 21 bp, Artificial Sequence
  Synthetic
cgcttttcagccgcctcaacc

SEQ ID NO: 30045 - DNA, 21 bp, Artificial Sequence
  Synthetic
cgcctgtcatcagccaccacc

SEQ ID NO: 30046 - DNA, 21 bp, Artificial Sequence
  Synthetic
agggtgtccgcggcgacgacg

SEQ ID NO: 30047 - DNA, 21 bp, Artificial Sequence
  Synthetic
cgcgtaggcgccggctcaacc

SEQ ID NO: 30048 - DNA, 21 bp, Artificial Sequence
  Synthetic
aggatatccgcggggacgacg

SEQ ID NO: 30049 - DNA, 21 bp, Artificial Sequence
  Synthetic
cgcatctcagcccaatacacc

SEQ ID NO: 30050 - DNA, 21 bp, Artificial Sequence
  Synthetic
cgcatctcagccgccaccacc

SEQ ID NO: 30051 - DNA, 21 bp, Artificial Sequence
  Synthetic
cgcatgggcgccggctcaacc

SEQ ID NO: 30052 - DNA, 21 bp, Artificial Sequence
  Synthetic
cgcgtatcagccggcaacacc

SEQ ID NO: 30053 - DNA, 21 bp, Artificial Sequence
  Synthetic
cgcttttcagccggctcaacc

SEQ ID NO: 30054 - DNA, 21 bp, Artificial Sequence
  Synthetic
aggacgtccgcgaattccacg

SEQ ID NO: 30055 - DNA, 21 bp, Artificial Sequence
  Synthetic
aggttcggggcggggtccacg

SEQ ID NO: 30056 - DNA, 21 bp, Artificial Sequence
  Synthetic
aggttctccgcggggtccacg

SEQ ID NO: 30057 - DNA, 21 bp, Artificial Sequence
  Synthetic
cgcatctcatcagccaccacc

SEQ ID NO: 30058 - DNA, 21 bp, Artificial Sequence
  Synthetic
aggttctccgcggggacgacg

SEQ ID NO: 30059 - DNA, 21 bp, Artificial Sequence
  Synthetic
cgcatgtcagccgcctcaacc

SEQ ID NO: 30060 - DNA, 21 bp, Artificial Sequence
  Synthetic
cgcttttcatcagccaccacc

SEQ ID NO: 30061 - DNA, 21 bp, Artificial Sequence
  Synthetic
cgcatctcagccggcaccacc

SEQ ID NO: 30062 - DNA, 21 bp, Artificial Sequence
  Synthetic
cgcatgtcagccggcaccacc

SEQ ID NO: 30063 - DNA, 21 bp, Artificial Sequence
  Synthetic
cgcgtatcatcaaactcaacc

SEQ ID NO: 30064 - DNA, 21 bp, Artificial Sequence
  Synthetic
agggtgtccgcggggacgacg

SEQ ID NO: 30065 - DNA, 21 bp, Artificial Sequence
  Synthetic
aggatatcctccgcgacgacg

SEQ ID NO: 30066 - DNA, 21 bp, Artificial Sequence
  Synthetic
aggacgtccgcggcgacgacg

SEQ ID NO: 30067 - DNA, 21 bp, Artificial Sequence
  Synthetic
aggatgtccgcgaattccacg

SEQ ID NO: 30068 - DNA, 21 bp, Artificial Sequence
  Synthetic
cgcacctcatcagcctcaacc

SEQ ID NO: 30069 - DNA, 21 bp, Artificial Sequence
  Synthetic
cgcaccggctcagcctcaacc

SEQ ID NO: 30070 - DNA, 21 bp, Artificial Sequence
  Synthetic
cgctttggcgccggctcaacc

SEQ ID NO: 30071 - DNA, 21 bp, Artificial Sequence
  Synthetic
cgcacctcagccggctcaacc

SEQ ID NO: 30072 - DNA, 21 bp, Artificial Sequence
  Synthetic
cgcgtatcagccgccaacacc

SEQ ID NO: 30073 - DNA, 21 bp, Artificial Sequence
  Synthetic
aggatgtccgcggggacgacg

SEQ ID NO: 30074 - DNA, 21 bp, Artificial Sequence
  Synthetic
cgcgtatcagccgccaccacc

SEQ ID NO: 30075 - DNA, 21 bp, Artificial Sequence
  Synthetic
cgcttttcagccgccaccacc

SEQ ID NO: 30076 - DNA, 21 bp, Artificial Sequence
  Synthetic
cgcatctcagccaacaccacc

SEQ ID NO: 30077 - DNA, 21 bp, Artificial Sequence
  Synthetic
aggttctccgcggcgtccacg

SEQ ID NO: 30078 - DNA, 21 bp, Artificial Sequence
  Synthetic
agggtgggggcggggtccacg

SEQ ID NO: 30079 - DNA, 21 bp, Artificial Sequence
  Synthetic
agggtgtccgcggggaatacg

SEQ ID NO: 30080 - DNA, 21 bp, Artificial Sequence
  Synthetic
gaccatggctgcgccgaatgc

SEQ ID NO: 30081 - DNA, 21 bp, Artificial Sequence
  Synthetic
aggtattccgcggcgacgacg

SEQ ID NO: 30082 - DNA, 21 bp, Artificial Sequence
  Synthetic
agggtgtcctccgggtccacg

SEQ ID NO: 30083 - DNA, 21 bp, Artificial Sequence
  Synthetic
cgcaccggctcaggctcaacc

SEQ ID NO: 30084 - DNA, 21 bp, Artificial Sequence
  Synthetic
agggtgtccgcggcgaatacg

SEQ ID NO: 30085 - DNA, 21 bp, Artificial Sequence
  Synthetic
aggatgtccgcgaatacgacg

SEQ ID NO: 30086 - DNA, 21 bp, Artificial Sequence
  Synthetic
agggtgtccgcggggtatacg

SEQ ID NO: 30087 - DNA, 21 bp, Artificial Sequence
  Synthetic
cgcgtatcatcaggctcaacc

SEQ ID NO: 30088 - DNA, 21 bp, Artificial Sequence
  Synthetic
aggacggggtccgggtccacg

SEQ ID NO: 30089 - DNA, 21 bp, Artificial Sequence
  Synthetic
cgcacctcagccgcctcaacc

SEQ ID NO: 30090 - DNA, 21 bp, Artificial Sequence
  Synthetic
cgcgtatcagccggcaccacc

SEQ ID NO: 30091 - DNA, 21 bp, Artificial Sequence
  Synthetic
agggtgtccgcggcggcgacg

SEQ ID NO: 30092 - DNA, 21 bp, Artificial Sequence
  Synthetic
cgcatctcatcagccaacacc

SEQ ID NO: 30093 - DNA, 21 bp, Artificial Sequence
  Synthetic
cgcatgtcagccaactcaacc

SEQ ID NO: 30094 - DNA, 21 bp, Artificial Sequence
  Synthetic
cgctacggcgccggctcaacc

SEQ ID NO: 30095 - DNA, 21 bp, Artificial Sequence
  Synthetic
aggatatccgcgggggggacg

SEQ ID NO: 30096 - DNA, 21 bp, Artificial Sequence
  Synthetic
aggatatccgcgaatacgacg

SEQ ID NO: 30097 - DNA, 21 bp, Artificial Sequence
  Synthetic
cgcatctcagcctcatcaacc

SEQ ID NO: 30098 - DNA, 21 bp, Artificial Sequence
  Synthetic
aggacgtcctccgcgtccacg

SEQ ID NO: 30099 - DNA, 21 bp, Artificial Sequence
  Synthetic
aggacggggtccgcgtccacg

SEQ ID NO: 30100 - DNA, 21 bp, Artificial Sequence
  Synthetic
cgcacctcagccgccggcacc

SEQ ID NO: 30101 - DNA, 21 bp, Artificial Sequence
  Synthetic
cgcaccggctcaaactcaacc

SEQ ID NO: 30102 - DNA, 21 bp, Artificial Sequence
  Synthetic
cgcttttcagccggcgccacc

SEQ ID NO: 30103 - DNA, 21 bp, Artificial Sequence
  Synthetic
aggttctccgcgaatacgacg

SEQ ID NO: 30104 - DNA, 21 bp, Artificial Sequence
  Synthetic
cgcctgtcatcaaacaccacc

SEQ ID NO: 30105 - DNA, 21 bp, Artificial Sequence
  Synthetic
agggtgtccgcgaataatacg

SEQ ID NO: 30106 - DNA, 21 bp, Artificial Sequence
  Synthetic
aggatatccgcgaataatacg

SEQ ID NO: 30107 - DNA, 21 bp, Artificial Sequence
  Synthetic
cgcatctcatcagcctacacc

SEQ ID NO: 30108 - DNA, 21 bp, Artificial Sequence
  Synthetic
cgcgtatcagccaactacacc

SEQ ID NO: 30109 - DNA, 21 bp, Artificial Sequence
  Synthetic
aggatatccgcggcggggacg

SEQ ID NO: 30110 - DNA, 21 bp, Artificial Sequence
  Synthetic
cgcgtatcatcagcctacacc

SEQ ID NO: 30111 - DNA, 21 bp, Artificial Sequence
  Synthetic
cgcatgtcatcagcctcaacc

SEQ ID NO: 30112 - DNA, 21 bp, Artificial Sequence
  Synthetic
aggatatcctccgcggcgacg

SEQ ID NO: 30113 - DNA, 21 bp, Artificial Sequence
  Synthetic
aggatatccgcgtcctccacg

SEQ ID NO: 30114 - DNA, 21 bp, Artificial Sequence
  Synthetic
cgcgtatcagccgccggcacc

SEQ ID NO: 30115 - DNA, 21 bp, Artificial Sequence
  Synthetic
cgcgtatcagccgccgccacc

SEQ ID NO: 30116 - DNA, 21 bp, Artificial Sequence
  Synthetic
cgcttttcagccaacaccacc

SEQ ID NO: 30117 - DNA, 21 bp, Artificial Sequence
  Synthetic
aggatgtcctccaattccacg

SEQ ID NO: 30118 - DNA, 21 bp, Artificial Sequence
  Synthetic
aggtatggggcggggtccacg

SEQ ID NO: 30119 - DNA, 21 bp, Artificial Sequence
  Synthetic
aggacgtccgcggcggggacg

SEQ ID NO: 30120 - DNA, 21 bp, Artificial Sequence
  Synthetic
cgcgtatcagccggcggcacc

SEQ ID NO: 30121 - DNA, 21 bp, Artificial Sequence
  Synthetic
aggatatccgcgcagtccacg

SEQ ID NO: 30122 - DNA, 21 bp, Artificial Sequence
  Synthetic
aggatgtcctccgcgtccacg

SEQ ID NO: 30123 - DNA, 21 bp, Artificial Sequence
  Synthetic
agggtgtcctccgcgtatacg

SEQ ID NO: 30124 - DNA, 21 bp, Artificial Sequence
  Synthetic
aggttgtcctccaatacgacg

SEQ ID NO: 30125 - DNA, 21 bp, Artificial Sequence
  Synthetic
agggtgtcctccgcgacgacg

SEQ ID NO: 30126 - DNA, 21 bp, Artificial Sequence
  Synthetic
cgcgtatcagcccaatacacc

SEQ ID NO: 30127 - DNA, 21 bp, Artificial Sequence
  Synthetic
aggtattcctccgcgacgacg

SEQ ID NO: 30128 - DNA, 21 bp, Artificial Sequence
  Synthetic
aggatgtcctccgcgacgacg

SEQ ID NO: 30129 - DNA, 21 bp, Artificial Sequence
  Synthetic
aggacgggggcggcgtccacg

SEQ ID NO: 30130 - DNA, 21 bp, Artificial Sequence
  Synthetic
cgcatctcagcctcatacacc

SEQ ID NO: 30131 - DNA, 21 bp, Artificial Sequence
  Synthetic
cgcatgtcatcagccaccacc

SEQ ID NO: 30132 - DNA, 21 bp, Artificial Sequence
  Synthetic
cgcgtatcatcagccaccacc

SEQ ID NO: 30133 - DNA, 21 bp, Artificial Sequence
  Synthetic
aggatatccgcgaatgcgacg

SEQ ID NO: 30134 - DNA, 21 bp, Artificial Sequence
  Synthetic
ttgatggtgaaaaaaatgacg

SEQ ID NO: 30135 - DNA, 21 bp, Artificial Sequence
  Synthetic
aggatatcctcctcctccacg

SEQ ID NO: 30136 - DNA, 21 bp, Artificial Sequence
  Synthetic
cgcacctcagccgccaccacc

SEQ ID NO: 30137 - DNA, 21 bp, Artificial Sequence
  Synthetic
aggacggggtccaattccacg

SEQ ID NO: 30138 - DNA, 21 bp, Artificial Sequence
  Synthetic
agggtgtccgcgaattatacg

SEQ ID NO: 30139 - DNA, 21 bp, Artificial Sequence
  Synthetic
aggatatcctccgcgaatacg

SEQ ID NO: 30140 - DNA, 21 bp, Artificial Sequence
  Synthetic
cgcatgtcagccaacaccacc

SEQ ID NO: 30141 - DNA, 21 bp, Artificial Sequence
  Synthetic
cgctactcagccgccaccacc

SEQ ID NO: 30142 - DNA, 21 bp, Artificial Sequence
  Synthetic
cgcatctcagccaacgccacc

SEQ ID NO: 30143 - DNA, 21 bp, Artificial Sequence
  Synthetic
cgcatgtcatcaaactcaacc

SEQ ID NO: 30144 - DNA, 21 bp, Artificial Sequence
  Synthetic
aggacgtcctccaattccacg

SEQ ID NO: 30145 - DNA, 21 bp, Artificial Sequence
  Synthetic
aggatatccgcgtcctatacg

SEQ ID NO: 30146 - DNA, 21 bp, Artificial Sequence
  Synthetic
aggttctcctccgcgtccacg

SEQ ID NO: 30147 - DNA, 21 bp, Artificial Sequence
  Synthetic
agggtgtccgcgaatacgacg

SEQ ID NO: 30148 - DNA, 21 bp, Artificial Sequence
  Synthetic
agggtgtccgcgtcctccacg

SEQ ID NO: 30149 - protein, 7 aa, Artificial Sequence
  Synthetic
RTGSGST

SEQ ID NO: 30150 - protein, 7 aa, Artificial Sequence
  Synthetic
RTSAGGT

SEQ ID NO: 30151 - protein, 7 aa, Artificial Sequence
  Synthetic
RVSAGMT

SEQ ID NO: 30152 - protein, 7 aa, Artificial Sequence
  Synthetic
RVSAGLT

SEQ ID NO: 30153 - protein, 7 aa, Artificial Sequence
  Synthetic
RLSAGSS

SEQ ID NO: 30154 - protein, 7 aa, Artificial Sequence
  Synthetic
RVSANMT

SEQ ID NO: 30155 - protein, 7 aa, Artificial Sequence
  Synthetic
RTSAGSS

SEQ ID NO: 30156 - protein, 7 aa, Artificial Sequence
  Synthetic
GSGTVKL

SEQ ID NO: 30157 - protein, 7 aa, Artificial Sequence
  Synthetic
GSGTVRN

SEQ ID NO: 30158 - protein, 7 aa, Artificial Sequence
  Synthetic
GSGTVRL

SEQ ID NO: 30159 - protein, 7 aa, Artificial Sequence
  Synthetic
GSGTVRA

SEQ ID NO: 30160 - protein, 7 aa, Artificial Sequence
  Synthetic
GSGTVYH

SEQ ID NO: 30161 - protein, 7 aa, Artificial Sequence
  Synthetic
QNRTTYV

SEQ ID NO: 30162 - protein, 7 aa, Artificial Sequence
  Synthetic
QNRADYV

SEQ ID NO: 30163 - protein, 7 aa, Artificial Sequence
  Synthetic
VETYSNR

SEQ ID NO: 30164 - protein, 7 aa, Artificial Sequence
  Synthetic
GAAGYPR

SEQ ID NO: 30165 - protein, 7 aa, Artificial Sequence
  Synthetic
SGPVGGR

SEQ ID NO: 30166 - protein, 7 aa, Artificial Sequence
  Synthetic
VLTSGAW

SEQ ID NO: 30167 - DNA, 21 bp, Artificial Sequence
  Synthetic
aggactgggtcgggttctact

SEQ ID NO: 30168 - DNA, 21 bp, Artificial Sequence
  Synthetic
cggacgtcggcggggggtact

SEQ ID NO: 30169 - DNA, 21 bp, Artificial Sequence
  Synthetic
agggtgtcggctggtatgacg

SEQ ID NO: 30170 - DNA, 21 bp, Artificial Sequence
  Synthetic
agggtttcggctggtctgact

SEQ ID NO: 30171 - DNA, 21 bp, Artificial Sequence
  Synthetic
cggttgtctgcgggtagttcg

SEQ ID NO: 30172 - DNA, 21 bp, Artificial Sequence
  Synthetic
cgggttagtgctaatatgact

SEQ ID NO: 30173 - DNA, 21 bp, Artificial Sequence
  Synthetic
aggacgagtgctgggagtagt

SEQ ID NO: 30174 - DNA, 21 bp, Artificial Sequence
  Synthetic
gggtcgggtactgtgaagctt

SEQ ID NO: 30175 - DNA, 21 bp, Artificial Sequence
  Synthetic
ggtagtggtacggttcgtaat

SEQ ID NO: 30176 - DNA, 21 bp, Artificial Sequence
  Synthetic
ggttctggtactgtgcgtctg

SEQ ID NO: 30177 - DNA, 21 bp, Artificial Sequence
  Synthetic
gggtctgggacggtgagggcg

SEQ ID NO: 30178 - DNA, 21 bp, Artificial Sequence
  Synthetic
gggtcggggacggtttatcat

SEQ ID NO: 30179 - DNA, 21 bp, Artificial Sequence
  Synthetic
cagaatcggacgacgtatgtt

SEQ ID NO: 30180 - DNA, 21 bp, Artificial Sequence
  Synthetic
cagaatcgggctgattatgtt

SEQ ID NO: 30181 - DNA, 21 bp, Artificial Sequence
  Synthetic
gtggagacgtatagtaatcgg

SEQ ID NO: 30182 - DNA, 21 bp, Artificial Sequence
  Synthetic
ggtgctgcggggtatccgcgt

SEQ ID NO: 30183 - DNA, 21 bp, Artificial Sequence
  Synthetic
agtggtccggttgggggtcgt

SEQ ID NO: 30184 - DNA, 21 bp, Artificial Sequence
  Synthetic
gtgttgactagtggggcttgg

SEQ ID NO: 30185 - protein, 7 aa, Artificial Sequence
  Synthetic
YHPLDVT

SEQ ID NO: 30186 - protein, 7 aa, Artificial Sequence
  Synthetic
YHPLDPT

SEQ ID NO: 30187 - protein, 7 aa, Artificial Sequence
  Synthetic
YHPLDPT

SEQ ID NO: 30188 - protein, 7 aa, Artificial Sequence
  Synthetic
YHPLDIT

SEQ ID NO: 30189 - protein, 7 aa, Artificial Sequence
  Synthetic
YHPLDRT

SEQ ID NO: 30190 - protein, 7 aa, Artificial Sequence
  Synthetic
YHPMDPT

SEQ ID NO: 30191 - protein, 7 aa, Artificial Sequence
  Synthetic
YHPLDSS

SEQ ID NO: 30192 - protein, 7 aa, Artificial Sequence
  Synthetic
YHPLDKT

SEQ ID NO: 30193 - protein, 7 aa, Artificial Sequence
  Synthetic
YHPLDKT

SEQ ID NO: 30194 - protein, 7 aa, Artificial Sequence
  Synthetic
YHPLDVT

SEQ ID NO: 30195 - protein, 7 aa, Artificial Sequence
  Synthetic
YHPLDPS

SEQ ID NO: 30196 - protein, 7 aa, Artificial Sequence
  Synthetic
YHPMDPS

SEQ ID NO: 30197 - protein, 7 aa, Artificial Sequence
  Synthetic
YHPMDPS

SEQ ID NO: 30198 - protein, 7 aa, Artificial Sequence
  Synthetic
YHPQDPT

SEQ ID NO: 30199 - protein, 7 aa, Artificial Sequence
  Synthetic
YHPLDLT

SEQ ID NO: 30200 - protein, 7 aa, Artificial Sequence
  Synthetic
YHPLDMT

SEQ ID NO: 30201 - protein, 7 aa, Artificial Sequence
  Synthetic
YHPHDPT

SEQ ID NO: 30202 - protein, 7 aa, Artificial Sequence
  Synthetic
YHPLDAT

SEQ ID NO: 30203 - protein, 7 aa, Artificial Sequence
  Synthetic
YHPEDWT

SEQ ID NO: 30204 - protein, 7 aa, Artificial Sequence
  Synthetic
YHPLDHT

SEQ ID NO: 30205 - DNA, 21 bp, Artificial Sequence
  Synthetic
tatcacccgttggatgtgacg

SEQ ID NO: 30206 - DNA, 21 bp, Artificial Sequence
  Synthetic
taccatcccctggaccccacc

SEQ ID NO: 30207 - DNA, 21 bp, Artificial Sequence
  Synthetic
tatcacccgttggatccgacg

SEQ ID NO: 30208 - DNA, 21 bp, Artificial Sequence
  Synthetic
tatcacccgttggatataacg

SEQ ID NO: 30209 - DNA, 21 bp, Artificial Sequence
  Synthetic
tatcacccgttggataggacg

SEQ ID NO: 30210 - DNA, 21 bp, Artificial Sequence
  Synthetic
tatcacccgatggatccgacg

SEQ ID NO: 30211 - DNA, 21 bp, Artificial Sequence
  Synthetic
taccatcccctggactcatca

SEQ ID NO: 30212 - DNA, 21 bp, Artificial Sequence
  Synthetic
tatcacccgttggataaaacg

SEQ ID NO: 30213 - DNA, 21 bp, Artificial Sequence
  Synthetic
taccatcccctggacaagacc

SEQ ID NO: 30214 - DNA, 21 bp, Artificial Sequence
  Synthetic
taccatcccctggacgtaacc

SEQ ID NO: 30215 - DNA, 21 bp, Artificial Sequence
  Synthetic
taccatcccctggacccctca

SEQ ID NO: 30216 - DNA, 21 bp, Artificial Sequence
  Synthetic
tatcacccgatggatccgtcc

SEQ ID NO: 30217 - DNA, 21 bp, Artificial Sequence
  Synthetic
taccatcccatggacccctca

SEQ ID NO: 30218 - DNA, 21 bp, Artificial Sequence
  Synthetic
tatcacccgcaggatccgacg

SEQ ID NO: 30219 - DNA, 21 bp, Artificial Sequence
  Synthetic
tatcacccgttggatttgacg

SEQ ID NO: 30220 - DNA, 21 bp, Artificial Sequence
  Synthetic
taccatcccctggacatgacc

SEQ ID NO: 30221 - DNA, 21 bp, Artificial Sequence
  Synthetic
tatcacccgcacgatccgacg

SEQ ID NO: 30222 - DNA, 21 bp, Artificial Sequence
  Synthetic
taccatcccctggacgccacc

SEQ ID NO: 30223 - DNA, 21 bp, Artificial Sequence
  Synthetic
tatcacccggaggattggacg

SEQ ID NO: 30224 - DNA, 21 bp, Artificial Sequence
  Synthetic
tatcacccgttggatcacacg

SEQ ID NO: 30225 - protein, 7 aa, Artificial Sequence
  Synthetic
  MISC_FEATURE (1)..(1): Xaa may be Thr or Ser
  MISC_FEATURE (2)..(2): Xaa may be Leu, Ile, Val or Met
  MISC_FEATURE (3)..(3): Xaa may be Ala or any naturally occurring amino acid
  MISC_FEATURE (4)..(4): Xaa may be Val or any naturally occurring amino acid
XXXXPFK

SEQ ID NO: 30226 - protein, 7 aa, Artificial Sequence
  Synthetic
  MISC_FEATURE (1)..(1): Xaa may be Thr or Ser
  MISC_FEATURE (2)..(2): Xaa may be Val or any naturally occurring amino acid
  MISC_FEATURE (3)..(3): Xaa may be Thr, Ser or any naturally occurring amino acid
  MISC_FEATURE (4)..(4): Xaa may be Lys or Arg
  MISC_FEATURE (7)..(7): Xaa may be Leu, Ile, Val or Ala
XXXXPFX

SEQ ID NO: 30227 - protein, 7 aa, Artificial Sequence
  Synthetic
  misc_feature (1)..(3): Xaa can be any naturally occurring amino acid
  MISC_FEATURE (6)..(6): Xaa may be Asp or Asn
  MISC_FEATURE (7)..(7): Xaa may be  Ile, Val or Pro
  MISC_FEATURE (7)..(7): Xaa may be Ile, Val or Pro
XXXFKXX

SEQ ID NO: 30228 - protein, 7 aa, Artificial Sequence
  Synthetic
  misc_feature (1)..(1): Xaa can be any naturally occurring amino acid
  MISC_FEATURE (2)..(2): Xaa may be Lys, Tyr or Arg
  MISC_FEATURE (3)..(3): Xaa may be Lys, Tyr, Phe, Arg or any naturally occurring amino acid
  MISC_FEATURE (4)..(4): Xaa may be Lys, Tyr, Gly, Arg or any naturally occurring amino acid
  MISC_FEATURE (5)..(5): Xaa may be Tyr, Trp, Phe, Leu, or Met
  MISC_FEATURE (6)..(6): Xaa may be Ser or Ala
  MISC_FEATURE (7)..(7): Xaa may be Ser, Thr, Ala or Gln
XXXXXXX

SEQ ID NO: 30229 - DNA, 14 bp, Artificial Sequence
  Synthetic
ttttttctacaggt

SEQ ID NO: 30230 - DNA, 68 bp, Artificial Sequence
  Synthetic
  misc_feature (29)..(36): n is a, c, g, or t
ctttccctacacgacgctcttccgatctnnnnnnnnccaacgaagaagaaattaaaactactaacccg

SEQ ID NO: 30231 - DNA, 67 bp, Artificial Sequence
  Synthetic
  misc_feature (29)..(35): n is a, c, g, or t
ctttccctacacgacgctcttccgatctnnnnnnnccaacgaagaagaaattaaaactactaacccg

SEQ ID NO: 30232 - DNA, 66 bp, Artificial Sequence
  Synthetic
  misc_feature (29)..(34): n is a, c, g, or t
ctttccctacacgacgctcttccgatctnnnnnnccaacgaagaagaaattaaaactactaacccg

SEQ ID NO: 30233 - DNA, 65 bp, Artificial Sequence
  Synthetic
  misc_feature (29)..(33): n is a, c, g, or t
ctttccctacacgacgctcttccgatctnnnnnccaacgaagaagaaattaaaactactaacccg

SEQ ID NO: 30234 - DNA, 64 bp, Artificial Sequence
  Synthetic
  misc_feature (29)..(32): n is a, c, g, or t
ctttccctacacgacgctcttccgatctnnnnccaacgaagaagaaattaaaactactaacccg

SEQ ID NO: 30235 - DNA, 63 bp, Artificial Sequence
  Synthetic
  misc_feature (29)..(31): n is a, c, g, or t
ctttccctacacgacgctcttccgatctnnnccaacgaagaagaaattaaaactactaacccg

SEQ ID NO: 30236 - DNA, 62 bp, Artificial Sequence
  Synthetic
  misc_feature (29)..(30): n is a, c, g, or t
ctttccctacacgacgctcttccgatctnnccaacgaagaagaaattaaaactactaacccg

SEQ ID NO: 30237 - DNA, 61 bp, Artificial Sequence
  Synthetic
  misc_feature (29)..(29): n is a, c, g, or t
ctttccctacacgacgctcttccgatctnccaacgaagaagaaattaaaactactaacccg

SEQ ID NO: 30238 - DNA, 60 bp, Artificial Sequence
  Synthetic
ctttccctacacgacgctcttccgatctccaacgaagaagaaattaaaactactaacccg

SEQ ID NO: 30239 - DNA, 53 bp, Artificial Sequence
  Synthetic
ccataccaaaccgtcctgtctctactctagccttctcgtgtgcagacttgagg

SEQ ID NO: 30240 - DNA, 54 bp, Artificial Sequence
  Synthetic
  misc_feature (26)..(26): n is a, c, g, or t
ccataccaaaccgtcctgtctctacntctagccttctcgtgtgcagacttgagg

SEQ ID NO: 30241 - DNA, 55 bp, Artificial Sequence
  Synthetic
  misc_feature (26)..(27): n is a, c, g, or t
ccataccaaaccgtcctgtctctacnntctagccttctcgtgtgcagacttgagg

SEQ ID NO: 30242 - DNA, 56 bp, Artificial Sequence
  Synthetic
  misc_feature (26)..(28): n is a, c, g, or t
ccataccaaaccgtcctgtctctacnnntctagccttctcgtgtgcagacttgagg

SEQ ID NO: 30243 - DNA, 57 bp, Artificial Sequence
  Synthetic
  misc_feature (26)..(29): n is a, c, g, or t
ccataccaaaccgtcctgtctctacnnnntctagccttctcgtgtgcagacttgagg

SEQ ID NO: 30244 - DNA, 58 bp, Artificial Sequence
  Synthetic
  misc_feature (26)..(30): n is a, c, g, or t
ccataccaaaccgtcctgtctctacnnnnntctagccttctcgtgtgcagacttgagg

SEQ ID NO: 30245 - DNA, 60 bp, Artificial Sequence
  Synthetic
  misc_feature (26)..(32): n is a, c, g, or t
ccataccaaaccgtcctgtctctacnnnnnnntctagccttctcgtgtgcagacttgagg

SEQ ID NO: 30246 - DNA, 61 bp, Artificial Sequence
  Synthetic
  misc_feature (26)..(33): n is a, c, g, or t
ccataccaaaccgtcctgtctctacnnnnnnnntctagccttctcgtgtgcagacttgagg

SEQ ID NO: 30247 - DNA, 30 bp, Artificial Sequence
  Synthetic
cactcatcgaccaatacttgtactatctct

SEQ ID NO: 30248 - DNA, 26 bp, Artificial Sequence
  Synthetic
gtattccttggttttgaacccaaccg

SEQ ID NO: 30249 - DNA, 81 bp, Artificial Sequence
  Synthetic, (M:50500000)(N:25252525)
  misc_feature (41)..(41): n is a, c, g, or t
  misc_feature (43)..(44): n is a, c, g, or t
  misc_feature (46)..(47): n is a, c, g, or t
  misc_feature (49)..(50): n is a, c, g, or t
  misc_feature (52)..(53): n is a, c, g, or t
  misc_feature (55)..(56): n is a, c, g, or t
  misc_feature (58)..(59): n is a, c, g, or t
gtattccttggttttgaacccaaccggtctgcgcctgtgcnmnnmnnmnnmnnmnnmnnttgggcactctggtggtttgtg

SEQ ID NO: 30250 - DNA, 45 bp, Artificial Sequence
  Synthetic
gagctcgtttagtgaaccgtcagatatcgccaccatggacacttc

SEQ ID NO: 30251 - DNA, 43 bp, Artificial Sequence
  Synthetic
caggcccctggaagagcacctctagaccgcctccattgggaac

SEQ ID NO: 30252 - DNA, 45 bp, Artificial Sequence; identical to SEQ ID NO: 30250
  Synthetic

SEQ ID NO: 30253 - DNA, 45 bp, Artificial Sequence
  Synthetic
aggcccctggaagagcacctctagaccacctgcagtgggaactgc

SEQ ID NO: 30254 - DNA, 45 bp, Artificial Sequence
  Synthetic
gctcgtttagtgaaccgtcagatatcgccaccatgggaatccaag

SEQ ID NO: 30255 - DNA, 50 bp, Artificial Sequence
  Synthetic
cctggaagagcacctctagaccattttcaagctgttcgttaaagttacac

SEQ ID NO: 30256 - DNA, 45 bp, Artificial Sequence
  Synthetic
gtttagtgaaccgtcagatatcgccaccatgaagatcttcttgcc

SEQ ID NO: 30257 - DNA, 50 bp, Artificial Sequence
  Synthetic
ggcccctggaagagcacctctagaccactgaaattgcacagaaagctctg

SEQ ID NO: 30258 - protein, 7 aa, Artificial Sequence
  Synthetic
TLAVPFK

SEQ ID NO: 30259 - protein, 7 aa, Artificial Sequence
  Synthetic
  misc_feature (1)..(1): Xaa can be any naturally occurring amino acid
  MISC_FEATURE (2)..(2): Xaa may be Lys or Arg
  MISC_FEATURE (3)..(3): Xaa may be any naturally occurring amino acid except Cys, Lys or Arg
  MISC_FEATURE (7)..(7): Xaa may be Thr, Ser or Gln
XXXGYSX

SEQ ID NO: 30260 - protein, 7 aa, Artificial Sequence
  Synthetic
IMPRTGG

SEQ ID NO: 30261 - DNA, 21 bp, Artificial Sequence
  Synthetic
attatgcctaggacgggtggt

SEQ ID NO: 30262 - protein, 7 aa, Artificial Sequence
  Synthetic
  MISC_FEATURE (3)..(3): Xaa may be any naturally occurring hydrophobic amino acid
  misc_feature (4)..(5): Xaa can be any naturally occurring amino acid
FTXXXPK

SEQ ID NO: 30263 - protein, 7 aa, Artificial Sequence
  Synthetic
  MISC_FEATURE (1)..(1): Xaa may be Thr, Ser or any naturally occurring amino acid
  misc_feature (2)..(4): Xaa can be any naturally occurring amino acid
  MISC_FEATURE (7)..(7): Xaa may be Lys or Arg
XXXXPFX

SEQ ID NO: 30264 - protein, 7 aa, Artificial Sequence
  Synthetic
  misc_feature (2)..(2): Xaa can be any naturally occurring amino acid
  MISC_FEATURE (3)..(3): Xaa may be Phe or Trp
  misc_feature (4)..(4): Xaa can be any naturally occurring amino acid
  misc_feature (7)..(7): Xaa can be any naturally occurring amino acid
GXXXPPX

SEQ ID NO: 30265 - protein, 7 aa, Artificial Sequence
  Synthetic
  MISC_FEATURE (1)..(1): Xaa may be Thr, Ser or any naturally occurring amino acid
  misc_feature (2)..(3): Xaa can be any naturally occurring amino acid
  MISC_FEATURE (4)..(4): Xaa may be Lys or Arg
  MISC_FEATURE (7)..(7): Xaa may be Leu, Ile, Val, Gln, His, Ser, Thr,  Ala or Met
XXXXPFX

SEQ ID NO: 30266 - protein, 7 aa, Artificial Sequence
  Synthetic
  MISC_FEATURE (2)..(5): Xaa may be Thr, Ser or any naturally occurring amino acid
  MISC_FEATURE (6)..(6): Xaa may be Thr or Ser
PXXXXXW

SEQ ID NO: 30267 - protein, 7 aa, Artificial Sequence
  Synthetic
  MISC_FEATURE (1)..(1): Xaa may be Gly or Ser
  misc_feature (2)..(3): Xaa can be any naturally occurring amino acid
XXXGWAP

SEQ ID NO: 30268 - protein, 7 aa, Artificial Sequence
  Synthetic
  MISC_FEATURE (3)..(3): Xaa may be any naturally occurring hydrophobic amino acid
  misc_feature (4)..(4): Xaa can be any naturally occurring amino acid
  MISC_FEATURE (7)..(7): Xaa may be Lys, Ile, Val or Arg
LTXXTSX

SEQ ID NO: 30269 - protein, 7 aa, Artificial Sequence
  Synthetic
  misc_feature (1)..(2): Xaa can be any naturally occurring amino acid
  MISC_FEATURE (3)..(3): Xaa may be Lys or Arg
  misc_feature (6)..(6): Xaa can be any naturally occurring amino acid
  MISC_FEATURE (7)..(7): Xaa may be Ile, Val or Met
XXXFEXX

SEQ ID NO: 30270 - protein, 7 aa, Artificial Sequence
  Synthetic
  misc_feature (2)..(3): Xaa can be any naturally occurring amino acid
  MISC_FEATURE (6)..(6): Xaa may be Leu, Ile, Ser, Thr, Val or Ala
  MISC_FEATURE (7)..(7): Xaa may be Ala or Pro
SXXGWXX

SEQ ID NO: 30271 - protein, 7 aa, Artificial Sequence
  Synthetic
  misc_feature (2)..(5): Xaa can be any naturally occurring amino acid
  MISC_FEATURE (6)..(6): Xaa may be Gly or Ser
YXXXXXW

SEQ ID NO: 30272 - protein, 7 aa, Artificial Sequence
  Synthetic
  misc_feature (2)..(3): Xaa can be any naturally occurring amino acid
  MISC_FEATURE (4)..(4): Xaa may be Gly or any naturally occurring amino acid
  MISC_FEATURE (6)..(6): Xaa may be Val, Ile, Tyr, Phe or Met
KXXXSXY

SEQ ID NO: 30273 - protein, 7 aa, Artificial Sequence
  Synthetic
  MISC_FEATURE (2)..(2): Xaa may be Phe or Tyr
  misc_feature (3)..(3): Xaa can be any naturally occurring amino acid
  MISC_FEATURE (4)..(4): Xaa may be Gly or Ser
  MISC_FEATURE (5)..(5): Xaa may be Asp or Glu
  MISC_FEATURE (6)..(6): Xaa may be Ser, Ala, Pro, Asn or Gly
  MISC_FEATURE (7)..(7): Xaa may be Ser, Ala, Gly, Thr, Val, Ile or Gln
RXXXXXX

SEQ ID NO: 30274 - protein, 7 aa, Artificial Sequence
  Synthetic
  misc_feature (1)..(3): Xaa can be any naturally occurring amino acid
  MISC_FEATURE (5)..(5): Xaa may be Tyr, Phe or Trp
  MISC_FEATURE (7)..(7): Xaa may be Gln, Ser, Thr,  Ala or Met
XXXGXSX

SEQ ID NO: 30275 - protein, 7 aa, Artificial Sequence
  Synthetic
  misc_feature (1)..(3): Xaa can be any naturally occurring amino acid
XXXPGVW

SEQ ID NO: 30276 - protein, 7 aa, Artificial Sequence
  Synthetic
  misc_feature (2)..(4): Xaa can be any naturally occurring amino acid
GXXXGRW

SEQ ID NO: 30277 - protein, 7 aa, Artificial Sequence
  Synthetic
  MISC_FEATURE (1)..(1): Xaa may be Glu or Asp
  MISC_FEATURE (2)..(2): Xaa may be Val, Gly, Asp, Pro, Leu, Asn or Ala
  MISC_FEATURE (3)..(3): Xaa may be Gly, Pro, Ala, Thr, Asp, Asn or Leu
XXXSGRW

SEQ ID NO: 30278 - protein, 7 aa, Artificial Sequence
  Synthetic
  MISC_FEATURE (2)..(2): Xaa may be Pro, Leu, Tyr, Glu, Gly, Thr, Asp or Ala
  MISC_FEATURE (3)..(3): Xaa may be Gly, Asn, Ser, Asp, Val, Thr or His
  MISC_FEATURE (4)..(4): Xaa may be Asp, Ser, Gly, Glu, Pro, Val, Tyr or Ile
  MISC_FEATURE (5)..(5): Xaa may be Gly, Ala, Ser, Asn and Val
SXXXXRW

SEQ ID NO: 30279 - protein, 7 aa, Artificial Sequence
  Synthetic
  misc_feature (1)..(2): Xaa can be any naturally occurring amino acid
  misc_feature (4)..(4): Xaa can be any naturally occurring amino acid
  MISC_FEATURE (7)..(7): Xaa may be Ser, Thr, Val, Ala, Met, Gln, Ile or His
XXYXGSX

SEQ ID NO: 30280 - protein, 7 aa, Artificial Sequence
  Synthetic
  MISC_FEATURE (2)..(2): Xaa may be Thr, Val or Leu
  MISC_FEATURE (3)..(3): Xaa may be Ser or Gly
  MISC_FEATURE (4)..(4): Xaa may be Ala or Ser
  MISC_FEATURE (5)..(5): Xaa may be Gly, Asn or any naturally occurring amino acid
  MISC_FEATURE (6)..(6): Xaa may be Ser, Gly, Met or any naturally occurring amino acid
  MISC_FEATURE (7)..(7): Xaa may be Thr or Ser
RXXXXXX

SEQ ID NO: 30281 - protein, 7 aa, Artificial Sequence
  Synthetic
  MISC_FEATURE (6)..(6): Xaa may be Lys or Arg
  misc_feature (7)..(7): Xaa can be any naturally occurring amino acid
GSGTVXX

SEQ ID NO: 30282 - protein, 7 aa, Artificial Sequence
  Synthetic
  misc_feature (4)..(5): Xaa can be any naturally occurring amino acid
QNRXXYV

SEQ ID NO: 30283 - protein, 7 aa, Artificial Sequence
  Synthetic
  MISC_FEATURE (4)..(4): Xaa may be Leu or Met
  MISC_FEATURE (6)..(6): Xaa may be Val, Pro, Ile, Arg, Lys, Leu, Met or Trp
  MISC_FEATURE (7)..(7): Xaa may be Thr or Ser
YHPXDXX

The invention claimed is:

1. A method comprising:

providing an adeno-associated virus (AAV) capsid protein;

contacting the AAV capsid protein with a cell that expresses a protein of the lymphocyte antigen-6 (Ly6)/urokinase-type plasminogen activator receptor (uPAR) protein family attached to the surface of the cell; and selecting the AAV capsid protein if it specifically binds to the protein of the Ly6/uPAR protein family attached to the surface of the cell; wherein the protein of the Ly6/uPAR protein family is expressed recombinantly in the cell, and wherein the protein of the Ly6/uPAR protein family is CD59A.

2. The method of claim 1, wherein the AAV capsid protein is an AAV9 capsid protein.

3. The method of claim 2, wherein the AAV9 capsid protein contains an insertion between amino acids 586-592 of SEQ ID NO: 730.

4. The method of claim 1, wherein the protein of the Ly6/uPAR protein family is expressed in the central nervous system.

5. The method of claim 1, wherein the method comprises contacting the AAV capsid protein with a cell that expresses a GPI-anchored protein.

6. The method of claim 1, wherein the AAV capsid protein comprises at least 4 contiguous amino acids of SEQ ID NO: 316.

7. The method of claim 3, wherein the AAV9 capsid protein contains an insertion between amino acids 588-589 of SEQ ID NO: 730.

8. The method of claim 1, wherein the AAV capsid protein is part of an AAV1, AAV2, AAV3, AAV4, AAV5, AAV6, AAV7, AAV8, AAV10 or AAV11.

9. The method of claim 1, wherein the protein of the Ly6/uPAR protein family forms a dimer.

10. The method of claim 1, wherein the method is conducted in vitro.

11. The method of claim 1, wherein the AAV capsid protein comprises SEQ ID NO: 316.

* * * * *